United States Patent 11,596,699 (RNA ENCODING AN ANTIBODY) - sequence listing, part 4

SEQ ID NO: 17961 - RNA, 333 nt, Artificial Sequence
  derived and/or modified sequence opt2 from anti-HIV_048-111339_VR-Chain
caguccguccucacccagccccccuccgucuccgccgcccccggccagaaggucaccaucuccugcaccggcuccuccuccaacaucggcggcuacgccguccacugguaccagcagguccccgccaccgcccccaagcuccucaucuacgagaacaacgagcgccccuccggcauccccgaccgcuucuccggcuccaaguccggcaccuccgccacccucggcaucaccggccuccagaccggcgacgaggccgacuacuacugcggcaccugggacaccucccucuccgccggcggcgucuucggcaccggcaccaaggucaccguccuc

SEQ ID NO: 17962 - RNA, 333 nt, Artificial Sequence
  derived and/or modified sequence opt2 from anti-HIV_048-111055_VR-Chain
caguccgcccucacccagcccgccuccgucuccggcucccccggccaguccaucaccaucuccugcaccggcacccgcuccgacgucggcuacaacuacgucuccugguaccagcagcaccccggcaaggcccccaagcuccucaucuacgagaacaccaagcgccccuccggcauccccgaccgcuucuccggcuccaaguccggcaccuccgccacccucggcaucaccggccuccagaccggcgacgaggccgacuacuacugcggcaccugggacaccucccucuccgccggcggcgucuucggcuccggcaccaaggucaccguccuc

SEQ ID NO: 17963 - RNA, 333 nt, Artificial Sequence
  derived and/or modified sequence opt2 from anti-HIV_048-111027_VR-Chain
caguccguccucacccagccccccuccgucuccgccgcccccggccagaaggucaccaucuccugcuccggcuccaacuccaaccucggcaacaacuacgucuccugguaccagcaccuccccggcaccgccccccgccuccucaucuacgaggacaagaagcgccccuccggcauccccgaccgcuucuccggcuccaaguccggcgccuccgccacccucgacaucaccggccuccagaccggcgacgaggccgacuacuacugcggcaucugggacaccucccucuccgccggcggcgucuucggcaccggcaccaaggucaccguccuc

SEQ ID NO: 17964 - RNA, 333 nt, Artificial Sequence
  derived and/or modified sequence opt2 from anti-HIV_048-109721_VR-Chain
caguccguccucacccagccccccuccgucuccgccgcccccggccagaaggucaccaucuccugcuccggcuccuccuccgacaucggcuccaacuucgucuccugguaccagcaccuccccggcaccgccccccgccuccucaucuacgagaacaaccgccgccccuccggcauccccgaccgcuucuccggcuccaaguccggcaccuccgccacccucgccaucaccggccuccagaccggcgacgaggccgacuacuacugcggcaccugggacaccucccucaaccgcggcggcgucuucggcaccggcaccaaggucaccguccuc

SEQ ID NO: 17965 - RNA, 333 nt, Artificial Sequence
  derived and/or modified sequence opt2 from anti-HIV_048-109666_VR-Chain
caguccguccucacccagccccccuccauguccgccgcccccggcgagcgcgucaccaucuccugcuccggcuccuccuccaacaucggcaaccaccacgucuccugguaccagcagcgccccggcaccgcccccaagcuccucaucuacgagaacaacgagcgccccuccggcauccccgaccgcuucuccggcuccaaguccggcuccuccgccacccucgccaucaccggccuccagaccggcgacgaggccgacuacuacugcggcaccugggacggccgccucaacaucggcggcgucaucggcaccggcaccaaggucaccguccuc

SEQ ID NO: 17966 - RNA, 333 nt, Artificial Sequence
  derived and/or modified sequence opt2 from anti-HIV_048-109196_VR-Chain
caguccguccucacccagccccccuccgucuccgccgcccccggccagaaggucaccaucuccugcuccggcuccuccuccaacaucggcaacaacuacgucuccugguaccagcagcuccccggcaccgcccccaagcuccucaucuacgagaccaacaagcgccccuccggcauccccgaccgcuucuccggcuccaaguccggcaccuccgccacccucgccaucaccggccuccagaccggcgacgaggccgacuacuacugcggcaccugggacaccucccucuccggcggcggcgucuucggcaccggcaccaaggucaccguccuc

SEQ ID NO: 17967 - RNA, 333 nt, Artificial Sequence
  derived and/or modified sequence opt2 from anti-HIV_048-109051_VR-Chain
caguccguccucacccagccccccuccgucuccgccgcccccggccagaaggucaccaucuccugcuccggcaacaacuccaacauggucaacaacuacaucuccugguaccagcuccuccccggcaccccccccaagcuccucaucuucaagaacaacgagcgccccuccggcauccccgaccgcuucuccggcuccaaguccggcaccuccgccacccucggcaucaccggccuccagaccggcgacgaggccgacuacuacugcggcaccugggacaccucccucuccgccggcggcgucuucggcaccggcaccaaggucaccguccuc

SEQ ID NO: 17968 - RNA, 333 nt, Artificial Sequence
  derived and/or modified sequence opt2 from anti-HIV_048-108570_VR-Chain
caguccgcccucacccagccccccuccgucuccgccgcccccggccagaaggucaccaucuccugcuccggcaaguccuccaacaucggcaccaacuucgucuccugguaccagcaguuccccgaggccgcccccaagcuccucaucuacgacaacaacaagcgccccuccggcauccccgaccgcuucuccggcuccaaguccggcaccuccgccacccucggcaucaccggccuccagaccggcgacgaggccgacuacuacugcggcaccugggacggcucccucuccaccggcggcgucaucggcaccggcaccaaggucaccguccuc

SEQ ID NO: 17969 - RNA, 327 nt, Artificial Sequence
  derived and/or modified sequence opt2 from anti-HIV_048-108033_VR-Chain
gagcucacccagucccccuccgucuccgccgcccccggccagcgcgucaccaucuccugcuccggcaacuccuccaacaucggcaacaacuacgucuccugguaccagcuccuccccggcaccgcccccaagcuccucaucuacaagaacgacaagcgccccuccggcauccccgaccgcuucuccggcuccaaguccggcaccuccgccacccucggcaucaccggccuccagaccggcgacgaggccgacuacuacugcggcaccugggacaccucccucuccaccggcggcgucuucggcaccggcaccaaggucaccguccuc

SEQ ID NO: 17970 - RNA, 333 nt, Artificial Sequence
  derived and/or modified sequence opt2 from anti-HIV_048-107279_VR-Chain
caguccguccucacccagccccccuccgucuccgccgcccccggccagaaggucaucaucuccugcuccggcuccuccuccaacaucggcaagaacuacgucuccugguaccagcaccuccccggcaccgcccccaagcuccucaucuacgagaacaacaagcgccccuccggcauccccgaccgcuucuccggcuccaaguccggcaccuccgccacccucggcaucaccggccuccagaccggcgacgaggccgacuacuacugcggcaccugggacgccucccucuccgccggcggcguccucggcaccggcaccaaggucaccguccuc

SEQ ID NO: 17971 - RNA, 333 nt, Artificial Sequence
  derived and/or modified sequence opt2 from anti-HIV_048-106271_VR-Chain
caguccguccucacccagccccccuccgucuccgccgcccccggccagaaggucaccaucuccugcuccggcucccgcuccaacaucggcuccaacuacaucuccugguaccagcagcuccccggcaccgcccccaagcuccucaucuacaagaacgacaagcgccccuccggcauccccgaccgcuucuccggcuccaaguccggcaccuccgccauccucggcaucaccggccuccagaccggcgacgaggccgacuacuacugcggcgccugggacaccucccucuccgccggcggcgucuucggcaccggcaccaaggucaccguccuc

SEQ ID NO: 17972 - RNA, 333 nt, Artificial Sequence
  derived and/or modified sequence opt2 from anti-HIV_048-106054_VR-Chain
caguccguccucacccagccccccuccgucuccgccgcccccggccagcaggucaccaucuccugcuccggcuccaccuccaacaucggcaacaacuacgucuccugguaccagcagguccccggcaccgcccccaagcuccucaucuacgacaacaacaaccgccccuccggcauccccgaccgcuucuccggcuccaaguccggcaccuccgccacccucggcaucuccggccuccagaccggcgacgaggccgacuacuacugcggcaccugggacaccucccucuccggcggcggcgucuucggcaccggcaccaaggucaccguccuc

SEQ ID NO: 17973 - RNA, 333 nt, Artificial Sequence
  derived and/or modified sequence opt2 from anti-HIV_048-104848_VR-Chain
caguccgcccucacccagcccgccuccgucuccggcucccccggccaguccaucaccaucuccugcaccggcaccuccuccgacgucggcuacaacuacgucuccugguaccagcagcuccccggcaccgcccccaagcuccucaucuucgacaacgacgaccgccccuccgagauccccgaccgcuucuccggcuccaaguccggcaccuccgccacccucggcaucaccggccuccagcccggcgacgaggccgacuacuacugcggcaccugggacuccucccucuccgccggcggcgucuucggcaccggcaccaaggucaccguccuc

SEQ ID NO: 17974 - RNA, 333 nt, Artificial Sequence
  derived and/or modified sequence opt2 from anti-HIV_048-104638_VR-Chain
caguccguccucacccagccccccuccgccuccggcacccccggccaccgcgucaccaucuccugcuccggcaacuccuccaacaucggcggcaaccacgucuacugguaccagcagguccccggcaccacccccaagcuccucaucuaccgcaacaacgagcgccccuccggcauccccgaccgcuucuccggcuccaaguccggcaccuccgccacccucggcaucaccggccuccagaccggcgacgaggccgacuacuacugcggcaccugggacaccucccucuccgccggcggcgucuucggcaccggcaccaaggucaccguccuc

SEQ ID NO: 17975 - RNA, 333 nt, Artificial Sequence
  derived and/or modified sequence opt2 from anti-HIV_048-104567_VR-Chain
caguccguccucacccagccccccuccgccuccggcacccccggccagcgcgucaccaucuccugcuccggcuccaacuccaacaucggcaccaacuucgucaacugguaccagcacguccccggccgcgcccccaagcuccucaucuacaagaacaccgagcgccccuccggcauccccgaccgcuucuccggcuccaaguccggcaccuccgccacccucgacaucaccggccuccagaccggcgacgaggccgacuacuacugcggcaccugggacaccucccucuccgccggcggcgucuucggcaccggcaccaaggucaccguccuc

SEQ ID NO: 17976 - RNA, 333 nt, Artificial Sequence
  derived and/or modified sequence opt2 from anti-HIV_048-102804_VR-Chain
caguccguccucacccagccccccuccgucuccaccgcccccggccagaaggucaccaucuccugcuccggcuccuccuccaacaucggcuacuccuacgucuccugguuccagcaccuccccggcaccgcccccaagcuccucaucuacggcaacuccaaccgccccuccggcguccccgaccgcuucuccggcuccaaguccggcaccuccgccucccucgccaucaccggccuccagaccggcgacgaggccgacuacuacugcggcaccugggacuccucccucuccgccggcggcgucuucggcaccggcaccaaggucaccguccuc

SEQ ID NO: 17977 - RNA, 333 nt, Artificial Sequence
  derived and/or modified sequence opt2 from anti-HIV_048-101676_VR-Chain
caguccguccucacccagccccccuccgucuccggcgcccccggccaguccgucaccaucuccugcaccggcaccuccuccaacaucggcgacuucgacguccacugguaccagcagcuccccggcaccgcccccaagcuccuccucuacgagaacaacaagcgccccuccggcauccccgaccgcuucuccggcuccaaguccggcaccuccgccacccucgccaucaccggccuccagaccggcgacgaggccgacuacuacugcggcaccugggacggcucccucuccaccggcggcgucaucggcaccggcaccaaggucaccguccuc

SEQ ID NO: 17978 - RNA, 333 nt, Artificial Sequence
  derived and/or modified sequence opt2 from anti-HIV_048-097603_VR-Chain
caguccguccucacccagccccccuccgucuccgccgcccccggccagaaggucaccaucuccugcuccggcuccuccuccaacaucggcaacaacuacgucuccugguaccagcagcuccccggcaccgcccccaagcuccucaucuacgacaccgucaagcgccccuccggcauccccgaccgcuucuccggcuccaaguccggcaccuccgccacccucggcaucaccggccuccagaccggcgacgaggccgacuacuacugcggcaccugggacuccucccucuccggcggcggcgucuucggcaccggcaccaaggucaccguccuc

SEQ ID NO: 17979 - RNA, 333 nt, Artificial Sequence
  derived and/or modified sequence opt2 from anti-HIV_048-097107_VR-Chain
caguccguccucacccagccccccuccgucuccgccgcccccggccagaaggucaccaucuccugcuccggcuccuccuccaacaucgagaacaacuacgucuccugguaccgccagguccccggcaccgcccccaagcuccucaucuacaagaacgacaaccgccccuccggcauccccgaccgcuucuccggcuccaaguccggcaccuccgccacccucggcaucaccggccuccagaccggcgacgaggccgacuacuacugcggcaucugggacaccucccucuccgccggcggcgucuucggcaccggcaccaaggucaccguccuc

SEQ ID NO: 17980 - RNA, 333 nt, Artificial Sequence
  derived and/or modified sequence opt2 from anti-HIV_048-096871_VR-Chain
cagcccguccucacccagccccccuccgccuccggcacccccggccagcgcgucaccaucuccugcuccggcuccuccuccaacaucggcuccaacuacgucuacugguaccagcagcuccccggcaccacccccaagcuccucaucuaccgcaacaaccagcgccccuccggcauccccgaccgcuucuccggcuccaaguccggcaccuccgccacccucggcaucaccggccuccagaccggcgacgaggccgacuacuacugcggcaccugggacaccucccucuccaccggcggcgucuucggcaccggcaccaaggucaccguccuc

SEQ ID NO: 17981 - RNA, 333 nt, Artificial Sequence
  derived and/or modified sequence opt2 from anti-HIV_048-096668_VR-Chain
caguccguccucacccagccccccuccgucuccgccgcccccggccagaaggucaccaucuccugcuccggcuccggcuccaacaucggcaacaacuacgucuccugguaccagcagcuccccggcaccgcccccaagcuccucaucuacaagaacaccgagcgccccuccggcauccccgaccgcuucuccggcuccaaguccggcaccuccgccacccucgacaucaccggccuccagaccggcgacgaggccgacuacuacugcggcaccugggacaccucccucuccgccggcggcgucuucggcaccggcaccaaggucaccguccuc

SEQ ID NO: 17982 - RNA, 333 nt, Artificial Sequence
  derived and/or modified sequence opt2 from anti-HIV_048-095236_VR-Chain
caguccguccucacccagccccccuccgucuccgccccccccggccagaaggucaccaucuccugcuccggcaccaccuccaacaucggcuccaacuacgucgccugguaccagcagcuccccggcaccgcccccaagcucgucaucuacgagaacuccaagcgccccuccggcauccccgaccgcuucuccggcuccaaguccggcaccuccgccacccucggcaucaccggccuccagaccggcgacgaggccgacuacuacugcggcaccugggacaccucccucuccgccggcggcgucuucggcuccggcaccaaggucaccguccuc

SEQ ID NO: 17983 - RNA, 333 nt, Artificial Sequence
  derived and/or modified sequence opt2 from anti-HIV_048-094155_VR-Chain
caguccguccucacccagccccccuccgucuccgccgcccccggccagaaggucaccgucuccugcuccggcuccuccuccgacaucggcgagaacuacgucuccugguaccagcaguuccccgagaccgcccccaagcuccucaucuacgacaacaacaagcgccccuccggcauccccgaccgcuucuccggcuccaaguccggcaccuccgccacccucgccaucaccggccuccagaccggcgacgaggccgacuacuacugcggcaccugggacuccucccucuccgccggcggcgucuucggcaccggcaccaaggucaccguccuc

SEQ ID NO: 17984 - RNA, 333 nt, Artificial Sequence
  derived and/or modified sequence opt2 from anti-HIV_048-093219_VR-Chain
cagccccuccucacccagccccccgccgucuccgccacccccggccagcgcgucaccaucuccugcaccggcuccuccuccaacaucggccgcaccuucgucaacugguaccagcagcuccccggcaccgcccccaagcuccucaucuacgagaacuccaagcgccccuccggcauccccgaccgcuucuccggcuccaaguccggcaccuccgccacccucggcaucaccggccuccagaccggcgacgaggccgacuacuacugcggcaccugggacaccucccucuccgccggcggcgucuucggcuccggcaccaaggucaccguccuc

SEQ ID NO: 17985 - RNA, 333 nt, Artificial Sequence
  derived and/or modified sequence opt2 from anti-HIV_048-092976_VR-Chain
caguccguccucacccagccccccuccgucuccgccgccuccggccagaaggucaccaucuccugcuccggcuccuccuccaacaucggcaacaacuacgucuccugguaccagcaccuccccggcaccgcccccaagcuccucaucuacaagaacgacaagcgccccuccggcauccccgaccgcuucuccggcuccaaguccggcaccuccgccacccucggcaucaccggccuccagaccggcgacgaggccgacuacuacugcggcaccugggacaccucccucuccgccggcggcgucuucggcaccggcaccaaggucaccguccuc

SEQ ID NO: 17986 - RNA, 333 nt, Artificial Sequence
  derived and/or modified sequence opt2 from anti-HIV_048-090866_VR-Chain
caguccguccucacccagccccccuccgucuccgccgcccccggccagaaggucaccaucuccugcuccggcucccgcuccaacaucggcuccaacuacaucuccugguaccagcagcuccccggcaccgcccccaagcuccucaucuacgacaacaacaagcgccccuccggcauccccgaccgcuucuccggcuccaaguccggcaccuccgccacccucggcaucaccggccuccagaccggcgacgaggccuacuacuacugcggcaccugggacaccucccucuccgccggcggcgucuucggcuccggcaccaaggucaccguccuc

SEQ ID NO: 17987 - RNA, 333 nt, Artificial Sequence
  derived and/or modified sequence opt2 from anti-HIV_048-090650_VR-Chain
caguccgcccucacccagcccgccuccgucuccggcucccucggccaguccaucaccaucuccugcuccggcuccuccuccaccaucggcaacaacuacgucuccugguaccagguccuccccggcgccgcccccaagcuccucaucugcaagaacaacgagcgccccuccggcauccccgaccgcuucuccggcuccaaguccggcaccuccgccacccucggcaucaccggccuccagaccggcgacgaggccgacuacuacugcggcaccugggacaccucccucuccgccggcggcgucuucggcaccggcaccaaggucaccguccuc

SEQ ID NO: 17988 - RNA, 333 nt, Artificial Sequence
  derived and/or modified sequence opt2 from anti-HIV_048-089009_VR-Chain
caguccguccucacccagccccccuccgucuccgccgcccccggccagaaggucaccaucuccugcuccggcggcuccuccaacaucggcaacaacuacgucuccugguaccagcagcuccccgagaccgcccccaagcucaucaucuacgacaacaacaagcgccccuccggcauccacgaccgcuucuccggcuccaaguccggcaccuccgccacccucgacaucaccgcccuccagaccggcgacgaggccgacuacuacugcggcaccugggacaccucccucuccgccggcggcgucuucggcaccggcaccaaggucaccguccuc

SEQ ID NO: 17989 - RNA, 333 nt, Artificial Sequence
  derived and/or modified sequence opt2 from anti-HIV_048-088654_VR-Chain
caguccgcccucacccagccccgcuccgucuccgccgcccccggccagaaggucuccaucuccugcuccggccgcuccaccaaccucggcuacaacuacgucuccugguaccagcaccuccccggcgccgcccccaagguccucaucuacgagaacaacaagcgccccuccggcauccccgaccgcuucuccggcuccaaguccggcaccuccgccacccucggcaucaccggccuccagaccggcgacgaggccgacuacuacugcggcaccugggacaccucccucuccgccggcggcgucuucggcuccggcaccaaggucaccguccuc

SEQ ID NO: 17990 - RNA, 333 nt, Artificial Sequence
  derived and/or modified sequence opt2 from anti-HIV_048-086513_VR-Chain
caguccgcccucacccagccccccuccgucuccgccgcccccggccagaaggucaccaucuccugcuccggcuccaccuccaacaucggcaacaacuacgucuccugguaccagcagcuccccggcaccgcccccaagcuccucaucuacaagaacgacaaccgccccuccggcauccccgaccgcuucuccuccuccaaguccggcaccuccgccacccucggcaucaccggccuccagaccggcgacgaggccgacuacuacugcggcaucugggacaccucccucuccgccggcggcgucuucggcaccggcaccaaggucaccguccuc

SEQ ID NO: 17991 - RNA, 324 nt, Artificial Sequence
  derived and/or modified sequence opt2 from anti-HIV_048-086024_VR-Chain
cucgcccagccccccuccgucuccggcacccccggccagcgcgucaccaucuccugcuccggcuccuccuccaacaucggcuccaacgccgucaacugguaccagcaguuccccggcaccgcccccaagcuccucaucuacgacaccgacaagcgccccuccggcauccccgaccgcuucuccggcuccaaguccggcaccuccgccauccucggcaucaccggccuccagaccggcgacgaggccgacuacuacugcggcgccugggacaccucccucuccgccggcggcgucuucggcaccggcaccaaggucaccguccuc

SEQ ID NO: 17992 - RNA, 333 nt, Artificial Sequence
  derived and/or modified sequence opt2 from anti-HIV_048-085857_VR-Chain
caguccgcccucacccagccccgcuccgucuccggcucccucggccaguccgucaccaucuccugcaccggcaccaccuccgacgucggcuucgacuacgucuccugguaccagguccuccccggcaccgcccccaagcuccucaucuacaagaacgacaagcgccccuccggcauccccgaccgcuucuccggcuccaaguccggcaccuccgccacccucggcaucaccggccuccagaccggcgacgaggccgacuacuacugcggcaccugggacaccucccucuccaccggcggcgucuucggcaccggcaccaaggucaccguccuc

SEQ ID NO: 17993 - RNA, 333 nt, Artificial Sequence
  derived and/or modified sequence opt2 from anti-HIV_048-084277_VR-Chain
caguccguccuccgccagccccccucccucuccggcgcccccggccagcgcgucacccucuccugcaccggcuccuccuccaacaucggcggcuacgacguccacugguaccagcacguccccggcaccgcccccaagcuccucaucuacgagaacaccaagcgccccuccggcauccccgaccgcuucuccggcuccaaguccggcaccuccgccacccucggcaucaccggccuccagaccggcgacgaggccgacuacuacugcggcaccugggacaccucccucuccgccggcggcgucuucggcuccggcaccaaggucaccguccuc

SEQ ID NO: 17994 - RNA, 333 nt, Artificial Sequence
  derived and/or modified sequence opt2 from anti-HIV_048-084245_VR-Chain
caguccacccucacccagccccccuccgucuccgccgcccccggccagaaggucaccaucuccugcuccggcuccaacuccaacaucggcaagcacuacgucuccugguaccagcaguuccccggcgccguccccaagcuccucaucuacgagaacaagaagcgccccuccggcauccccgaccgcuucuccggcuccaaguccgacaccuccgccacccucgacaucaccggccuccagaccggcgacgaggccgacuacuacugcggcaccugggacaccucccucuccgccggcggcgucuucggcuccggcaccaaggucaccguccuc

SEQ ID NO: 17995 - RNA, 333 nt, Artificial Sequence
  derived and/or modified sequence opt2 from anti-HIV_048-082487_VR-Chain
cagucccuccucacccagccccccuccgucuccgccgcccccggccagaaggucaccaucuccugcuccggcuccuccuccaccaucggcaacaacuacgucuccugguaccagguccuccccggcgccgcccccaagcuccucaucugcaagaacaacgagcgccccuccggcauccccgaccgcuucuccggcuccaaguccggcaccuccgccacccucggcaucaccggccuccagaccggcgacgaggccgacuacuacugcggcaccugggacaccucccucuccgccggcggcgucuucggcuccggcaccaaggucaccguccuc

SEQ ID NO: 17996 - RNA, 333 nt, Artificial Sequence
  derived and/or modified sequence opt2 from anti-HIV_048-081787_VR-Chain
caguccguccucacccagccccccuccgucuccggcgcccccggccagcgcgucaccaucuccugcaccggcuccuccuccaacaucggcuccuacgacguccacugguaccagcagcuccccggcaccgcccccaagcuccucaucuacgagaacuccaagcgccccuccggcauccccgaccgcuucuccggcuccaaguccggcaccuccgccacccucggcaucaccggccuccagaccggcgacgaggccgacuacuacugcggcaccugggacaccucccucuccggcggcggcgucuucggcaccggcaccaaggucaccguccuc

SEQ ID NO: 17997 - RNA, 333 nt, Artificial Sequence
  derived and/or modified sequence opt2 from anti-HIV_048-081062_VR-Chain
caguccguccucacccagccccccuccgucuccgccgcccccggccagaaggucaccaucuccugcuccggcaccuccuccaacaucggcgccaacuacgucuccugguaccagcagguccccggcaccgcccccaagcuccucaucuacgagaacaacaagcgccccuccggcacccccgaccgcuucuccggcuccaaguccggcaccuccgccacccucggcaucaccggccuccagaccggcgacgaggccgacuacuacugcggcaccugggacaccucccucuccgccggcggcgucuucggcuccggcaccaaggucaccguccuc

SEQ ID NO: 17998 - RNA, 333 nt, Artificial Sequence
  derived and/or modified sequence opt2 from anti-HIV_048-079639_VR-Chain
caguccguccucacccagccccccuccgucuccgccgcccccggccagaaggucaccaucuccugcuccggcuccuccuccaacaucggcaagaacuacgucuccugguaccagcaccuccccggcaccgcccccaagcuccucaucuacgagaacaacaagcgccccuccggcauccccgaccgcuucuccggcuccaaguccggcaccgccgccacccucggcaucaccggccuccagaccggcgacgaggccggcuacuacugcggcaccugggacaccucccucuccgccggcggcgucuucggcaccggcaccaaggucaccguccuc

SEQ ID NO: 17999 - RNA, 333 nt, Artificial Sequence
  derived and/or modified sequence opt2 from anti-HIV_048-079126_VR-Chain
caguccguccucacccagccccccuccgucuccgccgcccccggccagaaggucaccaucuccugcuccggcuccuccuccaacaucggcaacaacuacgucuccugguaccagcaccuccccggcaccccccccaagcuccucaucuucaagaacaacgagcgccccuccggcauccccgaccgcuucuccggcuccaaguccggcaccuccgccacccucggcaucaccggccuccagaccggcgacgaggccgacuacuacugcggcaccugggacaccucccucuccgccggcggcgucuucggcaccggcaccaaggucaccguccuc

SEQ ID NO: 18000 - RNA, 333 nt, Artificial Sequence
  derived and/or modified sequence opt2 from anti-HIV_048-073118_VR-Chain
caguccguccucacccagccccccuccgucuccgccgccccccgccacaacgucaccaucuccugcuccggcggcuccuccaacaucggcaacaacuucgucuccugguaccaguaccuccccggcaccgcccccaagcuccucaucuacgacaacaacaagcgccccuccggcauccccgaccgcuucuccggcuccaaguccggcaccuccgccacccucggcaucaccggccuccagaccggcgacgaggccgacuacuacugcgccaccugggacaccucccucuccgccggcggcgucuucggcaccggcaccaaggucaccguccuc

SEQ ID NO: 18001 - RNA, 333 nt, Artificial Sequence
  derived and/or modified sequence opt2 from anti-HIV_048-070264_VR-Chain
caguccguccucacccagucccccuccgucuccgccgcccccggccagaaggucaccaucuccugcuccggcaccuccuccaacaucggcaacaccuacgucuccugguaccagcagcuccccggcaccgcccccaagcuccucaucuacaagaacgacaagcgccccuccggcauccccgaccgcuucuccggcuccaaguccggcaccuccgccacccucggcaucaccggccuccagaccggcgacgaggccgacuacuacugcggcaccugggacuccucccucuccgccggcggcgucuucggcaccggcaccaaggucaccguccuc

SEQ ID NO: 18002 - RNA, 333 nt, Artificial Sequence
  derived and/or modified sequence opt2 from anti-HIV_048-069426_VR-Chain
caguccguccucacccagccccccuccgucuccgccgcccccggccagaaggucaccaucuccugcuccggcuccuccuccaccaucggcaacaacuacgucuccugguaccagcagcuccccggcaccgcccccaagcuccucaucuacaagaacaacaagcgccccuccggcguccccgaccgcuucuccggcuccaaguccggcaccuccgccacccccggcaucaccggccuccagaccggcgacgaggccgacuacuacugcggcaccugggacaccucccucuccgccggcggcgucuucggcaccggcaccaaggucaccguccuc

SEQ ID NO: 18003 - RNA, 333 nt, Artificial Sequence
  derived and/or modified sequence opt2 from anti-HIV_048-068564_VR-Chain
caguccgcccucacccagccccgcuccgucuccggcucccccggccaguccgucgccaucuccugcaccggcaccuccuccgacgucggcuacaacuacgucuccugguaccagguccuccccggcaccgcccccaagcuccucaucuacaagaacaacgagcgccccuccggcauccccgaccgcuucuccggcuccaaguccggcaccuccgccacccucggcaucaccggccuccagaccggcgacgaggccgacuacuacugcggcaccugggacaccucccucuccgccggcggcgucuucggcaccggcaccaaggucaccguccuc

SEQ ID NO: 18004 - RNA, 333 nt, Artificial Sequence
  derived and/or modified sequence opt2 from anti-HIV_048-068345_VR-Chain
caguccguccucacccagacccccuccgucuccgccgcccccggccagcgcgucaccaucuccugcuccggcuccaccuccaacaucggcaacaacuacgucuccugguaccagcagcuccccggcaccgcccccaagcuccucaucuacgagaacaacaagcgccccuccggcauccgcgaccgcuucuccgccuccaaguccggcaccuccgccacccucggcaucaccggccuccagaccggcgacgaggccgacuacuacugcggcaccugggacaccucccucuccgccggcggcgucuucggcaccggcaccaaggucaccguccuc

SEQ ID NO: 18005 - RNA, 333 nt, Artificial Sequence
  derived and/or modified sequence opt2 from anti-HIV_048-067337_VR-Chain
caguccguccucacccagccccccuccgucuccgccgcccccggccagaaggucaccaucuccugcuccggcgccuccuacaacaucggcaagaacuccgucuccugguaccagcagcuccccggcaccgcccccaagcuccucaucuacaagaacgacaagcgccccuccggcauccccgaccgcuucuccggcuccaaguccggcgccuccgccacccucgacaucaccggccuccagaccggcgacgaggccgacuacuacugcggcaucugggacaccucccucuccgccggcggcgucuucggcaccggcaccaaggucaccguccuc

SEQ ID NO: 18006 - RNA, 333 nt, Artificial Sequence
  derived and/or modified sequence opt2 from anti-HIV_048-067180_VR-Chain
caguccguccucacccagccccccuccgucuccgccgcccccggccagaaggucaccaucuccugcuccggcuccucccccaacaucggcaacaacuacgucuccugguaccagcgccuccccggcaccgcccccaagcuccucaucuacgagaacgaccagcgccccuccggcauccccgaccgcaucuccggcuccaaguccggcaccuccgccacccucggcaucaccggccuccagaccggcgacgaggccgacuacuacugcggcaccugggacaccucccucuccaccggcggcgucuucggcaccggcaccaaggucaccguccuc

SEQ ID NO: 18007 - RNA, 333 nt, Artificial Sequence
  derived and/or modified sequence opt2 from anti-HIV_048-063017_VR-Chain
caguccguccucacccagccccccuccgucuccgccgcccccggccagaaggucaccaucuccugcuccggcuccuccuccaacaucggcaacaacuacgucuccugguaccagcaccaccccggcaaggcccccaagcucaugaucuacgaggucuccaagcgccccuccggcauccccgaccgcuucuccggcuccaaguccggcaccuccgccacccucggcaucaccggccuccagaccggcgacgaggccgacuacuacugcggcaccugggacaccucccucaaccgcggcggcgucuucggcaccggcaccaaggucaccguccuc

SEQ ID NO: 18008 - RNA, 333 nt, Artificial Sequence
  derived and/or modified sequence opt2 from anti-HIV_048-061885_VR-Chain
caguccguccucacccagccccccuccgucuccgccgcccccggccagaaggucaccaucuccugcuccggcuccuccuccaacaucggcucccacuacaucuccugguaccagcaguuccccggcgccgcccccaagcuccucaucuacgagaacgacaagcgccccuccggcauccccgaccgcuucuccgccuccaaguccggcaccuccgccacccucggcaucaccggccuccagaccggcgacgaggccgacuacuacugcggcaccugggacaccucccucuccgccggcggcgucuucggcaccggcaccaaggucaccguccuc

SEQ ID NO: 18009 - RNA, 333 nt, Artificial Sequence
  derived and/or modified sequence opt2 from anti-HIV_048-061671_VR-Chain
caguccguccucacccagccccccuccgccuccggcacccccggccagcgcgucaccaucuccugcuccggcucccgcuccaacaucggcuccaacuacgucuacugguaccagcaguuccccggcaccgcccccaagcuccucaucuacgagaacaacaagcgccccuccggcauccccgaccgcuucuccggcuccaaguccggcaccuccgccacccucggcaucaccggccuccagaccggcgacgaggccgacuacuacugcgccaccugggacaccucccucuccgccggcggcgucuucggcaccggcaccaaggucaccguccuc

SEQ ID NO: 18010 - RNA, 333 nt, Artificial Sequence
  derived and/or modified sequence opt2 from anti-HIV_048-060700_VR-Chain
caguccguccucacccagcuccccucccucuccgccgcccccggccagaaggucaccaucuccugcuccggcuccuccuccaacaucggcaacaacuacgucuccugguaccagcagcuccccggcaccgcccccaagcuccucaucuacgagaacaacaagcgccccuccggcauccccgaccgcuucuccggcuccaaguccggcaccuccgccacccucggcaucaccggccuccagaccggcgacgaggccgaguacuacugcgccaccugggacgccucccucuccggcggcggcgucuucggcaccggcaccaaggucaccguccuc

SEQ ID NO: 18011 - RNA, 333 nt, Artificial Sequence
  derived and/or modified sequence opt2 from anti-HIV_048-060592_VR-Chain
caguccguccucacccagccccccuccgucuccgccgcccccggccagaaggucaccaucuccugcuccggcuccuccuccaacaucggcaagaacuacgucuccugguaccagcaguuccccggcaccgcccccaagcuccucaucuacgagaacaacaagcgccccuccggcauccccgaccgcuucuccgccuccaaguccgccaccuccgccacccucgucaucaccggccuccagaccggcgacgaggccgucuacuacugcggcaccugggacaccucccucuccgccggcggcgucuucggcuccggcaccaaggucaccguccuc

SEQ ID NO: 18012 - RNA, 333 nt, Artificial Sequence
  derived and/or modified sequence opt2 from anti-HIV_048-060300_VR-Chain
cagcccguccucacccagccccccuccgccuccggcacccccggccagcgcgucaccaucuccugcuccggcuccuccuccaacaucggcaccaacaccgucaacugguaccagcaguuccccggcaccgcccccaagcuccucaucuacaagaacaacgagcgccccuccggcauccccgaccgcuucuccggcuccaaguccggcaccuccgccacccucggcaucaccggccuccagaccggcgacgaggccgacuacuacugcggcaccugggacaccucccucuccggcggcggcgucuucggcaccggcaccaaggucaccguccuc

SEQ ID NO: 18013 - RNA, 333 nt, Artificial Sequence
  derived and/or modified sequence opt2 from anti-HIV_048-059141_VR-Chain
cagcccguccucacccagccccccuccgccuccggcacccccggccagcgcgucuccaucuccugcuccggcaacuucuccaacaucggcuccaaguacgucuacugguaccagcagauccccggcaccgcccccaacgucaucaucuaccgcaccaaccuccgccccuccggcauccccgaccgcuucuccgccuccaaguccggcaccuccgccacccucggcaucaccggccuccagaccggcgacgaggccgacuacuacugcggcaccugggacaccucccucuccgccggcggcgucuucggcaccggcaccaaggucaccguccuc

SEQ ID NO: 18014 - RNA, 333 nt, Artificial Sequence
  derived and/or modified sequence opt2 from anti-HIV_048-057777_VR-Chain
caguccguccucacccagccccccucccucuccgccgcccccggccagcgcgucaccaucuccugcuccggcuccuccuccaacaucggcaacaacuacgucuccugguaccagcaguuccccggcaccgcccccacccuccucaucuacgagaacgacaagcgccccuccggcauccccgaccgcuucuccgccuccaaguccggcaccuccgccacccucggcaucaccggccuccaggccggcgacgaggccgacuacuacugcggcaccugggacaccucccucuccgccggcggcgucuucggcaccggcaccaaggucaccguccuc

SEQ ID NO: 18015 - RNA, 333 nt, Artificial Sequence
  derived and/or modified sequence opt2 from anti-HIV_048-056928_VR-Chain
caguccguccucacccagccccccuccgucuccgccgcccccggccagaaggucaccaucuccugcuccggcuccuccuccaccaucggcaacaacuacgucuccugguaccagcuccuccccggcaccgcccccaagcuccucaucuacgacaacgacaaccgccccuccgacauccccgaccgcuucuccggcuccaaguccggcaccuccgccacccucggcaucaccggccuccagaccggcgacgaggccgacuacuacugcggcgccugggacaccucccucuccgccggcggcgucuucggcaccggcaccaaggucaccguccuc

SEQ ID NO: 18016 - RNA, 333 nt, Artificial Sequence
  derived and/or modified sequence opt2 from anti-HIV_048-056131_VR-Chain
caguucguccucacccagcccgccuccgucuccggcucccccggccaguccaucaccaucuccugcuccggcaccuccuccgacgucggcuacaacuacgucuccugguaccagcagcuccccggcaccgcccccaagcuccucaucuacgagaacaccaagcgccccuccggcauccccgaccgcuucuccggcuccaaguccggcaccuccgccacccucggcaucaccggccuccagaccggcgacgaggccgacuacuacugcggcaccugggacaccucccucuccgccggcggcgucuucggcuccggcaccaaggucaccguccuc

SEQ ID NO: 18017 - RNA, 333 nt, Artificial Sequence
  derived and/or modified sequence opt2 from anti-HIV_048-055864_VR-Chain
caguccguccucacccagccccccuccgucuccgucgcccccggccagaaggucaccaucuacugcuccggcuccuccuccaacaucggcaagaacuccgucuccugguacguccagguccccggcaccgcccccaaguuccucaucuacgagaacaaccagcgccccuccggcaucuccgaccgcuucuccggcuccaaguccggcaccuccgccacccucggcaucuccggccuccagaccggcgacgaggccgacuacuacugcggcaccugggacaccucccucuccggcggcggcgucuucggcaccggcaccaaggucaccguccuc

SEQ ID NO: 18018 - RNA, 333 nt, Artificial Sequence
  derived and/or modified sequence opt2 from anti-HIV_048-055094_VR-Chain
caguccguccucacccagccccccuccgucuccggcgcccccggccagcgcgucaccaucuccugcuccgccuccuccuccuccaucggcaacgacuucgucuccugguaccagcagcuccccggcaccgcccccaagcuccucaucuccgagaacaacaagcgccccuccggcauccccgaccgcuucuccggcuccaaguccggcaccuccgccacccucggcaucaccggccuccagaccggcgacgaggccgacuacuacugcggcaccugggacuccucccucuccgccggcggcgucuucggcaccggcaccaaggucaccguccuc

SEQ ID NO: 18019 - RNA, 333 nt, Artificial Sequence
  derived and/or modified sequence opt2 from anti-HIV_048-054343_VR-Chain
caguccguccucacccagccccccuccgucuccggcgcccccggccagcgcgucaccaucuccugcaccggcuccuccuccaacaucggcggcuacgacgucaacugguaccagcagcuccccggcaccgcccccaagcuccucaucuucaagaacaacgagcgccccuccggcauccccgaccgcuucuccggcuccaaguccggcaccuccgccacccucggcaucaccggccuccagaccggcgacgaggccgacuacuacugcggcaccugggacaccucccucuccgccggcggcgucuucggcaccggcaccaaggucaccguccuc

SEQ ID NO: 18020 - RNA, 333 nt, Artificial Sequence
  derived and/or modified sequence opt2 from anti-HIV_048-054193_VR-Chain
caguccguccucacccagccccccuccgucuccgccgcccccggccagaaggucaccaucuccugcuccggcggcuccuccaacaucggcaacaacuacgucuccugguaccaccagguccccggcaccgcccccaagcuccucaucuucgagaacaacaagcgccccuccggcauccccgaccgcuucuccggcuccaaguccggcaccuccgccacccucggcaucaccggccuccagaccggcgacgaggccgacuacuacugcggcaccugggacaccucccucuccggcggcggcgucuucggcaccggcaccaaggucaccguccuc

SEQ ID NO: 18021 - RNA, 333 nt, Artificial Sequence
  derived and/or modified sequence opt2 from anti-HIV_048-052521_VR-Chain
caguccguccucacccagccccccuccgucuccgccgcccccggccagaaggucaccaucuccugcuccggcuccuccuccaacaucggccgccacuccgucuccugguaccagcagcuccccggcaccgcccccaagcuccucaucuacgacaccgacaagcgccccuccggcauccccgaccgcuucuccggcuccaaguccggcaccuccgccacccucggcaucaccggccuccagaccggcgacgaggccgacuacuacugcggcaccugggacaccucccucuccggcggcggcgucuucggcaccggcaccaaggucaccguccuc

SEQ ID NO: 18022 - RNA, 333 nt, Artificial Sequence
  derived and/or modified sequence opt2 from anti-HIV_048-049037_VR-Chain
caguccguccucacccagccccccuccgucuccgccgcccccggccagaaggucaccaucuccugcuccggcuccuccuucaacaucggcaacaacuacgucuccugguaccagcaccuccccggcaccgcccccaagcuccucaucuacgccgccgucacccgccccuccggcauccccgaccgcuucuccggcuccaaguccggcaccuccgccacccucgacaucaccggccuccagaccggcgacgaggccgacuacuacugcggcaccugggacaccucccucuccgccggcggcgucuucggcaccggcaccaaggucaccguccuc

SEQ ID NO: 18023 - RNA, 333 nt, Artificial Sequence
  derived and/or modified sequence opt2 from anti-HIV_048-048720_VR-Chain
caguccguccucacccagccccccgccgucuccgccgcccccggccagcgcgucgccaucuccugcuccggcaccuccuccaacaucggcuccaaccucgucuccugguaccagcagcuccccggcaaggccccccgccuccucaucuacgacaacuacaagcgccccuccggcauccccgaccgcuucuccggcuccaaguccggcaccuccgccacccucggcaucaccggccuccagaccggcgacgaggccgacuacuacugcggcaccugggacaccucccucuccaccggcggcgucuucggcaccggcaccaaggucaccguccuc

SEQ ID NO: 18024 - RNA, 333 nt, Artificial Sequence
  derived and/or modified sequence opt2 from anti-HIV_048-048542_VR-Chain
caguccguccucacccagccccccuccgucuccgccgcccccggccagaaggucaccaucuccugcuccggcuccuccuccaacaucggcaacaacuucgucuccugguaccagcagcuccccggcaccgcccccaagcuccucaucuacaacaacgaccgccgccccuccggcguccccgaccgcuucuccgccuccaaguucggcaccgccgccacccucggcaucaccggccuccagaccggcgacgaggccgacuacuacugcggcaccugggacuccucccucuccgccggcggcgucuucggcaccggcaccaaggucaccguccuc

SEQ ID NO: 18025 - RNA, 333 nt, Artificial Sequence
  derived and/or modified sequence opt2 from anti-HIV_048-047777_VR-Chain
caguccguccucacccagccccccuccgccuccggcacccccggccagcgcgucaccaucuccugcuccggcuccuccgccaacaucggcaccaacuacgucuucugguaccagcaccuccccggcaccgcccccaagcuccucaucuacgagaacaacaagcgccccuccggcauccccgaccgcuucuccggcuccaaguccggcaccuccgccacccucggcaucaccggccuccagaccggcgacgaggccgacuacuacugcggcaccugggacuccucccucuccgccggcggcgucuucggcaccggcaccaaggucaccguccuc

SEQ ID NO: 18026 - RNA, 333 nt, Artificial Sequence
  derived and/or modified sequence opt2 from anti-HIV_048-046841_VR-Chain
caguccguccucacccagccccccuccgucuccgccgcccucggccagaaggucaccaucaccugcuccggcgacaacggcaacaucggcuaccacuacgucuccugguaccagcaggucggccgcgccgcccccaagcuccucaucuacgccaacaacaagcgccccuccggcauccccgaccgcuucuccggcuccaaguccggcaccuccgccacccucggcaucaccggccuccagaccggcgacgaggccgacuacuacugcggcaccugggacaccucccucuccgccggcggcgucuucggcuccggcaccaaggucaccguccuc

SEQ ID NO: 18027 - RNA, 333 nt, Artificial Sequence
  derived and/or modified sequence opt2 from anti-HIV_048-046202_VR-Chain
caguccguccucacccagccccccuccgucuccgccgcccccggccagaaggucaccaucuccugcuccggcuccuccuccaacaucggcaacaacuacgucuccugguaccagcaccuccccggcaccgcccccaagcuccucaucuacgacaccuacaagcgccacuccggcguccccgaccgcuucuccaacuccaaguccggcaccuccgccacccucgccaucaccggccuccagaccggcgacgagggcgacuacuacugcggcgccugggacaccucccucuccgccggcggcgucuucggcaccggcaccaaggucaccguccuc

SEQ ID NO: 18028 - RNA, 333 nt, Artificial Sequence
  derived and/or modified sequence opt2 from anti-HIV_048-046059_VR-Chain
caguccguccucacccagccccccuccgucuccgccgcccccggccagaacgucaccaucuccugcuccggcaccuccuccaacaucgagaacaacuacgucuccugguaccagacccuccccggcaccgcccccaagcuccucaucuacgacaacaacaagcgccccuccggcauccccgaccgcuucuccggcuccaaguccggcaccuccgccacccucggcaucaccggccuccagaccggcgacgaggccgacuacuacugcggcaccugggacuccucccucuccgccggcggcgucuucggcaccggcaccaaggucaccguccuc

SEQ ID NO: 18029 - RNA, 333 nt, Artificial Sequence
  derived and/or modified sequence opt2 from anti-HIV_048-043568_VR-Chain
caguccguccucacccagccccccuccgucuccgccgcccccggccagaaggucaccaucuccugcuccggcuccgacuccaacaucggcuccaacuacgucuccugguaccagcagcuccccggcgccgcccccaagcuccucaucuacaagaacaacaaccgccccuccggcauccccgaccgcuucuccggcuccaaguccggcaccuccgccacccucggcaucuccggccuccagaccggcgacgaggccgacuacuacugcggcaccugggacaccucccucuccggcggcggcgucuucggcaccggcaccaaggucaccguccuc

SEQ ID NO: 18030 - RNA, 333 nt, Artificial Sequence
  derived and/or modified sequence opt2 from anti-HIV_048-042713_VR-Chain
caguccguccucacccagccccccuccgucuccgccgcccccggccagaaggucaccaucuccugcuccggcuccuccuccaacaucggccgccacuacgucuccugguaccagcagcuccccggcaccgcccccaagcuccucaucuacgacaacaacucccgccccuccggcauccccgaccgcuucuccggcuccaaguccggcaccuccgccacccucggcaucaccggccuccagaccggcgacgaggccgacuacuacugcggcaccugggacaccucccucaaccgcggcggcgucuucggcaccggcaccaaggucaccguccuc

SEQ ID NO: 18031 - RNA, 333 nt, Artificial Sequence
  derived and/or modified sequence opt2 from anti-HIV_048-042440_VR-Chain
caguccguccucacccagccccccuccgccuccggcacccccggccagcgcgucaccaucuccugcuccggcuccuccuccaacaucggcaccaacaccgucaacugguaccagcagcuccccggcaccgcccccaagcuccucaucuacgagaacuccaagcgccccuccggcauccccgaccgcuucuccggcuccaaguccggcaccuccgccacccucggcaucaccggccuccagaccggcgacgaggccgacuacuacugcggcaccugggacaccucccucuccgccggcggcgucuucggcuccggcaccaaggucaccguccuc

SEQ ID NO: 18032 - RNA, 333 nt, Artificial Sequence
  derived and/or modified sequence opt2 from anti-HIV_048-040511_VR-Chain
caguccguccucacccagccccccuccgucuccgccgcccccggccagaaggucaccaucuccugcuccggcuccuccuccaacaucggcaacaacuacgucuccugguaccagcaccuccccggcaccgcccccaagcuccucaucuacgagaacaacaagcgcuccuccggcauccccgagcgcuucuccggcucccaguccggcaccuccgccacccucggcaucaccggccuccagaccggcgacgaggccgacuacuacugcggcaccugggacaccucccucuccaccggcggcgucuucggcaccggcaccaaggucaccguccuc

SEQ ID NO: 18033 - RNA, 333 nt, Artificial Sequence
  derived and/or modified sequence opt2 from anti-HIV_048-039195_VR-Chain
caguccguccucacccagccccccuccgucuccgccgcccccggccagcgcgucaccaucuccugcuccggcuccaccuccaacaucggcaaccacuacgucuccugguaccagcagcuccccggcaccgcccccaagcuccucaucuacgacaacggcaaccgccccuccggcauccccgaccgcuucuccggcuccaaguccggcaccuccgccacccucgacaucaccggccuccagaccggcgacgaggccgacuacuacugcggcaccugggacaccucccucaaccgcggcggcgucuucggcaccggcaccaaggucaccguccuc

SEQ ID NO: 18034 - RNA, 333 nt, Artificial Sequence
  derived and/or modified sequence opt2 from anti-HIV_048-036935_VR-Chain
caguccguccucacccagccccccuccauguccgccgcccccggcgagcgcgucaccaucuccugcaccggcuccuccuccaacaucggcggcuacgacguccacugguaccagcagcuccccggcaucgcccccaagauccucaucuaccgcaacuccauccgccccuccggcauccccgaccgcuucuccggcuccaaguccggcaccuccgccacccucggcaucaccggccuccagaccggcgacgaggccgacuacuacugcggcaccugggacaccucccucuccaccggcggcgucuucggcaccggcaccaaggucaccguccuc

SEQ ID NO: 18035 - RNA, 333 nt, Artificial Sequence
  derived and/or modified sequence opt2 from anti-HIV_048-034478_VR-Chain
caguccguccucacccagccccccuccgucuccgccgcccccggccagaaggucaccaucuccugcaccggcuccggcuccaacaucggcaacaacgacgucuccugguaccagcagcuccccggcaccgccccccgccuccucaucuacggcgacaacaagcgccccuccggcauccccgaccgcuucuccggcuccaaguccggcaccuccgccacccucggcaucaccggccuccagaccggcgacgaggccgacuacuacugcggcaccugggacaccucccucuccgccggcggcgucuucggcaccggcaccaaggucaccguccuc

SEQ ID NO: 18036 - RNA, 333 nt, Artificial Sequence
  derived and/or modified sequence opt2 from anti-HIV_048-031641_VR-Chain
caguccguccucacccagccccccuccgucuccgccgcccccggccagaaggucaccaucuccugcuccggcaacaacuccaacaucggcaacaacuacgucuccugguaccagcagcuccccggcaccgcccccaagcuccucaucuacgagaacuccaagcgccccuccggcauccccgaccgcuucuccggcuccaaguccggcaccuccgccacccucggcaucaccggccuccagaccggcgacgaggccgacuacuacugcggcaccugggacaccucccucuccgccggcggcgucuucggcuccggcaccaaggucaccguccuc

SEQ ID NO: 18037 - RNA, 333 nt, Artificial Sequence
  derived and/or modified sequence opt2 from anti-HIV_048-029760_VR-Chain
caguccgcccucacccagcccgccuccgucuccggcuccuccggccaguccaucaccaucuccugcaccggcaccaacuccgacgucggcuacgacuacgucugcugguaccagcagcuccccggcaccgcccccaagcuccucaucuacgagaacaacaagcgccccuccggcauccccgaccgcuucuccggcuccaaguccggcaccuccgccacccucggcaucaccggccuccagaccggcgacgaggccgacuacuacugcggcaccugggacaccucccucuccgccggcggcgucuucggcaccggcaccaaggucaccguccuc

SEQ ID NO: 18038 - RNA, 333 nt, Artificial Sequence
  derived and/or modified sequence opt2 from anti-HIV_048-027970_VR-Chain
caguccguccucacccagccccccuccgucuccgccccccccggccagaaggucaccaucuccugcuccggcaccaccuccaacaucggcuccaacuacgucgccugguaccagcaguuccccggcaccgcccccaagcuccucaucuacgagaacaacaagcgccccuccggcauccccgaccgcuucuccggcuccaaguccggcaccuccgccacccucggcaucaccggccuccagaccggcgacgaggccgacuacuacugcgccaccugggacaccucccucuccgccggcggcgucuucggcaccggcaccaaggucaccguccuc

SEQ ID NO: 18039 - RNA, 333 nt, Artificial Sequence
  derived and/or modified sequence opt2 from anti-HIV_048-027337_VR-Chain
caguccguccucacccagccccccuccgucuccgccgcccccggccagaaggucaccaucuccugcuccggcuccuacuccaacaucggcaacaacuaccucuccugguaccagcagcuccccggcaccgcccccaagcuccucaucuacaagaacaacaagcgccccuccggcguccccgaccgcuucuccggcuccaaguccggcgccuccgccacccucgacaucaccggccuccagaccggcgacgaggccgacuacuacugcggcaucugggacaccucccucuccgccggcggcgucuucggcaccggcaccaaggucaccguccuc

SEQ ID NO: 18040 - RNA, 333 nt, Artificial Sequence
  derived and/or modified sequence opt2 from anti-HIV_048-027217_VR-Chain
caguccguccucacccagccccccuccgucuccgccgcccccggccagaaggucaccaucuccugcuccggcuccuccuccaucaucggcaacaacuacgucuccugguaccagcagcuccccggcaccgcccccaagcuccucaucuacgagaacaacaagcgccccuccggcauccccgaccgcuucuccggcuccaaguccggcaccuccgccacccucgccaucgccggccuccagaccggcgacgaggccgacuacuacugcgccaccugggacaccucccucuccgccggcggcgucuucggcaccggcaccaaggucaccguccuc

SEQ ID NO: 18041 - RNA, 333 nt, Artificial Sequence
  derived and/or modified sequence opt2 from anti-HIV_048-026760_VR-Chain
caguccguccucacccagccccccuccgucuccgccgcccccggccagaaggucaccaucuccugcuccggcuccuccuccaacaucggcaacaacuacgucuccugguaccagcaccuccccggcaccgcccccaagcuccucaucuacgacaccgucaagcgccacuccggcguccccgaccgcuucuccggcuccaaguccggcaccuccgccacccucggcaucuccggccuccagaccggcgacgaggccgacuacuacugcggcaccugggacaccucccucuccgccggcggcgucuucggcuccggcaccaaggucaccguccuc

SEQ ID NO: 18042 - RNA, 333 nt, Artificial Sequence
  derived and/or modified sequence opt2 from anti-HIV_048-024800_VR-Chain
caguccguccucacccagccccccuccgucuccgccgcccccggccagaaggucaccaucuccugcuccggcuccuacuccaacaucggcaacaacuacgucuccugguaccagguccuccccggcaccgcccccaagcuccucaucuacaagaacaacgagcgccccuccggcauccccgaccgcuucuccggcuccaaguccggcaccuccgccacccucggcaucaccggccuccagaccggcgacgaggccgacuacuacugcggcaccugggacaccucccucuccgccggcggcgucuucggcaccggcaccaaggucaccguccuc

SEQ ID NO: 18043 - RNA, 333 nt, Artificial Sequence
  derived and/or modified sequence opt2 from anti-HIV_048-024313_VR-Chain
caguccguccucacccagccccccuccgucuccgccgcccccggccagaaggucaccaucuccugcuccggcuccuccuccaccaucggcaacucccacgucuccugguaccagauccuccccggcaccgcccccaagcuccucaucuacaaggacgacaagcgccccuccggcauccccgaccgcuucuccggcuccaaguccggcaccuccgccacccucggcaucaccggccuccagaccggcgacgaggccgacuacuacugcggcaccugggacaccucccucaaccgcggcggcgucuucggcaccggcaccaaggucaccguccuc

SEQ ID NO: 18044 - RNA, 333 nt, Artificial Sequence
  derived and/or modified sequence opt2 from anti-HIV_048-021748_VR-Chain
caguccguccucacccagccccccuccgucuccgccgcccccggccagcgcgucaccaucuccugcuccggcuccaccuccaacaucggcaacaacuacgucuccugguaccagcagcuccccggcaccgcccccaagcuccucaucuacgagaacaacaagcgccccuccggcauccccgaccgcuucuccggcuccaaguccggcaccuccgccacccucggcaucuccggccuccagaccggcgacgaggccgacuacuacugcggcaccugggacuccucccucuccggcggcggcgucuucggcaccggcaccaaggucaccguccuc

SEQ ID NO: 18045 - RNA, 333 nt, Artificial Sequence
  derived and/or modified sequence opt2 from anti-HIV_048-020991_VR-Chain
caguccguccucacccagccccccuccgccuccggcacccccggccagaaggucaccaucuccugcuccggcuccuccuccaccaucggcaacaacuacgucuccugguaccagguccuccccggcaccgcccccaagcuccucaucuacaagaacgacaagcgccccuccggcauccccgaccgcuucuccggcuccaaguccggcaccuccgccacccucggcaucaccggccuccagaccggcgacgaggccgacuacuacugcggcaccugggacaccucccucuccaccggcggcgucuucggcaccggcaccaaggucaccguccuc

SEQ ID NO: 18046 - RNA, 333 nt, Artificial Sequence
  derived and/or modified sequence opt2 from anti-HIV_048-020340_VR-Chain
caguccguccucacccagccccccuccgucuccgccgcccccggccagcgcgucaccaucuccugcuccggcuccuccuccaacgucggcaacaacuacgucuccugguaccagcagcuccccggcaccgcccccaagcuccucaucuacgagaacaacaagcgccccuccggcauccccgaccgcuucuccggcuccaaguccggcaccuccgccacccucggcaucaccggccuccagaccggcgacgaggccgacuacuacugcggcaccugggacgccucccucuccgccggcggcgucuucggcaccggcaccaaggucaccguccuc

SEQ ID NO: 18047 - RNA, 333 nt, Artificial Sequence
  derived and/or modified sequence opt2 from anti-HIV_048-019993_VR-Chain
caguccguccucacccagccccccuccgucuccggcgcccccggccagcgcgucaccaucuccugcaccggcuccuccuccuccaucggcggcuucgacguccacugguaccagcgccuccccggcaccgccccccgccuccucaucuacgagaacaacaagcgccccuccggcauccccgaccgcuucuccggcuccaaguccggcaccuccgccacccucggcaucaccggccuccagaccggcgacgaggccgacuacuacugcggcaccugggacuccucccucuccgccggcggcgucuucggcaccggcaccaaggucaccguccuc

SEQ ID NO: 18048 - RNA, 333 nt, Artificial Sequence
  derived and/or modified sequence opt2 from anti-HIV_048-019947_VR-Chain
caguccguccucacccagccccccuccgucuccgccgcccccggccagcgcgucaccaucuccugcuccggcuccuccuccaacaucggcuccaaguacgucuccugguaccagcagcuccccggcaccgcccccaagcuccucaucuacgagaacuccaagcgccccuccggcauccccgaccgcuucuccggcuccaaguccggcaccuccgccacccucggcaucaccggccuccagaccggcgacgaggccgacuacuacugcggcaccugggacaccucccucuccaccggcggcgucuucggcaccggcaccaaggucaccguccuc

SEQ ID NO: 18049 - RNA, 333 nt, Artificial Sequence
  derived and/or modified sequence opt2 from anti-HIV_048-017871_VR-Chain
caguccguccucacccagccccccuccgucuccgccgcccccggccagaaggucaccaucuccugcuccggcuccuccuccaacaucggcaaccgcuacgucuccugguaccagcagcuccccggcaccgcccccaagcuccucaucuacaagaacaacaagcgccccuccggcauccccgaccgcuucuccggcuccaaguccggcaccuccgccacccucggcaucaccggccuccagaccggcgacgaggccgacuacuacugcggcaccugggacggcucccucuccaccggcggcgucaucggcaccggcaccaaggucaccguccuc

SEQ ID NO: 18050 - RNA, 333 nt, Artificial Sequence
  derived and/or modified sequence opt2 from anti-HIV_048-015931_VR-Chain
caguccguccucacccagccccccuccgucuccgccgcccccggccagaaggucaccaucuccugcuccggcggcuccuccaacaucggcuccaccuacgucuccugguaccagcagguccccggcaccgcccccaagcuccucaucuacgagaacaacaagcgccccuccggcauccccgaccgcuucuccggcuccaaguccggcaccuccgccacccucgacaucaccggccuccagaccggcgacgaggccgacuacuacugcggcaccugggacaccucccucuccggcggcggcgucuucggcaccggcaccaaggucaccguccuc

SEQ ID NO: 18051 - RNA, 333 nt, Artificial Sequence
  derived and/or modified sequence opt2 from anti-HIV_048-015920_VR-Chain
cagucccuccucacccagccccccuccgucuccgccgcccccggccagaaggucaccaucuccugcuccggcuccuccuccaccaucggcaacaacuacgucuccugguaccagguccuccccggcaccgcccccaagcuccucaucuacaagaacaacgagcgccccuccggcauccccgaccgcuucuccggcuccaaguccggcaccuccgccacccucggcaucaccggccuccagaccggcgacgaggccgaguacuacugcgccaccugggacgccucccucuccggcggcggcgucuucggcaccggcaccaaggucaccguccuc

SEQ ID NO: 18052 - RNA, 333 nt, Artificial Sequence
  derived and/or modified sequence opt2 from anti-HIV_048-013898_VR-Chain
caguccguccucacccagccccccuccgucuccgccgcccccggccagaaggucaccaucuccugcuccggcuccuccuccaacaucggcaagcacuccgucuccugguaccagcagcuccccggcaccgcccccgagcuccucaucuacgacaacaacaaccgccccuccggcauccccgaccgcuucuccggcuccaaguccggcaccuccgccacccucggcaucaccggccuccagaccggcgacgaggccgacuacuacugcggcaccugggacaccucccucuccgccggcggcgucuucggcaccggcaccaaggucaccguccuc

SEQ ID NO: 18053 - RNA, 333 nt, Artificial Sequence
  derived and/or modified sequence opt2 from anti-HIV_048-013429_VR-Chain
caguccguccucacccagccccccuccgucuccgccgcccccggccagaaggucaccaucuccugcuccggcuccuccuccaacaucggcaacaacuacgucuccugguaccagcagcuccccggcaccgcccccacccuccucaucuacgagaacgacaagcgccccuccggcauccccgaccgcuucuccggcuccaaguccggcaccuccgccacccucggcaucaccggccuccagaccggcgacgaggccgacuacuacugcggcaccugggacuccucccucuccgccggcggcgucuucggcaccggcaccaaggucaccguccuc

SEQ ID NO: 18054 - RNA, 333 nt, Artificial Sequence
  derived and/or modified sequence opt2 from anti-HIV_048-012358_VR-Chain
caguccguccucacccagccccccuccgucuccgccgcccccggccagaaggucaccaucuccugcuccggcuccaacuccgccaucggcaacaacuacgucuccugguaccagguccuccccggcaccgcccccaagcuccucaucuacaagaacaacgagcgccccuccggcauccccgaccgcuucuccggcuccaaguccggcaccuccgccacccucgacaucaccggccuccagaccggcgacgaggccgacuacuacugcggcaccugggacaccucccucuccgccggcggcgucuucggcaccggcaccaaggucaccguccuc

SEQ ID NO: 18055 - RNA, 333 nt, Artificial Sequence
  derived and/or modified sequence opt2 from anti-HIV_048-011158_VR-Chain
caguccguccucacccagccccccuccgucuccgccgcccccggccagaaggucaccaucuccugcuccggcaucuccuccaacaucggcaacaacgacgucuccugguaccagcagcuccccggcaccgcccccaagcuccucaucuacgacaacgacaagcgccccuccggcauccccgaccgcuucuccggcuccaaguccggcaccuccgccacccucggcaucaccggccuccagaccggcgacgaggccgacuacuacugcggcaccugggacuccucccucuccgccggcggcgucuucggcaccggcaccaaggucaccguccuc

SEQ ID NO: 18056 - RNA, 333 nt, Artificial Sequence
  derived and/or modified sequence opt2 from anti-HIV_048-010720_VR-Chain
caguccguccucacccagccccccuccgucuccgccgcccccggccagaaggucaccaucuccugcuccggcuccuccuccaacaucggcucccacuacgucuccugguaccagcagguccccggcaccgccccccgccucgucaucuacgagaacuccaagcgccccuccggcauccccgaccgcuucuccggcuccaaguccggcaccuccgccacccucggcaucaccggccuccagaccggcgacgaggccgacuacuacugcggcaccugggacaccucccucuccgccggcggcgucuucggcuccggcaccaaggucaccguccuc

SEQ ID NO: 18057 - RNA, 333 nt, Artificial Sequence
  derived and/or modified sequence opt2 from anti-HIV_048-009445_VR-Chain
caguccguccucacccagccccccuccgucuccgccgcccccggccagaaggucaccaucuccugcuccggcuccuccuccaacaucggcaacaacuacgucuccugguaccagcagcuccccggcaccguccccaagcuccucaucuacgacaccuacacccgccccuccggcacccccgaccgcuucuccggcuccaaguccggcaccuccgccacccucgccaucaccggccuccagaccggcgacgaggccgacuacuacugcggcaccugggacggcucccucuccaccggcggcgucaucggcaccggcaccaaggucaccguccuc

SEQ ID NO: 18058 - RNA, 324 nt, Artificial Sequence
  derived and/or modified sequence opt2 from anti-HIV_048-006126_VR-Chain
caguccguccucacccagccccccuccgucuccggcgcccccggccagaaggucaccaucuccugcuccggcaucuccuccaacuucggcaucuccugguaccagcagguccccggcaccgcccccaagcuccucaucuacgagaacgacaagcgccccuccggcauccccgaccgcuucuccggcuccaaguccggcaccuccgccacccucggcaucaccggccuccagaccggcgacgaggccgacuacuacugcggcaccugggacaccucccucuccgccggcggcgucuucggcaccggcaccaaggucaccguccuc

SEQ ID NO: 18059 - RNA, 333 nt, Artificial Sequence
  derived and/or modified sequence opt2 from anti-HIV_048-005652_VR-Chain
caguccguccucacccagccccccuccgucuccgccgcccccggccagaaggucaccaucuccugcuccggcuccaacuccgccaucggcaacaacuacgucuccugguaccagguccuccccggcaccgcccccaagcuccucaucuacgacaccuacaagcgcgccuccggcauccccgaccgcuucuccggcuccaaguccggcaccuccgccacccucggcaucaccggccuccagaccggcgacgaggccgacuacuacugcggcaccugggacaccucccucuccggcggcggcgucuucggcaccggcaccaaggucaccguccuc

SEQ ID NO: 18060 - RNA, 333 nt, Artificial Sequence
  derived and/or modified sequence opt2 from anti-HIV_048-005532_VR-Chain
caguccguccucacccagccccccuccgucuccgccgcccccggccagaaggucaccaucuccugcuccggcaccuccuccaacaucggcaacaccuacgucuccugguaccagcagcuccccggcaccgcccccaacuaccucaucuacaagaucgacaagcgccccuccggcauccccgaccgcuucuccggcuccaaguccggcaccuccgccacccucggcaucaccggccuccagaccggcgacgaggccgacuacuacugcggcaccugggacaccucccucuccgccggcggcgucuucggcaccggcaccaaggucaccguccuc

SEQ ID NO: 18061 - RNA, 333 nt, Artificial Sequence
  derived and/or modified sequence opt2 from anti-HIV_048-005189_VR-Chain
caguccguccucacccagccccccuccgucuccgccgcccccggccagaaggucaccaucuccugcuccggcuccggcuccaccaucggcaacaacgacgucuccugguaccagcagcuccccggcgccgcccccaagcuccucaucuacgaggacaacaagcgccccuccggcauccccgcccgcuucuccggcuccaaguccggcaccuccgccacccuccgcaucaccggccuccagaccggcgacgaggccgacuacuacugcggcaccugggacuccucccucuccgccggcggcgucuucggcaccggcacccgcgucuccguccuc

SEQ ID NO: 18062 - RNA, 333 nt, Artificial Sequence
  derived and/or modified sequence opt2 from anti-HIV_048-005088_VR-Chain
caguccguccucacccagccccccuccgucuccgccgcccccggccagaaggucaccaucuccugcuccggcuccuccuccaacaucggcaagaacuacgucuccugguaccagcagcuccccggcaccgcccccaagcuccucaucuacgacaacaacaaccgccccuccggcauccccgaccgcuucuccggcuccaaguccggcaccuccgccacccucggcaucaccggccuccagaccggcgacgaggccgacuacuacugcggcgccugggacaccucccucuccgccggcggcgucuucggcaccggcaccaaggucaccguccuc

SEQ ID NO: 18063 - RNA, 333 nt, Artificial Sequence
  derived and/or modified sequence opt2 from anti-HIV_048-004023_VR-Chain
caguccguccucacccagccccccuccgucuccgccacccccggccagaaggucaccaucuccugcuccggcggcuccuccaacaucggcaagaacgacgucuccugguaccagcagcuccccggcaccgcccccaagcuccucaucuacgacaccaacaagcgccccuccggcauccccgaccgcuucuccgccgcccgcuccggcaccuccgccacccucgacaucaccggccuccagaccggcgacgaggccgacuacuacugcggcaccugggacaccucccucuccgccggcggcgucuucggcaccggcaccaaggucaccguccuc

SEQ ID NO: 18064 - RNA, 333 nt, Artificial Sequence
  derived and/or modified sequence opt2 from anti-HIV_048-001580_VR-Chain
caguccguccucacccagccccccuccgucuccgccgcccccggccagaaggucaccaucuccugcuccggcuccuccuccaacaucggcaacaacuacgucuccugguaccagcagcuccccggcaccgcccccaagcuccuccucuacgagaacaacaagcgccccuccggcauccccgaccgcuucuccggcuccaaguccggcaccuccgccacccucgccaucaccggccuccagaccggcgacgaggccgccuacuacugcggcaccugggacggcucccucuccaccggcggcgucaucggcaccggcaccaaggucaccguccuc

SEQ ID NO: 18065 - RNA, 333 nt, Artificial Sequence
  derived and/or modified sequence opt2 from anti-HIV_038-221120_VR-Chain
caguccguccucacccagccccccuccgucuccgccgcccccggccagaaggucaccaucuccugcuccggcuccaccuccaacaucggcaagaacuacgucuccugguaccagcagcuccccggcaccgcccccaagcuccucaucuacgacaacaacgagcgccccuccggcauccccgaccgcuucuccggcuccaaguccggcaccuccgccacccucggcaucaccggccuccagaccggcgacgaggccgacuacuacugcgccaccugggacuccucccucuccggcggcggcgucuucggcaccggcacccgcgucaccguccuc

SEQ ID NO: 18066 - RNA, 333 nt, Artificial Sequence
  derived and/or modified sequence opt2 from anti-HIV_038-197677_VR-Chain
caguccguccucacccagccccccuccgucuccgccgcccccggccagaaggucaccgucuccugcuccggcuccaacuccaacaucggcaaccacuacgucuccugguaccagcagcuccccggcaccgcccccaagcuccucaucuacgacaacaacaagcgccccuccggcauccccgaccgcuucuccggcuccaaguccggcaccuccgccacccucggcaucaccggccuccagaccggcgacgaggccgacuacuacugcggcaccugggacuccucccucuccgccggcggcgucuucggcaccggcaccaaggucaccguccuc

SEQ ID NO: 18067 - RNA, 333 nt, Artificial Sequence
  derived and/or modified sequence opt2 from anti-HIV_038-196765_VR-Chain
caguccgcccucacccagcccgccuccgucuccggcucccccggccaguccaucaccaucuccugcaccggcaccuccggcgacgucggcuacaaccucgucuccugguaccagcagcuccccggcaccgcccccaagguccucaucuacgagaacaacaagcgccccuccggcauccccgaccgcuucuccggcuccaaguccggcaccuccgccacccucggcaucaccggccuccagaccggcgacgaggccgacuacuacugcggcaccugggacuccucccucuccgccggcggcgucuucggcaccggcaccaaggucaccguccuc

SEQ ID NO: 18068 - RNA, 333 nt, Artificial Sequence
  derived and/or modified sequence opt2 from anti-HIV_038-186200_VR-Chain
caguccguccucacccagccccccuccgccuccggcacccccggccagcgcaucaccaucuccugcuccggcaccuccuccaacaucggcuccaacaucgucuccugguaccagcaccuccccggcaccacccccaagcucgucaucuuccgcaacaaccagcgccccuccggcauccccgaccgcuucuccggcuccaaguccggcaccuccgccacccucggcaucaccggccuccagaccggcgacgaggccgacuacuacugcggcaccugggacuccucccucuccgccggcggcgucuucggcaccggcaccaaggucaccguccuc

SEQ ID NO: 18069 - RNA, 333 nt, Artificial Sequence
  derived and/or modified sequence opt2 from anti-HIV_038-126170_VR-Chain
caguccguccucacccagccccccuccgucuccgccccccccggccagaaggucaccaucuccugcuccggcaccaccuccaacaucggcuccaacuacgucgccugguaccagcagcuccccggcaccgcccccaagcuccucaucuacgacaacgucaagcgccccaccaacauccccgaccgcuucuccggcuccaaguccggcaccuccgccacccucggcaucaccggccuccagaccggcgacgaggccgacuacuacugcggcaccugggacuccucccucuccgccggcggcgucuucggcaccggcaccaaggucaccguccuc

SEQ ID NO: 18070 - RNA, 333 nt, Artificial Sequence
  derived and/or modified sequence opt2 from anti-HIV_038-108545_VR-Chain
caguccguccucacccagccccccuccgccuccggcacccccggccagcgcgucaccaucuccugcuccggcuccuccuccaacaucggcuacaacaccgucuccugguaccagcagcuccccggcaccgcccccaagcuccucaucuacgagaacaacaagcgccccuccggcauccccgaccgcuucuccggcuccaaguccggcaccuccgccacccucggcaucaccggccuccagaccggcgacgaggccgacuacuacugcggcaccugggacuccucccucuccgccggcggcgucuucggcaccggcaccaaggucaccguccuc

SEQ ID NO: 18071 - RNA, 333 nt, Artificial Sequence
  derived and/or modified sequence opt2 from anti-HIV_038-107263_VR-Chain
caguccguccucacccagccccccuccgccuccggcacccccggccagcgcgucaccaucuccugcuccggcuccuccuccaacaucggcuccaacaccgucaacugguaccagcagguccccggcaccgcccccaaccuccucaucuacuccaacgaccagcgccccuccggcauccccgaccgcuucuccggcuccaaguccggcaccuccgccacccucggcaucaccggccuccagaccggcgacgaggccgacuacuacugcggcaccugggacuccucccucuccgccggcggcgucuucggcaccggcaccaaggucaccguccuc

SEQ ID NO: 18072 - RNA, 333 nt, Artificial Sequence
  derived and/or modified sequence opt2 from anti-HIV_038-104530_VR-Chain
caguccguccucacccagccccccuccgucuccgccgcccccggccagaaggucaccaucuccugcuccggcuccuccuccaacaucggcuccaacuacgucuccugguaccagcaccuccccggcaaggcccccaagcuccucaucuacgacaacaacaagcgccccuccggcauccccgaccgcuucuccggcuccaaguccggcaccuccgccacccucggcaucaccggccuccagaccggcgacgaggccgacuacuacugcggcaccugggacuccucccucuccgccggcggcgucuucggcaccggcaccaaggucaccguccuc

SEQ ID NO: 18073 - RNA, 333 nt, Artificial Sequence
  derived and/or modified sequence opt2 from anti-HIV_038-099169_VR-Chain
caguccguccucacccagccccccuccgccuccggcacccccggccagcgcgucuccaucuccugcuccggcaucaccuccucccucggcuccaaccacauguccugguaccagcagcuccccggcaccgcccccaagcuccucaucuacgagaacaacaagcgccccuccggcauccccgaccgcuucuccggcuccaaguccggcaccuccgccacccucggcaucaccggccuccagaccggcgacgaggccgacuacuacugcggcaccugggacuccucccucuccgccggcggcgucuucggcaccggcaccaaggucaccguccuc

SEQ ID NO: 18074 - RNA, 333 nt, Artificial Sequence
  derived and/or modified sequence opt2 from anti-HIV_038-075067_VR-Chain
caguccguccucacccagccccccuccgucuccggcgcccccggccagcgcgucaccaucuccugcuccggcuccuccuccaccaucggcaacaacuacgucuccugguaccagcuccuccccggcaccgcccccaagcuccucaucuacaagaacaacaagcgccccuccggcauccccgaccgcuucuccggcuccaaguccggcaccuccgccacccucggcaucaccggccuccagaccggcgacgaggccgacuacuacugcggcaccugggacaccucccucuccgccggcggcgucuucggcaccggcaccaaggucaccguccuc

SEQ ID NO: 18075 - RNA, 333 nt, Artificial Sequence
  derived and/or modified sequence opt2 from anti-HIV_038-072368_VR-Chain
caguccguccucacccagucccccuccgccuccggcacccccggccagcgcgucaccaucuccugcuccggcuccuccuccaacaucggcaacaacuacgucuccugguaccagcagcuccccggcaccgcccccaagcuccucaucuacgagaacaacaagcgccccuccggcauccccgaccgcuucuccggcuccaaguccggcaccuccgccacccucggcaucaccggccuccagaccggcgacgaggccgacuacuacugcggcaccugggacuccucccucuccgccggcggcgucuucggcaccggcaccaaggucaccguccuc

SEQ ID NO: 18076 - RNA, 333 nt, Artificial Sequence
  derived and/or modified sequence opt2 from anti-HIV_038-068503_VR-Chain
caguccguccucacccagccccccuccgucuccgccgcccccggccagauggucaccaucuccugcuccggcucccgcuccaacaucgagaaccacuacgucuccugguaccagcaccuccccggcgccgcccccaagcuccucaucuacgacaacggcaagcgccccuccggcauccccgaccgcuucuccggcuccaaguccggcaccuccgccacccucggcaucaccggccuccagaccggcgacgaggccgacuacuacugcggcaccugggacuccucccucuccgccggcggcgucuucggcaccggcaccaaggucaccguccuc

SEQ ID NO: 18077 - RNA, 333 nt, Artificial Sequence
  derived and/or modified sequence opt2 from anti-HIV_038-068016_VR-Chain
caguccguccucacccagccccccuccgccuccggcacccccggccagcgcgucaccaucuccugcuccggcuccuccuccaacaucgaguccaacuucgucuacugguaccagcaguuccccggcaccacccccaagcuccucaucuaccgcgacggccagcgccccuccggcauccccgaccgcuucuccggcuccaaguccggcaccuccgccacccucggcaucaccggccuccagaccggcgacgaggccgacuacuacugcggcaccugggacuccucccucuccgccggcggcgucuucggcaccggcaccaaggucaccguccuc

SEQ ID NO: 18078 - RNA, 333 nt, Artificial Sequence
  derived and/or modified sequence opt2 from anti-HIV_038-063958_VR-Chain
caguccguccucacccagccccccuccgucuccggcgcccccggccagcgcgucaccaucuccugcaccggcuccuccuccaacaucggcaacuccggcguccacugguaccagcagcuccccggcaccgcccccaagcuccucaucuacgagaacaacaagcgccccuccggcauccccgaccgcuucuccggcuccaaguccggcaccuccgccacccucggcaucaccggccuccagaccggcgacgaggccgacuacuacugcggcaccugggacuccucccucuccgccggcggcgucuucggcaccggcaccaaggucaccguccuc

SEQ ID NO: 18079 - RNA, 333 nt, Artificial Sequence
  derived and/or modified sequence opt2 from anti-HIV_038-033733_VR-Chain
caguccguccucacccagccccccuccgccuccggcacccccggccagcgcgucaccaucuccugcuccggcuccuccuccaacaucggcuccaaguacgucuacugguaccagcagcuccccggcaccgcccccaagcuccucaucuacgacaacgacaagcgccccuccggcauccccgaccgcaucuccgccuccaaguccggcaccuccgccacccucgacaucacccgccuccagaccggcgacgaggccgacuacuacugcggcaccugggacuccucccucuccgccggcggcgucuucggcaccggcaccaaggucaccguccuc

SEQ ID NO: 18080 - RNA, 333 nt, Artificial Sequence
  derived and/or modified sequence opt2 from anti-HIV_038-030557_VR-Chain
caguccguccucacccagccccccuccgucuccgccgcccccggccagaaggucaccaucuccugcuccggcuccuccuccaccaucggcaacaacuacgucuccugguaccagcuccuccccggcaccgcccccaagcuccucaucuacaagaacaacaagcgccccuccggcauccccgaccgcuucuccggcuccaaguccggcaccuccgccacccucggcaucaccggccuccagaccggcgacggcgccgacuacuacugcggcaccugggacaccucccucuccgccggcggcgucuucggcaccggcaccaucgucaccguccuc

SEQ ID NO: 18081 - RNA, 333 nt, Artificial Sequence
  derived and/or modified sequence opt2 from anti-HIV_038-024298_VR-Chain
caguccguccucacccagccccccuccgucuccgccgcccccggccagaaggucaccaucuccugcuccggcuccuccuccaacaucggcaacucccacgucuccugguaccagcaguuccccggcaccggccccaagcuccucaucuacgagaacgccaagcgccccuccggcauccccgaccgcaucuccggcuccaaguccgacaccuccgccacccucggcaucaccggccuccagaccggcgacgaggccgacuacuacugcggcaccugggacuccucccucuccgccggcggcgucuucggcaccggcaccaaggucaccguccuc

SEQ ID NO: 18082 - RNA, 333 nt, Artificial Sequence
  derived and/or modified sequence opt2 from anti-HIV_038-011154_VR-Chain
caguccguccucacccagccccccuccgucuccgccgcccccggccagcgcaucaccaucuccugcuccggcuccuccuccaacaucggcaacaacuacgucuccugguaccagcagcuccccggcaccgcccccaagcuccucaucuacaagaacaacaagcgccccuccggcauccccgaccgcuucuccggcuccaaguccggcaccuccgccacccucggcaucaccggccuccagaccggcgacgaggccgacuacuacugcggcaccugggacaccucccucuccgccggcggcgucuucggcaccggcaccaaggucaccguccuc

SEQ ID NO: 18083 - RNA, 318 nt, Artificial Sequence
  derived and/or modified sequence opt2 from anti-HIV-1_LightChain
gagaucguccucacccagucccccggcacccucucccucucccccggcgagcgcgccacccucuccugccgcgccucccaguccgucuccaacaacuuccucgccugguaccaguacaagcccggccagcccccccgcguccucaucuacggcaccucccgccgcgccuccggcauccccgaccgcuucuccggcuccggcuccggcaccgacggcucccucaccaucucccgccucgaggccgaggacuucgccgucuacuacugccagcaguacgaguucuucggccagggcacccgccucgagaugaagcgcacc

SEQ ID NO: 18084 - RNA, 318 nt, Artificial Sequence
  derived and/or modified sequence opt2 from anti-HIV-1_LightChain
gaggucguccucacccagucccccggcacccucucccucucccccggcgagcgcgccacccucuccugccgcgccucccaguccgucucccgcaacuaccucgccugguaccagcagaagcucggccacggcccccgccuccucgucuacgccaccucccgccgcgccaccggcauccccgaccgcuucaucggcucccaguccggcaccgaguacaaccucaccaucacccgccucgaccccggcgacuucgcccaguacuucugccagcaguacgaguucuucggccccggcacccgccucgacaucaagcgcacc

SEQ ID NO: 18085 - RNA, 309 nt, Artificial Sequence
  derived and/or modified sequence opt2 from anti-HIV-1_LightChain
gaggucguccucacccagucccccggcacccucucccucucccccggcgagcgcgccuccuucuccugcaaguccucccaguacggccacaccgccugguaccagcagaagcucggccacggcccccgccuccucaucuacgccaccucccgccgcgccaccggcauccccgaccgcuucaucggcucccaguccggcaccgaguacaaccucaccaucacccgccucgaccccggcgacuucgcccacuacuucugccagcagaacgaguucuucggccccggcacccgccucgacaugaagcgcacc

SEQ ID NO: 18086 - RNA, 306 nt, Artificial Sequence
  derived and/or modified sequence opt2 from anti-HIV-1_LightChain
gagaucguccucacccagucccccuccucccucucccucucccccggcgagcgcgccucccucuccugccgcggcucccacggccacgucgccugguaccagcacaagcccggccagaucccccgccuccucaucuacgccaccuccaagcgcgccuccggcaucuccgaccgcuucuccggcuccggcuccggcaccgacgccacccucuccaucucccgccucgagcccgaggacuucgccgucuacuucugccagcaguacgaguucuucggccagggcacccgccucgagaucaagcgcacc

SEQ ID NO: 18087 - RNA, 306 nt, Artificial Sequence
  derived and/or modified sequence opt2 from anti-HIV-1_LightChain
gagaucaugcucacccagucccccggcacccucucccucucccccggcgagcgcgccacccucuccugccgcggcucccacggccacgucgccugguaccagcagaagcccggccgcaucccccgccuccucaucuacggcaccuccaagcgcgccuccggcauccccgaccgcuucuccggcuccggcuccggcaccgacgccacccucaccaucucccgccucgaguccgaggacuucgccgucuacuucugccagcaguacgaguucuucggccagggcacccgccucgacaucaaccgcacc

SEQ ID NO: 18088 - RNA, 309 nt, Artificial Sequence
  derived and/or modified sequence opt2 from anti-HIV-1_LightChain
gaguccguccucacccagucccccggcacccucucccucucccccggcgagaccgccucccucuccugcaccgccgcccucuacggccacaugaccugguaccagaagaagcccggccagccccccaagcuccuccucuacgccuccuccaagcgcgccuccggcauccccgaccgcuucuccggcucccaguucggcaagcaguacacccucaucaucaccaagauggagcccgaggacuucgccgaguacuacugccagcaguucgaggucuucggccagggcacccgccucgacaugcgccgcacc

SEQ ID NO: 18089 - RNA, 306 nt, Artificial Sequence
  derived and/or modified sequence opt2 from anti-HIV-1_LightChain
gaggucguccucacccagucccccggcacccucucccucucccccggcgagcgcgccacccucuccugccgcggcucccacggccaccucuccugguaccaguacaagcccggccagcccccccgcguccucaucuacggcaccucccgccgcgccuccggcauccccgaccgcuucuccggcuccggcuccggcaccgacggcucccucaccaucucccgccucgaggccgaggacuucgccgucuacuacugccagcaguacgaguucuucggccagggcacccgccucgagaugaagcgcacc

SEQ ID NO: 18090 - RNA, 309 nt, Artificial Sequence
  derived and/or modified sequence opt2 from anti-HIV-1_LightChain
gaggucguccucacccagucccccggcacccucucccucucccccggcgagcgcgccucccucuccugcaaguccucccaguacggccacaccgccugguaccagcagaagcucggccagggcccccgccuccucaucuacgccaccucccgccgcgccaccggcauccccgaccgcuucuccggcucccaguccggcaccgaguacaaccucaccaucacccgccucgaccccggcgacuucgcccaguacuucugccagcaguacgaguucuucggccccggcacccgccucgacaucaagcgcacc

SEQ ID NO: 18091 - RNA, 306 nt, Artificial Sequence
  derived and/or modified sequence opt2 from anti-HIV-1_LightChain
gagaucaugcucacccagucccccggcacccucucccucucccccggcgagcgcgccacccucuccugccgcggcucccacggccacgucgccugguaccagcagaagcccggccgcaucccccgccuccucaucuacggcaccuccaagcgcgccuccggcauccccgaccgcuucuccggcuccggcuccggcaccgacgccacccucaccaucucccgccucgaguccgaggacuucgccgucuacuacugccagcaguacgaguucuucggccagggcacccgccucgacaucaagcgcacc

SEQ ID NO: 18092 - RNA, 309 nt, Artificial Sequence
  derived and/or modified sequence opt2 from anti-HIV-1_LightChain
gaguccguccucacccagucccccggcacccucucccucucccccggcgagaccgccucccucuccugcaccgccgccuccuacggccacaugaccugguaccagaagaagcccggccagccccccaagcuccucaucuucgccaccuccaagcgcgccuccggcauccccgaccgcuucuccggcucccaguucggcaagcaguacacccucaccaucacccgcauggagcccgaggacuucgccggcuacuacugccagcaggucgaguucuucggccagggcacccgccucgagauccgccgcacc

SEQ ID NO: 18093 - RNA, 309 nt, Artificial Sequence
  derived and/or modified sequence opt2 from anti-HIV-1_LightChain
gacauccagaugacccagucccccuccucccucuccgccuccgucggcgaccgcgucaccaucaccugccaggccucccaggacaucuccaacuaccucaacugguaccagcagaagcccggcaaggcccccaagcuccucaucuacgacgccuccaaccucgagaccggcguccccucccgcuucuccggcuccggcuuccacaccaccuucucccucaccaucuccggccuccagcgcgacgacuucgccaccuacuucugcgccguccucgaguucuucggccccggcaccaaggucgacuucaac

SEQ ID NO: 18094 - RNA, 309 nt, Artificial Sequence
  derived and/or modified sequence opt2 from anti-HIV-1_LightChain
gacauccagaugacccagucccccuccucccucuccgccuccgucggcgaccgcgucaccaucaccugccaggccucccaggacaucaccaacuaccucaacugguaccagcagaagcccggccgcgcccccaagcuccucguccacggcgccuccaaccuccagcgcggcguccccucccgcuucuccggcuccggcuuccacaccaccuucacccucaccaucuccucccuccagcccgacgacgucgccaccuacuucugcgaggucuuccagugguucggccccggcacccgcgucgacuucaac

SEQ ID NO: 18095 - RNA, 309 nt, Artificial Sequence
  derived and/or modified sequence opt2 from anti-HIV-1_LightChain
ggcuuccagcucacccagucccccuccucccucuccgccuccgucggcgaccgcgucuccaucaacugccaggccggcgagggcaucggcuccucccucaacugguaccagcagaagcccggccgcgcccccaagcuccucguccacggcgccuccaaccuccagcgcggcguccccucccgcuucuccggcuccggcuuccacaccaccuucacccucaccaucuccucccuccagcccgacgacgucgccaccuacuucugcgaggucuuccagugguucggccccggcacccgcgucgacuucaac

SEQ ID NO: 18096 - RNA, 309 nt, Artificial Sequence
  derived and/or modified sequence opt2 from anti-HIV-1_LightChain
ggcauccagcucacccagucccccuccucccucuccgucuccgucggcgaccgcgucaccaucaccugccgcgccucccagggcaucggcaacucccucaacugguaccagcagaagcccggcaaggcccccaaccucauggucuucggcaccaccaagcucaaccgcggcguccccucccgcuucuccggcuccggcuccggcaccaccgccacccucaccaucaacucccuccagcccgaggacaucgccaccuacuucugccaggucuucgaguuccucggccccggcaccaagcucgacaugaag

SEQ ID NO: 18097 - RNA, 309 nt, Artificial Sequence
  derived and/or modified sequence opt2 from anti-HIV-1_LightChain
gacauccagaugacccagucccccuccucccucuccgccuccgucggcgaccgcgucaccaucaccugccaggccggccagggcaucggcuccucccucaagugguaccagcagaagcccggccgcgccccccgccuccucguccacggcgccuccaaccuccaccgcggcguccccucccgcuucuccggcuccggcuuccacaccaccuucucccucaccaucuccggccuccagcgcgacgacuucgccaccuacuucugcgccguccucgaguucuucggccccggcaccaaggucgacuucaac

SEQ ID NO: 18098 - RNA, 309 nt, Artificial Sequence
  derived and/or modified sequence opt2 from anti-HIV-1_LightChain
ggcauccagcucacccagucccccuccucccucuccgccuccgucggcgaccgcgucaccaucaccugccaggccucccagggcaucggcuccucccuccagugguaccagcagaagcccggccgcgcccccaaccuccucguccacggcgccuccaaccuccaccgcggcguccccucccgcuucuccggcuccggcuuccacaccaccuucucccucaccaucuccggccuccagcgcgacgacuucgccaccuacuucugcgccguccucgaguucuucggccccggcaccaaggucgagaucaag

SEQ ID NO: 18099 - RNA, 309 nt, Artificial Sequence
  derived and/or modified sequence opt2 from anti-HIV-1_LightChain
ggcguccagcucacccagucccccuccucccucuccgccuccgucggcgaccgcgucuccaucaacugccaggccggccagggcaucggcuccucccucaacugguaccagcagaagcgcggcaaggcccccaagcuccucguccacggcgccuccacccuccagcgcggcguccccucccgcuucuccggcuccggcuuccacaccaccuucacccucaccaucuccucccuccagcccgacgacgucgccaccuacuucugcgaggucuuccagugguucggccccggcacccgcgucgacuucaac

SEQ ID NO: 18100 - RNA, 306 nt, Artificial Sequence
  derived and/or modified sequence opt2 from anti-HIV-1_LightChain
uacauccagcucacccagucccccuccucccucuccgccuccaucggcgaccgcgucaccaucgccugccgcgccucccagggcaucggcuacguccacugguaccagcagaagcgcggcaagccccccaagcuccucauccacggcgccuccauccucgagcgcggcguccccucccgcuucuccggcuccggcuccggcacccucuucaaccucaccgucuccggccuccagcccgaggacuucgccaccuacaugugccaggucuucgaguccuucggccccggcaccaagguccagaugaag

SEQ ID NO: 18101 - RNA, 309 nt, Artificial Sequence
  derived and/or modified sequence opt2 from anti-HIV-1_LightChain
ggcauccagcucacccagucccccuccucccucuccgccucccucggcgaccgcgucaccaucaccugccaggccucccagggcaucggcuccucccuccagugguaccagcagaagcccggcaaggcccccaagcuccucguccacggcgccuccaagcuccaccgcggcguccccucccgcuucuccggcuccggcuuccacaccaccuucucccucaccaucuccucccuccagcccgaggacuucgccaccuaccucugccagguccucgaguucuucggccccggcaccaaggucgacuucaac

SEQ ID NO: 18102 - RNA, 309 nt, Artificial Sequence
  derived and/or modified sequence opt2 from anti-HIV-1_LightChain
ggcauccagcucacccagucccccuccucccucuccgccuccgucggcgacaccgucaccaucaccugccaggccucccagggcaucggcuccucccuccagugguaccagcagaagcgcggccgcgcccccaagcuccucguccacggcgccuccaaccuccagggcggcguccccucccgcuucuccggcuccggcuuccacaccaccuucacccucgccauccgcggccuccagcccgacgacuucgccaccuacuucugccagucccucgaguucuucggccccggcaccaaggucgacaugaag

SEQ ID NO: 18103 - RNA, 306 nt, Artificial Sequence
  derived and/or modified sequence opt2 from anti-HIV-1_LightChain
uacauccagcucacccagucccccuccucccucuccgccuccgucggcgaccgcgucaccaucaccugccgcgccucccaggacaucggcuacgucuccugguacgcccagaagcgcggccgcgcccccaagcuccucauccacggcgccuccggccucgagcgcggcguccccucccgcuucuccggcuccggcuccggcacccucuucacccucaccaucgagucccuccagcccgaggacuucgccaccuacaugugccaggucuucgaguccuucggccccggcaccaaggucgagaugaag

SEQ ID NO: 18104 - RNA, 309 nt, Artificial Sequence
  derived and/or modified sequence opt2 from anti-HIV-1_LightChain
ggcauccagcucacccagucccccuccucccucuccgccuccgucggcgaccgcgucuccaucaacugccaggccggccagggcaucggcuccucccucaacugguaccagcagaagcccggccgcgcccccaagcuccucguccacggcgccuccaaccuccagcgcggcguccccucccgcuucuccggcuccggcuuccacaccaccuucacccucaccaucuccucccuccagcccgacgacgucgccaccuacuucugcgccgucuuccagugguucggccccggcacccgcgucgacuucaac

SEQ ID NO: 18105 - RNA, 366 nt, Artificial Sequence
  derived and/or modified sequence opt2 from anti-HIV-1_HeavyChain
ucccagcagcucguccaguccggcacccaggucaagaagcccggcgccuccguccgcaucuccugccaggccuccggcuacaccuucaccgacuacguccuccacugguggcgccaggcccccggccagggccucgaguggaugggcuggaucaagcccgucuacggcgcccgcaacuacgcccgccgcuuccagggccgcaucgacuucucccgcgacaucuaccgcgagaucgccuacauggaccucuccggccuccgcuccgacgacaccgcccucuacuucugcgcccgcgacggcuccggcgacgacaccuccuggcaccucgaccccuggggccagggcacccucgucaucgucuccgcc

SEQ ID NO: 18106 - RNA, 366 nt, Artificial Sequence
  derived and/or modified sequence opt2 from anti-HIV-1_HeavyChain
ucccagcagcucguccaguccggcacccaggucaagaagcccggcgccuccguccgcaucuccugccaggccuccggcuacaccuucaccgacuaccuccuccacugguggcgccaggcccccggccagcgccucgaguggaugggcuggaucaagcccgucuacggcgcccgcaacuacgcccaccgcuuccagggccgcaucaacuucgaccgcgacaucuaccgcgagaucgccuucauggaccucuccggccuccgcuccgacgacaccgccgucuacuucugcgcccgcgacggcggcggcgacgaccgcaccuggcuccucgacaccuggggccagggcacccucgucgucgucuccucc

SEQ ID NO: 18107 - RNA, 366 nt, Artificial Sequence
  derived and/or modified sequence opt2 from anti-HIV-1_HeavyChain
cagguccaccucgagcagcccggcuccgucguccgcuggcccggcgccucccucacccucuccugcaccgccuccggcuacaucuucgucaacuaccacauccacuggcuccgccaggcccccggccagcgccucgagcuccucggcaccaucaaccccgucggcggcgccaccuccuacgcccagaaguuccgcggccgccucguccucacccgcgacaucggcuccuccaccgucacccuccuccucaaccaccuccgccgcgacgacuccgccgucuacuucugcgcccgcgaguccaacgccuccggccgcggccgcuccauggaccacuggggccgcggcucccgcgucaucgucucccag

SEQ ID NO: 18108 - RNA, 366 nt, Artificial Sequence
  derived and/or modified sequence opt2 from anti-HIV-1_HeavyChain
cagguccagcucguccaguccggcgccgaggucaagaagcccggcgccuccguccgcgucuccugccaggccuccggcuacaccuucaccaacuacauccuccacugguggcgccaggcccccggccagggccucgaguggaugggccucaucaagcccgucuacggcgccgucaacuacgcccgccaguuccagggccgcauccagcucacccgcgacaucuaccgcgagaucgccuuccucgaccucuccggccuccgcuccgacgacaccgccgucuacuacugcgcccgcgacgaguccggcgacgaccucaaguggcaccuccaccccuggggccagggcacccaggucaucgucuccccc

SEQ ID NO: 18109 - RNA, 366 nt, Artificial Sequence
  derived and/or modified sequence opt2 from anti-HIV-1_HeavyChain
cagguccagcucguccaguccggcgccgaggucaagaagcccggcgccuccguccgcaucuccugccaggccuccggcuacaccuucaccgacuacguccuccacugguggcgccaggcccccggccagggccucgaguggaugggcuggaucaagcccgucuacggcgcccgcaacuacgcccgccgcuuccagggccgcaucaacuucgaccgcgacaucuaccgcgagaucgccuacauggaccucuccggccuccgcuccgacgacaccgcccgcuacuucugcgcccgcgacggcuccggcgacgacaccuccuggcaccuccaccccuggggccagggcacccucgucaucgucuccgcc

SEQ ID NO: 18110 - RNA, 366 nt, Artificial Sequence
  derived and/or modified sequence opt2 from anti-HIV-1_HeavyChain
ucccagcagcucguccaguccggcacccaggucaagaagcccggcgccuccguccgcgucuccugccaggccuccggcuacaccuucaccaacuacauccuccacugguggcgccaggcccccggccagggccucgaguggaugggccucaucaagcccgucuacggcgccgucaacuacgcccgccaguuccagggccgcauccagcucacccgcgacaucuaccgcgagaucgccuuccucgaccucuccggccuccgcaccgacgacaccgccgucuacuacugcgcccgcgacgaguccggcgacgaccucaaguggcaccuccaccccuggggccagggcacccaggucaucgucuccccc

SEQ ID NO: 18111 - RNA, 366 nt, Artificial Sequence
  derived and/or modified sequence opt2 from anti-HIV-1_HeavyChain
cagguccaccucgagcaguccggcuccgucguccgcuggcccggcgccucccucacccucuccugcaccgccuccggcuacaucuucgucaacuaccacauccacuggcuccgccaggcccccggccagcgccucgagcucaugggcaccaucaaccccgucggcggcgccaccuccuacacccagcgcuuccgcggccgccucguccucacccgcgacaucggcuccaacaccgucacccuccuccucaaccaccuccgcuccgacgacuccgccgucuacuucugcgcccgcgaguccaacgccuccggccgcggccgcuccauggaccacuggggccgcggcucccacgucaucgucuccccc

SEQ ID NO: 18112 - RNA, 366 nt, Artificial Sequence
  derived and/or modified sequence opt2 from anti-HIV-1_HeavyChain
ucccagcaccucguccaguccggcacccaggucaagaagcccggcgccuccguccgcgucuccugccaggccuccggcuacaccuucaccaacuacauccuccacugguggcgccaggcccccggccagggccucgaguggaugggccucaucaagcccgucuacggcgccgucaacuacgcccgccaguuccagggccgcauccagcucacccgcgacaucuaccgcgacaucgccuuccucgaccucuccggccuccgcuccgacgacaccgccgucuacuacugcgcccgcgacgaguccggcgacgaccucaaguggcaccuccaccccuggggccagggcacccaggucaucgucuccccc

SEQ ID NO: 18113 - RNA, 366 nt, Artificial Sequence
  derived and/or modified sequence opt2 from anti-HIV-1_HeavyChain
ucccagcagcucguccaguccggcacccaggucaagaagcccggcgccuccguccgcaucuccugccaggccuccggcuacaccuucaccgacuacguccuccacugguggcgccaggcccccggccagggccucgaguggaugggcuggaucaagcccgucuacggcgcccgcaacuacgcccgccgcuuccagggccgcaucaacuucgaccgcgacaucuaccgcgagaucgccuacauggaccucuccggccuccgcuccgacgacaccgcccgcuacuucugcgcccgcgacggcuccggcgacgacaccuccuggcaccuccaccccuggggccagggcacccucgucaucgucuccgcc

SEQ ID NO: 18114 - RNA, 366 nt, Artificial Sequence
  derived and/or modified sequence opt2 from anti-HIV-1_HeavyChain
cagguccaccucgagcagcccggcuccgucguccgcuggcccggcgccucccucacccucuccugcaccgccuccggcuacaucuucgucaacuaccacauccacuggcuccgccaggcccccggccagcgccucgagcuccucggcaccaucaaccccgucggcggcgccaccuccuacgcccagaaguuccgcggccgccucguccucacccgcgacaucggcuccuccaccgucacccuccuccucaaccaccuccgccgcgacgacuccgccgucuacuucugcgcccgcgaguccaacgccuccggccgcggccgcuccauggaccacuggggccgcggcaagcccgucaucgucuccccc

SEQ ID NO: 18115 - RNA, 321 nt, Artificial Sequence
  derived and/or modified sequence opt2 from anti-HIV-1_HeavyChain
gagaucgucaugacccagucccccgccauccucuccgucucccccggcgaccgcgccaccuucuccugccgcgccucccaguccgucaagaacaaccucgccugguaccagaagcgccccggccaggccccccgccuccucaucuucgacgccuccucccgcgccuccggcauccccgcccgcuucuccggcggcggcuccggcaccgaguucacccucaccgucaacuccaugcaguccgaggacuucgccaccuacuacugccagcaguacgaggaguggccccgcaccuucggccagggcaccaaggucgagaucaug

SEQ ID NO: 18116 - RNA, 321 nt, Artificial Sequence
  derived and/or modified sequence opt2 from anti-HIV-1_HeavyChain
cagaucguccucacccaguccccccccacccucucccucucccccggcgagcgcgccacccucuccugccgcgccucccaguccgucaagaacaaccucgccugguaccagaagcgccccggccaggccccccgccuccucaucuucgacaccuccucccgcgccuccaacauccccgcccgcuucuccggcggcggcuccggcaccgaguucacccucaccgucaacuccaugcaguccgaggacuucgccaccuacuacugccagcaguacgaggaguggccccgcaccuucggccagggcaccaaggucgagaucauc

SEQ ID NO: 18117 - RNA, 321 nt, Artificial Sequence
  derived and/or modified sequence opt2 from anti-HIV-1_HeavyChain
gagaucgucaugacccagucccccgccguccucuccgucucccccggcgaccgcgccacccucuccugccgcgccucccaguccgucaagaacaaccucgccugguaccagaagcgccccggccaggccccccgccuccucaucuucgacaccuccucccgcgccuccaacauccccgcccgcuucuccggcggcggcuccggcaccgaguucacccucaccgucaacuccaugcaguccgaggacuucgccaccuacuacugccagcaguacgaggaguggccccgcaccuucggccagggcaccaaggucgagaucaac

SEQ ID NO: 18118 - RNA, 321 nt, Artificial Sequence
  derived and/or modified sequence opt2 from anti-HIV-1_HeavyChain
gagaucguccucacccaguccccccccacccucuccgucucccccggcgaggccgccacccucuccugccgcgccucccaguccgucaagaacaaccucgccugguaccaccucaaggccggccaggccccccgccuccucaucuucgacgccuccucccgcgccggcgacgcccccgcccgcgucuccggcuccggcuacggcaccgaguucacccucaccgucaacuccguccaguccgaggacuucggcgacuacuacugccagcaguacgaggaguggccccgcaccuucggccagggcaccaaggucgaccuccgc

SEQ ID NO: 18119 - RNA, 321 nt, Artificial Sequence
  derived and/or modified sequence opt2 from anti-HIV-1_HeavyChain
gagaucgucaugacccaguccccccccacccucuccgucucccccggcgagaccgccacccucuccugccgcgccucccagaacgucaagaacaaccucgccugguaccagcucaagcccggccaggccccccgccuccucaucuucgacgccuccucccgcgccggcggcauccccgaccgcuucuccggcuccggcuacggcaccgacuucacccucaccgucaacuccguccaguccgaggacuucggcgacuacuucugccagcaguacgaggaguggccccgcaccuucggccagggcaccaaggucgaccuccgc

SEQ ID NO: 18120 - RNA, 321 nt, Artificial Sequence
  derived and/or modified sequence opt2 from anti-HIV-1_HeavyChain
gagaucgucaugacccagucccccgccguccucuccgucucccccggcgaccgcgccacccucuccugccgcgccucccaguccgucaagaacaaccucgccugguaccagaagcgccccggccaggccccccgccuccucaucuucgacaccuccucccgcgccuccaacauccccgcccgcuucuccggcggcggcuccggcaccgaguucacccucaccgucaacuccaugcaguccgaggacuucgccaccuacuacugccagcaguacgaggaguggccccgcaccuucggccagggcaccaaggucgagaucauc

SEQ ID NO: 18121 - RNA, 399 nt, Artificial Sequence
  derived and/or modified sequence opt2 from anti-HIV-1_HeavyChain
gagguccaccuccaggaguccggccccggccucguccgcccccucgagacccucucccucaccugcaccgccuccggcgccuccauccgcggcggcgaguggggcgacaacgacuaccacuggggcuggguccgccacucccccgagaagggccucgaguggaucggcuccauccacuggcgcggcaccacccacuacaacgcccccuuccgcggccgcgccacccucuccaucgacaccucccgcaaccaguucuuccuccgccucaccuccaugaccgccgacgacaccgccgucuacuacugcgucaagcacaaguaccacgacaucgucauggucguccccaucgccggcugguucgaccccuggggccagggccuccaggucaccgucuccgcc

SEQ ID NO: 18122 - RNA, 399 nt, Artificial Sequence
  derived and/or modified sequence opt2 from anti-HIV-1_HeavyChain
gagguccaccuccaggaguccggccccggccucguccgcccccucgagacccucucccucaccugcaccgccuccggcgccuccauccgcggcggcgaguggggcgacaacgacuaccacuggggcuggguccgccacucccccgagaagggccucgaguggaucggcuccauccacuggcgcggcaccacccacuacaacgcccccuuccgcggccgcgccacccucuccaucgacaccucccgcaaccaguucuuccuccgccucaccuccaugaccgccgacgacaccgccgucuacuacugcgucaagcacaaguaccacgacaucgucauggucguccccaucgccggcugguucaaccccuggggccagggccuccaggccaccguccccucc

SEQ ID NO: 18123 - RNA, 399 nt, Artificial Sequence
  derived and/or modified sequence opt2 from anti-HIV-1_HeavyChain
cagguccagcucaaggaguccggccccggccucgucaagcccuccgagacccucucccucaccugcaccgucuccggcggcuccaugcgcggcaccgacuggggcgagaacgacuuccacuacggcuggauccgccacuccuccgccgagggccucgaguggaucggcuccauccacuggcgcggcaccacccacuacaagauguccuuccgcucccgcgccaccaucuccaucgacaccuccaacaaccgcuucucccucauguucuccuucgucaccgccgaggacaccgccgucuacuacugcgcccgccacaaguaccacgacaucuuccgcgucguccccgucgccggcugguucgaccccuggggccagggccuccucgucaccgucuccucc

SEQ ID NO: 18124 - RNA, 399 nt, Artificial Sequence
  derived and/or modified sequence opt2 from anti-HIV-1_HeavyChain
gagguccaccuccaggaguccggccccggccucguccgcccccucgagacccucucccucaccugcaccgccuccggcgccuccauccgcggcggcgaguggggcgacaacgacuaccacuggggcuggguccgccacucccccgagaagggccucgaguggaucggcuccauccacuggcgcggcaccacccacuacaacgcccccuuccgcggccgcgccacccucuccaucgacaccuccaagaaccaguucucccuccgccucaccuccaugaccgccgacgacaccgccgucuacuacugcgucaagcacaaguaccacgacaucgucauggucguccccuucgccggcugguucgaccccuggggccagggccuccgcgucaccgucuccgcc

SEQ ID NO: 18125 - RNA, 399 nt, Artificial Sequence
  derived and/or modified sequence opt2 from anti-HIV-1_HeavyChain
gagguccaccuccaggaguccggccccggccucguccgcccccucgagacccucucccucaccugcaccgccuccggcgccuccauccgcggcggcgaguggggcgacaacgacuaccacuggggcuggguccgccacucccccgagaagggccucgaguggaucggcuccauccacuggcgcggcaccacccacuacaacgcccccuuccgcggccgcgccacccucuccaucgacaccuccaagaaccaguucuuccuccgccucaccuccaugaccgccgacgacaccgccgucuacuacugcgucaagcacaaguaccacgacaucugcauggucguccccaucgccggcugguucgaccccuggggccagggccuccaggucaccgucucccag

SEQ ID NO: 18126 - RNA, 399 nt, Artificial Sequence
  derived and/or modified sequence opt2 from anti-HIV-1_HeavyChain
cagguccaccuccaggaguccggccccggccucguccgcccccucgagacccucucccucaccugcaccgccuccggcgccuccauccgcggcggcgaguggggcgacaacgacuaccacuggggcuggguccgccacucccccgagaagggccucgaguggaucggcuccauccacuggcgcggcaccacccacuacaacgcccccuuccgcggccgcgccacccucuccaucgacaccucccgcaaccaguucuuccuccgccucaccuccaugaccgccgacgacaccgccgucuacuacugcgucaagcacaaguaccacgacaucgucauggucguccccaucgccggcugguucgaccccuggggccagggccuccaggucaccgucuccucc

SEQ ID NO: 18127 - RNA, 399 nt, Artificial Sequence
  derived and/or modified sequence opt2 from anti-HIV-1_HeavyChain
cagguccaccuccaggaguccggccccggccucguccgcccccucgagacccucucccucaccugcaccgccuccggcgccuccauccgcggcggcgaguggggcgacaacgacuaccacuggggcuggguccgccacucccccgagaagggccucgaguggaucggcuccauccacuggcgcggcaccacccacuacaacgcccccuuccgcggccgcgccacccucuccaucgacaccucccgcaaccaguucuuccuccgccucaccuccaugaccgccgacgacaccgccgucuacuacugcgucaagcacaaguaccacgacaucgucauggucguccccaucgccggcugguucgaccccuggggccagggccuccgcgucaccgucucccag

SEQ ID NO: 18128 - RNA, 399 nt, Artificial Sequence
  derived and/or modified sequence opt2 from anti-HIV-1_HeavyChain
cagguccaccuccaggaguccggccccggccucguccgcccccucgagacccucucccucaccugcaccgccuccggcgccuccauccgcggcggcgaguggggcgacaacgacuaccacuggggcuggguccgccacucccccggcaagggccucgaguggaucggcuccauccacuggcgcggcaccacccacuacaacgcccccuuccgcggccgcgccacccucuccaucgacaccuuccgcaaccaguucuuccuccgccucaccuccaugaccgccgacgacaccgccgucuacuacugcgucaagcacaaguaccacgacaucgucauggucguccccaucgccggcugguucgaccccuggggccagggccuccaggucaccgucucccag

SEQ ID NO: 18129 - RNA, 399 nt, Artificial Sequence
  derived and/or modified sequence opt2 from anti-HIV-1_HeavyChain
gagguccaccuccaggaguccggccccggccucguccgcccccucgagacccucucccucaccugcaccgccuccggcgccuccauccgcggcggcgaguggggcgacaacgacuaccacuggggcuggguccgccacucccccgagaagggccucgaguggaucggcuccauccacuggcgcggcaccacccacuacaacgcccccuuccgcggccgcgccacccucuccaucgacaccucccgcaaccaguucuuccuccgccucaccuccaugaccgccgacgacaccgccgucuacuacugcgucaagcacaaguaccacgacaucgucauggucguccccaucgccggcugguucgaccccuggggccagggccuccgcggcaccgucuccgcc

SEQ ID NO: 18130 - RNA, 393 nt, Artificial Sequence
  derived and/or modified sequence opt2 from anti-HIV-1_HeavyChain
cagguccagcucguccaguccggcgccgucaucaagacccccggcuccuccgucaagaucuccugccgcgccuccggcuacaacuuccgcgacuacuccauccacuggguccgccucauccccgacaagggcuucgaguggaucggcuggaucaagccccucuggggcgccgucuccuacgcccgccagcuccagggccgcgucuccaugacccgccagcucucccgcgaccccgacgaccccgacuggggcgucgccuacauggaguucuccggccucacccccgccgacaccgccgaguacuucugcguccgccgcggcuccugcgacuacugcggcgacuuccccuggcaguacuggggccagggcaccgucgucgucgucuccuccgcc

SEQ ID NO: 18131 - RNA, 393 nt, Artificial Sequence
  derived and/or modified sequence opt2 from anti-HIV-1_HeavyChain
cagguccagcucguccaguccggcgccgucaucaagacccccggcuccuccgucaagcucuccugccgcgccuccggcuacaacuuccgcgacuacuccauccacuggguccgccucauccccgacaagggcuucgaguggaucggcuggaucaagccccucuggggcgccgucuccuacgcccgccagcuccagggccgcgucuccaugacccgccagcucucccaggaccccgacgaccccgacuggggcgucgccuacauggaguucuccggccucacccccgccgacaccgccgaguacuucugcguccgccgcggcuccugcgacuacugcggcgacuuccccuggcaguacuggggccagggcaccgucgucgucgucuccuccgcc

SEQ ID NO: 18132 - RNA, 303 nt, Artificial Sequence
  derived and/or modified sequence opt2 from anti-HIV-1_LightChain
accgccggccucacccagucccccggcacccucucccucucccccggcgagcgcgccauccucuccugccgcaccucccaguacggcucccucgccugguaccagcagcgccccggccaggccccccgccucgucaucuacgccggccucacccgcgccaccggcauccccgaccgcuucuccggcucccgcuggggcgccgaguacaaccucaccaucuccaaccucgaguccgaggacuucggcgucuacuacugccagcaguacgacuucuucggccagggcaccaagguccaggucgac

SEQ ID NO: 18133 - RNA, 378 nt, Artificial Sequence
  derived and/or modified sequence opt2 from anti-HIV-1_HeavyChain
cagguccagcucguccaguccggcuccggcgucaagaagcucggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuccaccgcccacauggacauccgcggccucacccaggacgacaccgccaccuacuucugcgcccgccagaaguucgcccgcggcgaccagggcugguucuucgaccucuggggccgcggcacccucaucgucgucuccuccgcc

SEQ ID NO: 18134 - RNA, 384 nt, Artificial Sequence
  derived and/or modified sequence opt2 from anti-HIV-1_HeavyChain
cagguccagcucguccaguccggcuccggcgucaagaagcucggcgccuccguccgcgucuccugcuggaccuccgaggacaucuucgagcgcaccgagcucauccacuggguccgccaggcccccggccagggccucgaguggaucggcugggucaaggccgucaccggcaccgucaacuucggcucccucaacuuccgccagcgcgucucccucacccgcgaccgcgaccucuucaccgcccacauggacauccgcggccucacccagggcgacaccgccaccuacuucugcgcccgccagaaguucgagaaguacaccggcggccagggcugguacuucgaccucuggggccgcggcacccucaucgucgucuccuccgcc

SEQ ID NO: 18135 - RNA, 378 nt, Artificial Sequence
  derived and/or modified sequence opt2 from anti-HIV-1_HeavyChain
cagguccagcucguccaguccggcuccgccaugaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgccucccucgacuuccgcaaccgcaucucccucucccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccuccgcc

SEQ ID NO: 18136 - RNA, 387 nt, Artificial Sequence
  derived and/or modified sequence opt2 from anti-HIV-1_HeavyChain
cagguccagcucguccaguccggcgccgaggucaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgccucccucgacuuccgcaaccgcaucucccucucccgcgaccgcgaccucuccaccgcccacauggacauccgcggccucacccaggacgacaccgccaccuacuucugcgcccgccagaaguucgagucccgcuacaccggcggccagggcugguacuucgaccucuggggccgcggcacccacaucgucgucuccuccgcc

SEQ ID NO: 18137 - RNA, 387 nt, Artificial Sequence
  derived and/or modified sequence opt2 from anti-HIV-1_HeavyChain
cagguccagcucguccaguccggcuccgccaugaagaagcccggcgccuccguccgcgucuccugcuggaccuccgaggacaucuucgagcgcaccgagcucaucuacuggguccgccaggcccccggccgcggccucgaguggaucggcugggucaagaccgucuccggcaccgucaacuucggcuccuccgacuuccgcaaccgcaucucccucacccgcgaccgcgaccucuccaccgcccacauggacauccgcggccucacccaggacgacaccgccaccuacuucugcgcccgccagaaguucgagucccucuacuccgacgaccagggcuccuacuucgaccucuggggccgcggcacccucaucaucgucuccuccgcc

SEQ ID NO: 18138 - RNA, 387 nt, Artificial Sequence
  derived and/or modified sequence opt2 from anti-HIV-1_HeavyChain
cagguccagcucguccaguccggccucgaggucaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgccucccucgacuuccgcaaccgcaucucccucucccgcgaccgcgaccucuccaccgcccacauggacauccgcggccucacccaggacgacaccgccaccuacuucugcgcccgccagaaguucgccucccgcuacuccggcgaccagggcuccuacuucgaccucuggggccgcggcacccucaucaucgucuccuccgcc

SEQ ID NO: 18139 - RNA, 387 nt, Artificial Sequence
  derived and/or modified sequence opt2 from anti-HIV-1_HeavyChain
cagguccagcucguccaguccgccuccggcguccgccgccccggcgccuccguccgcgucuccugcuggaccuccgaggacaucuucgagcgcuccgagcucaucuacuggguccgccaggcccccggccgcggccucgaguggaucggcuggaucaagcucgucuccggcgccgucaacuucggcuccgucgacuuccgcgaccgcgucucccucacccgcgaccgcgaccucuucaccgcccacauggacauccgcggccucacccaggacgacaccgccaccuacuucugcgcccgccagaaguucgccucccgcuacuccggcgaccagggcuccuacuucgaccucuggggccgcggcacccucaucaucgucuccuccgcc

SEQ ID NO: 18140 - RNA, 375 nt, Artificial Sequence
  derived and/or modified sequence opt2 from anti-HIV-1_HeavyChain
cagguccagcucguccaguccggcuccggcgucaagaagcccggcgccuccguccgcgucuccugcuggaccuccgagggcaucuucgagaaguccgagcucauccacuggguccgccaggcccccggccagggccucgaguggaucggcugggucaagaccgucaccggcgccgucaacuucggccaccagaucuccgaccgcgucucccucacccgcgaccgcgaccucuucaccgcccacauggacauccgcggccucacccagggcgacaccgccaccuacuucugcgcccgccagaaguucgagcgcggcggccagggcuggaucuucgaccucuggggccgcggcacccucaucgccgucuccuccgcc

SEQ ID NO: 18141 - RNA, 378 nt, Artificial Sequence
  derived and/or modified sequence opt2 from anti-HIV-1_HeavyChain
cagguccagcucguccaguccggcgccgaggucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccuccgcc

SEQ ID NO: 18142 - RNA, 378 nt, Artificial Sequence
  derived and/or modified sequence opt2 from anti-HIV-1_HeavyChain
cagguccagcucguccaguccggcgccgaggucaagcgccccggcgccuccgucaaggucuccugcuggaccuccgaggacaucuucgagcgcaccgagcucauccacuggguccgccaggcccccggccagggccucgaguggaucggcugggucaagaccgucuccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccuccgcc

SEQ ID NO: 18143 - RNA, 378 nt, Artificial Sequence
  derived and/or modified sequence opt2 from anti-HIV-1_HeavyChain
cagguccagcucguccaguccggcuccggcgucaagaagcccggcgccuccguccgcgucuccugcuggaccuccgaggacaucuucgagggcuccgagcucauccacuggguccgccaggcccccggccagggccucgaguggaucggcugggucaagaccgucaccggcgccgucaacuucggcuccgccuacuuccgccaccgcgucucccucacccgcgaccgcgaccucuucaccgcccacauggacauccgcggccucacccagggcgacaccgccaccuacuucugcgcccgccagaaguucauguccggcggccagggcugguacuucgaccucuggggccgcggcaccgucaucgucgucuccuccgcc

SEQ ID NO: 18144 - RNA, 387 nt, Artificial Sequence
  derived and/or modified sequence opt2 from anti-HIV-1_HeavyChain
cagguccagcucguccccuccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccucgacuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccuccgcc

SEQ ID NO: 18145 - RNA, 378 nt, Artificial Sequence
  derived and/or modified sequence opt2 from anti-HIV-1_HeavyChain
cagguccagcucguccaguccggcuccggcgucaagaaggucggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuucaccgcccacauggacauccgcggccucacccaggacgacaccgccaucuacuucugcgcccgccagaaguucuacgccggcggccagggcugguacuucgaccucuggggccgcggcacccucaucgucgucuccuccgcc

SEQ ID NO: 18146 - RNA, 387 nt, Artificial Sequence
  derived and/or modified sequence opt2 from anti-HIV-1_HeavyChain
cagguccagcucguccaguccggcgccgaggucaagaagcccggcuccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagucccgcuacuccggcgaccagggcuccuacuucgaccucuggggccgcggcacccucaucaucgucuccuccgcc

SEQ ID NO: 18147 - RNA, 375 nt, Artificial Sequence
  derived and/or modified sequence opt2 from anti-HIV-1_HeavyChain
cagguccagcucguccaguccggcgccgaggucaagaagcccggcgccuccgucaaggucuccugcaaggccuccggcuacaccuucaccuccuacuacaugcacuggguccgccaggcccccggccagggccucgaguggaucggcugggucaagcccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguacuacgccggcggccagggcugguacuucgaccucuggggccgcggcacccucaucgucgucuccuccgcc

SEQ ID NO: 18148 - RNA, 375 nt, Artificial Sequence
  derived and/or modified sequence opt2 from anti-HIV-1_HeavyChain
cagguccagcucguccaguccggcgccgaggucaagaagcccggcgccuccguccaggucuccugcaaggccuccggcuaccccuucaccaaguacuacaugcacuggguccgccaggcccccggccagggccucgaguggaucggcugggucaaggccgucuccggcgccgucaacuacggcucccucgacuuccgccaccgcgucucccucacccgcgaccgcgaccucuccaccgcccacauggacauccgcggccucacccaggacgacaccgccaccuacuucugcgcccgccagaaguucgcccgcggcgaccagggcugguucuucgaccucuggggccgcggcacccucaucgucgucuccuccgcc

SEQ ID NO: 18149 - RNA, 375 nt, Artificial Sequence
  derived and/or modified sequence opt2 from anti-HIV-1_HeavyChain
cagguccagcucguccaguccggcgccgaggucaagaagcccggcgccuccgucaaggucuccugcaaggccuccggcuacaccuucaccggcuacuacaugcacuggguccgccaggcccccggccagggccucgaguggaucggcugggucaagaccgucuccggcgccgucaacuucggcucccucaacuuccgccaccgcgucucccucacccgcgaccgcgaccucuucaccgcccacauggacauccgcggccucacccagggcgacaccgccaccuacuucugcgcccgccagaaguucgcccgcggcgaccagggcugguucuucgaccucuggggccgcggcacccucaucgucgucuccuccgcc

SEQ ID NO: 18150 - RNA, 402 nt, Artificial Sequence
  derived and/or modified sequence opt2 from anti-HIV-1_HeavyChain
cagguccagcucguccaguccggcuccggcgucaagaagcccggcgccuccguccgcgucuccugccgcgccuccgaggaccucuucggcgacgagaucaucuacgacgacgaggucauccacuggcuccgccagguccccggccagcgccccgaguggaugggcuggauccgccccaagaccggcgcccgcaaccaggcccgccaguuccagccccgcaucucccucacccgcgaccgcgcccucuccaccgccuaccucgaccucaacucccucaccuccgccgacuccggcaccuacuucugcgcccgccagaccuucaagcccgacuucuacuucgccgaccagggcugguccuucaaccucuggggccgcggcgcccacuucaucgucuccuccgcc

SEQ ID NO: 18151 - RNA, 381 nt, Artificial Sequence
  derived and/or modified sequence opt2 from anti-HIV-1_HeavyChain
cagguccagcucguccaguccggcggcggcgucaagaagcccggcgccuccgccuccuucuccugccgcaccuccgaggaccccuucgacaacgaguucuucgacuccgaguucaugcacuggguccgccucacccccggccagcgccccgaguggaugggcuggaugaacccccgcuccggcggcgucaacuacgccggccaguuccgcccccgcauguccauguggcgcgaccgcgagcucuccaccgccuacauggagcuccgcgaccucaccuucgccgacaccggccucuacuucugcgcccgccgcaaggaggacgacuacgacugguacuacgaccucuggggccgcggcgcccacaucaucgucuccgccgcc

SEQ ID NO: 18152 - RNA, 384 nt, Artificial Sequence
  derived and/or modified sequence opt2 from anti-HIV-1_HeavyChain
cagguccagcucguccaggccggcggcggcgucaagaagcccggcgccuccgucacccucuccugcaagaccgccgacgaggacgucuucgacgccgccuacaugcacuggguccgccaggcccccggccagaccuucgaguggcucggcuggaugaagcccgucaccggcgccgucaacuacgcccgcaaguuccagggccgcgucuccuucuaccgcacccgcgagcucggcaucgccuacauggaccuccgcaaccuccgcuucgacgacaccgccgucuacuucugcgcccgcaagaccgccggcgacgucuccggcgacaagcgcggcuucuucuucgaccucuggggccgcggcucccgcgucaucgucuccuccgcc

SEQ ID NO: 18153 - RNA, 384 nt, Artificial Sequence
  derived and/or modified sequence opt2 from anti-HIV-1_HeavyChain
cagguccagcucguccaguccggcgccgaggucaagaagcccggcgccuccgucacccucuccugcaagaccgccgacgaggacgucuucgacgccgccuacaugcacuggguccgccaggcccccggccagaccuucgaguggcucggcuggaugaagcccgucaccggcgccgucuccuacgcccgcaaguuccagggccgcgucuccuucuacaugacccgcgagcucggcauggccuacauggaccuccgcaaccuccgcuucgacgacaccgccgucuacuucugcgcccgcaagaccgccggcgacgucuccggcgacaaccgcggcuacuucuucgaccucuggggccgcggcucccgcgucaucgucuccuccgcc

SEQ ID NO: 18154 - RNA, 384 nt, Artificial Sequence
  derived and/or modified sequence opt2 from anti-HIV-1_HeavyChain
cagguccagcucguccaguccgaggccgaggucaagaagcccggcgccuccaugaccgucuccugcgagaccgccgacgaggacaucuucgacgccgccuacaugcacuggguccgccaggcccccggccagaccuucgaguggcucggcuggaugaagcccgucaccggcgccgucaacuacgcccgcaaguuccagggccgcaucuccuucuaccgcacccgcgagcucgccaucgccuacauggaccuccgcgaccuccgcuucgacgacaccgccgucuacuucugcgcccgcaagaccgccggcgacgucuccggcgacaaccgcggcuacuucuucgaccucuggggccgcggcucccgcgucaucgucuccuccgcc

SEQ ID NO: 18155 - RNA, 420 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgacaccaccgagcuccucuggguccgccaggcccccggccagggccucgaguggaucggcugggucaagaucgucuccggcaccgucaacuucgccucccucgacuuccgcaaccgcaucucccucucccgcgaccgcgaccucuccaccgcccacauggacauccgcggccucacccaggacgacaccgccaccuacuacugcgcccgccagaaguucgccucccgcuacuccggcgaccagggcuccuacuucgaccucuggggccgcggcacccucaucaucgucuccuccgccuccaccaagggccccuccgucuucccccacgaccuc

SEQ ID NO: 18156 - RNA, 417 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgagcgcaccgagcucaucuacuggguccgccaggcccccggccgcggccucgaguggaucggcugggucaagaccgucuccggcaccgucaacuucggcuccuccgacuuccgcaaccgcaucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccuccgccuccaccaacggccccaucggccuccccccccgcuccgcc

SEQ ID NO: 18157 - RNA, 423 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucgagucccucuacuccgacgaccagggcuccuacuucgaccucuggggccgcggcacccucaucaucgucuccuccgccuccaccaagggccccuccuccucccccaccaucugc

SEQ ID NO: 18158 - RNA, 417 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucuccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccuccgccuccaccaagggccccuccgucuucccccacgaccuccgc

SEQ ID NO: 18159 - RNA, 411 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucuccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccuccucccuccaccagggccccuccggccucccccacgac

SEQ ID NO: 18160 - RNA, 417 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccuccgccuccaccaagggccccuccgucuucccccacgaccuccgc

SEQ ID NO: 18161 - RNA, 426 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucuccggcgccgucaacuucggcucccccaacuuccgccaccgcgucucccucacccgcgaccgcgaccucuucaccgcccacauggacauccgcggccucacccagggcgacaccgccaccuacuacugcgcccgccagaaguucgagucccucuacuccgacgaccagggcuccuacuucgaccucuggggccgcggcacccucaucaucgucuccuccgccuccaccaagggccccuccgucuucccccacgaccuccgc

SEQ ID NO: 18162 - RNA, 384 nt, Artificial Sequence
  derived and/or modified sequence opt2 from anti-HIV-1_HeavyChain
cagguccaccucgagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccucc

SEQ ID NO: 18163 - RNA, 423 nt, Artificial Sequence
  derived and/or modified sequence opt2 from anti-HIV-1_HeavyChain
caggucuacauggagcaggccggcgccggcgucaagaagcccggcgccuccgucacccucuccugcaagaccgccgacgaggacgucuucgacgccgccuacaugcacuggguccgccaggcccccggccagaccuucgaguggcucggcuggaugaagcccgucaccggcgccgucaacuacgcccgcaaguuccagggccgcgucuccuucuaccgcacccgcgagcucggcaucgccuacauggaccuccgcaaccuccgcuucgacgacaccgccgucuacuucugcgcccgcaagaccgccggcgacgucuccggcgacaagcgcggcuucuucuucgaccucuggggccgcggcucccgcgucaucgucuccuccgccuccaccaagggccccuccgucuucccccacgaccuccgc

SEQ ID NO: 18164 - RNA, 414 nt, Artificial Sequence
  derived and/or modified sequence opt2 from anti-HIV-1_HeavyChain
caggcccaccucgagcaguccggcuccggcgucaagaagcccggcaccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgcccgcggcgaccagggcugguucuucgaccucuggggccgcggcacccucaucgucgucuccuccgccuccaccaagggccccuccgucuuccccaccaucugc

SEQ ID NO: 18165 - RNA, 411 nt, Artificial Sequence
  derived and/or modified sequence opt2 from anti-HIV-1_HeavyChain
cagguccagcucguccaguccggcgccgaggucaagaagcccggcgccuccgucaaggucuccugcaaggccuccggcuacaccuucaccuccuacuacaugcacuggguccgccaggcccccggccagggccucgaguggaucggcugggucaagcccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguacuacgccggcggccagggcugguacuucgaccucuggggccgcggcacccucaucgucgucuccuccgccuccaccaagggccccgucgucuuccccaccaucugc

SEQ ID NO: 18166 - RNA, 381 nt, Artificial Sequence
  derived and/or modified sequence opt2 from anti-HIV-1_HeavyChain
caggucuacauggagcaggccggcggcggcgucaagaagcccggcgccuccgucacccucuccugcaagaccgccgacgaggacgucuucgacgccgccuacaugcacuggguccgccaggcccccggccagaccuucgaguggcucggcuggaugaagcccgucaccggcgccgucaacuacgcccgcaaguuccagggccgcgucuccuucuaccgcacccgcgagcucggcaucgccuacauggaccuccgcaaccuccgcuucgacgacaccgccgucuacuucugcgcccgcaagaccgccggcgacgucuccggcgacaagcgcggcuucuucuucgaccucuggggccgcggcucccgcgucaucgucuccucc

SEQ ID NO: 18167 - RNA, 384 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcuggaucaagaccgucaccggcgccgucaacuucggcucccucgacuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccucc

SEQ ID NO: 18168 - RNA, 420 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgagcgcaccgagcucaucuacuggguccgccaggcccccggccgcggccucgaguggaucggcugggucaagaccgucuccggcaccgucaacuucggcuccuccgacuuccgcaaccgcaucucccucacccgcgaccgcgaccucuccaccgcccacauggacauccgcggccucacccaggacgacaccgccaccuacuucugcgcccgccagaaguucgagcgcggcggccagggcugguacuucgaccucuggggccgcggcacccucaucgucgucuccuccgccuccaccgagggccccucccgcuccuucccccagauccuccgc

SEQ ID NO: 18169 - RNA, 414 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucugcgucuccuccgccuccccccgcgcccaccgcuccuccccccgcuccgcc

SEQ ID NO: 18170 - RNA, 384 nt, Artificial Sequence
  derived and/or modified sequence opt2 from anti-HIV-1_HeavyChain
caggcccaccucgagcaguccggcuccggcgucaagaagcccggcgccuccguccgcgucuccugcugguccuccgaggacaucuucgagcgcaccgagcucauccacuggguccgccaggcccccggccagggccucgaguggaucggcugggucaagaccgucaccggcgccgucaacuucggcucccucgacuuccgccaccgcaucucccucacccgcgaccgcgaccucuucaccgcccacauggacauccgcggccucacccgcggcgacaccgccaccuacuacugcgcccgccagaaguucgagucccgcuacaccggcggccagggcugguacuucgaccucuggggccgcggcacccacaucgucgucuccucc

SEQ ID NO: 18171 - RNA, 384 nt, Artificial Sequence
  derived and/or modified sequence opt2 from anti-HIV-1_HeavyChain
caggcccaccucgagcaguccggcuccggcgucaagaagcccggcgccuccguccgcgucuccugcugguccuccgaggacaucuucgagcgcaccgagcucauccacuggguccgccaggcccccggccagggccucgaguggaucggcugggucaagaccgucaccggcgccgucaacuucggcucccucgacuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucaucgucuccucc

SEQ ID NO: 18172 - RNA, 423 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgacaccaccuccaucuucaucggcugcgaccgcccccucgacaaggacugguccggccucggcggcuccaagcucucccucgcccccuccaucuucgccucccucgacuuccgcaaccgcaucucccucucccgcgaccgcgaccucuccaccgccuacauggacauccgcggccucacccaggacgacaccgccaccuacuucugcgcccgccagaaguucgccucccgcuacuccggcgaccagggcuccuacuucgaccucuggggccgcggcacccucaucgucgucuccuccgccuccaccaagggccccuccgucuucccccacgaccuc

SEQ ID NO: 18173 - RNA, 399 nt, Artificial Sequence
  derived and/or modified sequence opt2 from anti-HIV-1_HeavyChain
cgcgaguaccucgagcaguccggcggcggcgucaagaagcucggcgccuccguccgcgucuccugccgcgccuccgaggaccucuucggcgacgaggucaucuacgacgacgagcucauccacuggcuccgccagguccccggccagcgccccgaguggaugggcuggauccgccccaagaccggcgcccgcaaccaggcccgccaguuccagccccgcaucaaccucucccgcgaccgcgcccucaacaccgccuaccucgaccucuccucccucaccuccgccgacuccgccaccuacuucugcgcccgccagaccuucaagcccgacuucuacuucgccgaccagggcugguccuucaaccucuggggccgcggcgcccgcgucaucgucuccucc

SEQ ID NO: 18174 - RNA, 384 nt, Artificial Sequence
  derived and/or modified sequence opt2 from anti-HIV-1_HeavyChain
cagguccaccucguccaguccggcgccgaggucaagaagcccggcuccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagucccgcuacuccggcgaccagggcuccuacuucgaccucuggggccgcggcacccucaucaucgucuccucc

SEQ ID NO: 18175 - RNA, 414 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaucgucuccggcgccgucaacuucggcucccccaacuuccgccagcgcgucucccucacccgcgaccgcgaccucuucaccgcccacauggacauccgcggccucacccagggcgacaccgccaccuacuucugcgcccgccagaaguucgagcgcggcggccagggcuggaucuucgaccucuggggccgcggcacccucaucgccgucuccuccgccuccaccaagggccccuccgucuuccccaccaucugc

SEQ ID NO: 18176 - RNA, 441 nt, Artificial Sequence
  derived and/or modified sequence opt2 from anti-HIV-1_HeavyChain
cgcgaguuccucgagcaguccggcggcggcgucaagaagcucggcgccucccuccgcgucuccugccgcgccuccgaggaccucuucggcgacgaguucaucuacgacgacgaggucauccacuggcuccgccagguccccggccagcgccccgaguggaugggcuggauccgccccaagaccggcgcccgcaaccaggccacccaguuccagccccgcaucucccucacccgcgaccgcgcccucuccaccgccuaccucgaccucaacucccucaccuccgccgacuccggcaccuacuucugcgcccgccagaccuucaagcccgacuucuacuucgccgaccagggcugguccuucaaccucuggggccgcggcgcccacuucaucgucuccuccgccuccaccaagggccccuccgucuucccccacgacuccgcc

SEQ ID NO: 18177 - RNA, 399 nt, Artificial Sequence
  derived and/or modified sequence opt2 from anti-HIV-1_HeavyChain
cgcgaguaccucgagcaguccggcggcggcgucaagaagcucggcgccucccuccgcgucuccugccgcgccuccgaggaccucuucggcgacgagaucaucuacgacgacgaggucauccacuggcuccgccagguccccggccagcgccccgaguggaugggcuggauccgccccaagaccggcgcccgcaaccaggcccgccaguuccagccccgcaucucccucacccgcgaccgcgcccucuccaccgccuaccucgaccucaacucccucaccuccgccgacuccggcaccuacuucugcgcccgccagaccuucaagcccgacuucuacuucgccgaccagggcugguccuucaaccucuggggccgcggcgcccacuucaucgucuccucc

SEQ ID NO: 18178 - RNA, 384 nt, Artificial Sequence
  derived and/or modified sequence opt2 from anti-HIV-1_HeavyChain
caggcccaccucgagcaguccggcuccggcgucaagaagcccggcgccuccguccgcgucuccugcugguccuccgaggacaucuucgagcgcaccgagcucauccacuggguccgccaggcccccggccagggccucgaguggaucggcugggucaagaccgucaccggcgccgucaacuucggcucccucgacuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccucc

SEQ ID NO: 18179 - RNA, 381 nt, Artificial Sequence
  derived and/or modified sequence opt2 from anti-HIV-1_HeavyChain
caggucuacauggagcaggccggcggcggcgucaagaagcccggcgccuccgucacccucuccugcaagaccgccgacgaggacgucuucgacgccgccuacaugcacuggguccgccaggcccccggccagaccuucgaguggcucggcuggaugaagcccgucaccggcgccgucuccuacgcccgcaaguuccagggccgcgucuccuucuacaugacccgcgagcucggcauggccuacauggaccuccgcaaccuccgcuucgacgacaccgccgucuacuucugcgcccgcaagaccgccggcgacgucuccggcgacaaccgcggcuacuucuucgaccucuggggccgcggcucccgcgucaucgucuccucc

SEQ ID NO: 18180 - RNA, 414 nt, Artificial Sequence
  derived and/or modified sequence opt2 from anti-HIV-1_HeavyChain
caggcccaccucgagcaguccggcaccggcgucaagaagcccggcgccuccguccgcgucuccugcuggaccuccgaggacaucuucgagaaguccgagcucauccacuggguccgccaggcccccggccagggccucgaguggaucggcugggucaagaucgucuccggcgccgucaacuucggcucccccaacuuccgccagcgcgucucccucacccgcgaccgcgaccucuucaccgcccagauggacauccgcggccucacccagggcgacaccgccaccuacuucugcgcccgccagaaguucgagcgcggcggccagggcuggaucuucgaccucuggggccgcggcacccucaucgccgucuccuccgccuccaccaagggccccuccgucuucccccacgaccuc

SEQ ID NO: 18181 - RNA, 399 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuccaccgcccacauggacauccgcggccucacccaggacgacaccgccaccuacuucugcgcccgccagaaguucgcccgcggcgaccagggcugguucuucgaccucuggggccgcggcacccucaucgucgucuccuccgccuccaccaagggccccuccggc

SEQ ID NO: 18182 - RNA, 414 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgccaccgcgucucccucacccacgaccgcgaccucuucaccgcccacauggacauccgcggccucacccagggcgacaccgccaccuacuucugcgcccgccagaaguucuacgccggcggccagggcugguacuucgaccucuggggccgcggcacccucaucugcgucuccuccgccuccaccaagggccccuccggccuccccccccgcucc

SEQ ID NO: 18183 - RNA, 426 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuccaccgcccacauggacauccgcggccucacccaggacgacaccgccaccuacuucugcgcccgccagaaguucgagucccucuacuccgacgaccagggcuccuacuucgaccucuggggccgcggcacccucaucaucgucuccuccgccuccaccaagggccccuccgucuucccccacgaccuccgc

SEQ ID NO: 18184 - RNA, 414 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucuccggcgccgucaacuucggcucccccaacuuccgccaccgcgucucccucacccgcgaccgcgaccucuucaccgcccacauggacauccgcggccucacccagggcgacaccgccaccuacuacugcgcccgccagaaguucgagcgcggcggccagggcugguacuucgaccucuggggccgcggcacccucaucgucgucuccuccgccuccaccaagggccccuccgucuuccccaccaucuac

SEQ ID NO: 18185 - RNA, 384 nt, Artificial Sequence
  derived and/or modified sequence opt2 from anti-HIV-1_HeavyChain
caggcccaccucgagcaguccggcuccggcgucaagaagcccggcgccuccguccgcgucuccugcugguccuccgaggacaucuucgagcgcaccgagcucauccacuggguccgccaggcccccggccagggccucgaguggaucggcugggucaagaccgucaccggcgccgucaacuucggcucccucgacuuccgccaccgcaucucccucacccgcgaccgcgaccucuucaccgcccacauggacauccgcggccucacccagggcgacaccgccaccuacuacugcgcccgccagaaguucgagucccgcuacaccggcggccagggcugguacuucgaccucuggggccgcggcacccacaucgucgucuccucc

SEQ ID NO: 18186 - RNA, 414 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagggcuccgagcucauccacuggguccgccaggcccccggccagggccucgaguggaucggcugggucaagaccgucaccggcgccgucaacuucggcuccgccuacuuccgccaccgcgucucccucacccgcgaccgcgaccucuucaccgcccacauggacauccgcggccucacccagggcgacaccgccaccuacuacugcgcccgccagaaguucuacaagggcggccagggcugguacuucgaccucuggggccgcggcacccucaucgucgucuccuccgccuccaccaagggccccuccgucuuccccaccaucugc

SEQ ID NO: 18187 - RNA, 399 nt, Artificial Sequence
  derived and/or modified sequence opt2 from anti-HIV-1_HeavyChain
cgcgaguaccucgagcaguccggcggcggcgucaagaagcccggcgccuccguccgcgucuccugccgcgccuccgaggaccucuucggcgacgagaucaucuacgacgacgaggucauccacuggcuccgccagguccccggccagcgccccgaguggaugggcuggauccgccccaagaacggcggccgcaaccaggcccgccaguuccagccccgcaucucccucacccgcgaccgcgcccucaacaccgccuaccucgaccucaacucccucaccuccgccgacuccggcaccuacuucugcgcccgccagaccuucaagcccgacuucuacuucgccgaccagggcugguccuucaaccucuggggccgcggcgcccgcgucaucgucuccucc

SEQ ID NO: 18188 - RNA, 375 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuccaccgcccacauggacauccgcggccucacccaggacgacaccgccaccuacuucugcgcccgccagaaguucgcccgcggcgaccagggcugguucuucgaccucuggggccgcggcacccucaucgucgucuccucc

SEQ ID NO: 18189 - RNA, 420 nt, Artificial Sequence
  derived and/or modified sequence opt2 from anti-HIV-1_HeavyChain
caggucuacauggagcaggccggcggcggcgucaagaagcccggcgccuccgucacccucuccugcaagaccgccgacgaggacgucuucgacgccgccuacaugcacuggguccgccaggcccccggccagaccuucgaguggcucggcuggaugaagcccgucaccggcgccgucuccuacgcccgcaaguuccagggccgcgucuccuucuacaugacccgcgagcucggcauggccuacauggaccuccgcaaccuccgcuucgacgacaccgccgucuacuucugcgcccgcaagaccgccggcgacgucuccggcgacaaccgcggcuacuucuucgaccucuggggccgcggcucccgcgucaucgucuccuccgccuccaccaagggccccuccgucuuccccaccaucugc

SEQ ID NO: 18190 - RNA, 417 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagggcuccgagcucauccacuggguccgccaggcccccggccagggccucgaguggaucggcugggucaagaccgucaccggcgccgucaacuucggcuccgccuacuuccgccaccgcgucucccucacccgcgaccgcgaccucuucaccgcccacauggacauccgcggccucacccaguccgacaccgccaccuacuucugcgcccgccagaaguucuacgccggcggccagggcugguacuucgaccucuggggccgcggcacccucaucgucgucuccuccgccuccaccaagggccccuccgucuucccccacgaccuccgc

SEQ ID NO: 18191 - RNA, 426 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgagcgcaccgagcucaucuacuggguccgccaggcccccggccgcggccucgaguggaucggcugggucaagaccgucuccggcaccgucaacuucggcuccuccgacuuccgcaaccgcaucucccucacccgcgaccgcgaccucuccaccgcccacauggacauccgcggccucacccaggacgacaccgccaccuacuucugcgcccgccagaaguucgagucccucuacuccgacgaccagggcuccuacuucgaccucuggggccgcggcacccucaucaucgucuccuccgccucccccaagggccccuccggccuccccccccgcuccgcc

SEQ ID NO: 18192 - RNA, 411 nt, Artificial Sequence
  derived and/or modified sequence opt2 from anti-HIV-1_HeavyChain
cagguccagcucguccaguccggcgccgaggucaagaagcccggcgccuccgucaaggucuccugcaaggccuccggcuacaccuucaccaccuacggcaucuccuggguccgccaggcccccggccagggccucgaguggaucggcugggucaagaccgucaccggcgccgucaacuucggccaccagaucuccgaccgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccuccgccuccaccaagggccccuccgucuucccccacgaccuccgc

SEQ ID NO: 18193 - RNA, 417 nt, Artificial Sequence
  derived and/or modified sequence opt2 from anti-HIV-1_HeavyChain
caggcccagcucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccuccgccuccaccaagggccccuccgucuucccccacgaccuccgc

SEQ ID NO: 18194 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuacugcgcccgccagaaguucgagcgcggcggccagggcugguacuucgaccucuggggccgcggcacccucaucgucgucuccucc

SEQ ID NO: 18195 - RNA, 384 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuacugcgcccgccagaaguucgagucccgcuacaccggcggccagggcugguacuucgaccucuggggccgcggcacccacaucgucgucuccucc

SEQ ID NO: 18196 - RNA, 414 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccuccgccuccaccaagggccccuccgucuuccccaccaucugc

SEQ ID NO: 18197 - RNA, 381 nt, Artificial Sequence
  derived and/or modified sequence opt2 from anti-HIV-1_HeavyChain
cagguccagcucguccaguccggcgccgagguccagaagcccggcgccuccgucaccgucuccugcaaggccuccggcuacacccucaucuccuacggcaucuccuggguccgccaggcccccggccagggccccgaguggaugggcuggauccgccccaagaccggcgcccgcaaccaggcccgccaguuccagccccgcaucucccucacccgcgaccgcgcccucuccaccgccuaccucgaccucaacucccucaccuccgccgacuccggcaccuacuucugcgcccgccagaccuucaagcccgacuucuacuucgccgaccagggcugguccuucaaccucuggggccgcggcgcccacuucaucgucuccucc

SEQ ID NO: 18198 - RNA, 414 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacauccuccgcaagaaggagcucauccacuggguccgccaggcccccggccagggccucgaguggaucggcugggucaagaccgucaccggcaccgucaacuucggcuccuccgacuuccgccagcgcgucucccucacccgcgaccgcgaccucuucaccgcccacauggacauccgcggccucacccagggcgacaccgccaccuaccucugcgcccgccagaaguucgagcgcggcggccagggcuggaucuucgaccucuggggccgcggcacccucaucgccgucuccuccgccuccaccaagggccccuccgucuucccccacgaccuc

SEQ ID NO: 18199 - RNA, 426 nt, Artificial Sequence
  derived and/or modified sequence opt2 from anti-HIV-1_HeavyChain
caggcccaccucgagcaguccggcuccggcgucaagaagcccggcgccuccguccgcgucuccugcugguccuccgaggacaucuucgagcgcaccgagcucauccacuggguccgccaggcccccggccagggccucgaguggaucggcugggucaagaccgucaccggcgccgucaacuucggcucccucgacuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccuccgccuccaccaacggccccaucggccucccccaccgcuccgcc

SEQ ID NO: 18200 - RNA, 384 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucggcaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucgagucccucuacuccgacgaccagggcuccuacuucgaccucuggggccgcggcacccucaucaucgucuccucc

SEQ ID NO: 18201 - RNA, 417 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaucgucuccggcgccgucaacuucggcucccccaacuuccgccagcgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccuccgccuccaccaagggccccuccggccucccccacggcuccgcc

SEQ ID NO: 18202 - RNA, 423 nt, Artificial Sequence
  derived and/or modified sequence opt2 from anti-HIV-1_HeavyChain
cagguccaguacggccgcgaggccggcgccggcaugaagaagcccggcgccuccaugaccgucuccugcaagaccgccgacgaggacaucuucgacgccgccuacaugcaccgcguccgccaggcccccggccagaccuucgaguggcucggcuggaugaagcccgucaccggcgccgucaacuacgcccgccaguuccagggccgcgucuccuucuaccgcacccgcgagcucggcaucgccuacauggaccuccgcgaccucaaguucgacgacaccgccgucuacuucugcgcccgcaagaccaagggcgacgucuccggcgacgaccgcggcuucuucuucgaccucuggggccgcggcacccgcgucaucgucuccuccgccuccaccaagggccccuccgucuuccccaccaucuac

SEQ ID NO: 18203 - RNA, 426 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccucgacuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccuccgccuccaccaagggccccuccgucuucccccacgaccuccgc

SEQ ID NO: 18204 - RNA, 423 nt, Artificial Sequence
  derived and/or modified sequence opt2 from anti-HIV-1_HeavyChain
cagguccagcucguccaguccgaggccgagcucaagaagcccggcgccuccgucuccgucuccugcaaggccuccggcuacuccuucaccuccuacggcaucuccuggguccgccagguccccggccagggccucgaguggaucgccuggauccgccccaagaccggcgcccgcaaccaggcccgccaguuccagccccgcaucucccucacccgcgaccgcgcccucuccaccgccuaccucgaccucaacucccucaccuccgccgacuccggcaccuacuucugcgcccgccagaccuucaagcccgacuucuacuucgccgaccagggcugguccuucaaccucuggggccgcggcgcccacuucaucgucuccuccgccuccaccaagggccccuccgucuucccccacgaccuccgc

SEQ ID NO: 18205 - RNA, 414 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuacugcgcccgccagaaguucgagcgcggcggccagggcugguacuucgaccucuggggccgcggcacccucaucgucgucuccuccgccuccaccaagggccccuccgucuucccccacgaccuc

SEQ ID NO: 18206 - RNA, 381 nt, Artificial Sequence
  derived and/or modified sequence opt2 from anti-HIV-1_HeavyChain
cagguccagcucguccaguccggcgccgagguccagaagcccggcgccuccgucaccgucuccugcaaggccuccggcuacacccucaucuccuacggcaucuccuggguccgccaggcccccggccagggccccgaguggaugggcuggauccgccccaagaccggcgcccgcaaccaggcccgccaguuccagccccgcaucucccucacccgcgaccgcgcccucuccaccgccuaccucgaccucaacucccucaccuccgccgacuccggcaccuacuacugcgcccgccagaccuucaagcccgacuucuacuucgccgaccagggcugguccuucaaccucuggggccgcggcgcccacuucaucgucuccucc

SEQ ID NO: 18207 - RNA, 414 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuucaccgcccacauggacauccgcggccucacccaggacgacaccgccaccuacuucugcgcccgccagaaguucgcccgcggcgaccagggcugguucuucgaccucuggggccgcggcacccucaucgucgucuccuccgccuccaccaagggccccuccgucuucccccagaucugc

SEQ ID NO: 18208 - RNA, 378 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucugcgucuccuccgcc

SEQ ID NO: 18209 - RNA, 438 nt, Artificial Sequence
  derived and/or modified sequence opt2 from anti-HIV-1_HeavyChain
cagggcuaccucgcccaguccggcggcggcgucaagaagcccggcaccuccgccuccuucuccugccgcaccuccgacgacaucuacgacaacgaguucuucgacuccgccuucaugcacuggguccgccucauccccggccagcgccccgaguggaugggcuggaugaacccccgcuccggcgccgucaacuacgcccgccagcuccagccccgcgucuccauguaccgcgaccgcgaccucuccaccgccuaccucgaccucaacucccucaccuccgccgacuccggcaccuacuucugcgcccgccagaccuucaagcccgacuucuacuucgccgaccagggcugguccuucaaccucuggggccgcggcgcccacuucaucgucuccuccgccuccaccaagggccccuccguccucccccacgaccuccgc

SEQ ID NO: 18210 - RNA, 414 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucacccacuggguccgccaggcccccggccagggccucgaguggaucggcugggucaagaucgucuccggcgccgucaacuucggcucccccaacuuccgccagcgcgucucccucacccgcgaccgcgaccucuucaccgcccacauggacauccgcggccucacccagggcgacaccgccaccuacuucugcgcccgccagaaguucgagcgcggcggccagggcuggaucuucgaccucuggggccgcggcacccucaucgccgucuccuccgccuccaccaagggccccuccgucuucccccgcuccgcc

SEQ ID NO: 18211 - RNA, 414 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaagaaggagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccuccgccuccaccaagggccccuccgucuucccccacgaccuc

SEQ ID NO: 18212 - RNA, 384 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcucccucgacuuccgccaccgcaucucccucacccgcgaccgcgaccucuucaccgcccacauggacauccgcggccucacccagggcgacaccgccaccuacuacugcgcccgccagaaguucgagucccgcuacaccggcggccagggcugguacuucgaccucuggggccgcggcacccacaucgucgucuccucc

SEQ ID NO: 18213 - RNA, 414 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuacugcgcccgccagaaguucuacgccggcggccagggcugguacuucgaccucuggggccgcggcacccucaucgucgucuccuccgccuccaccaagggccccuccgucuuccccaccaucugc

SEQ ID NO: 18214 - RNA, 384 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuccaccgcccacauggacauccgcggccucacccaggacgacaccgccaccuacuucugcgcccgccagaaguucgagucccucuacuccgacgaccagggcuccuacuucgaccucuggggccgcggcacccucaucaucgucuccucc

SEQ ID NO: 18215 - RNA, 426 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagggcuccgagcucauccacuggguccgccaggcccccggccagggccucgaguggaucggcugggucaagaccgucaccggcgccgucaacuucggcuccgccuacuuccgccaccgcgucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccuccgccuccaccaagggccccuccgucuucccccacgaccuccgc

SEQ ID NO: 18216 - RNA, 408 nt, Artificial Sequence
  derived and/or modified sequence opt2 from anti-HIV-1_HeavyChain
cagguccagcucguccacuccggcgccgaggucaagaagcccggcgccuccaugaaggucuccugcaagaccuccggcuacuccuucaccggcuacuacaugcacuggguccgccaggcccccggccagggccucgaguggaugggcuggaucaaccccuccuccaacgacaccaacuacgcccagaaguuccagggccgcgucaccaugacccgcgacaccuccaucaacaccgccuacauggagcucucccgccuccgcuccggcgacaccgccaucuacuucugcgcccgccagaaguucuacgccggcggccagggcugguacuucgaccucuggggccgcggcacccucaucgucgucuccuccgccuccaccaagggccccuccgucuuccccaccaucugc

SEQ ID NO: 18217 - RNA, 381 nt, Artificial Sequence
  derived and/or modified sequence opt2 from anti-HIV-1_HeavyChain
caggucuacauggagcaggccggcggcggcgucaagaagcccggcgccuccgucacccucuccugcaagaccgccgacgaggacgucuucgacgccgccuacaugcacuggguccgccaggcccccggccagaccuucgaguggcucggcuggaugaagcccgucaccggcgccgucuccuacgcccgccgcuuccagggccgcgucuccuucuacaugacccgcgagcucggcauggccuacauggaccuccgcaaccuccgcuucgacgacaccgccgucuacuucugcgcccgcaagaccgccggcgacgucuccggcgacaaccgcggcuacuucuucgaccucuggggccgcggcucccgcgucaucgucuccucc

SEQ ID NO: 18218 - RNA, 414 nt, Artificial Sequence
  derived and/or modified sequence opt2 from anti-HIV-1_HeavyChain
cagggcacccucgagcaguccugguccgaggucaagaagcucggcgccuccguccgcgucuccugcuggaccuccgaggacaucuucaagaccgagcucauccacuggguccgccaggcccccggccagggccucgaguggaucggcggcaugaaggccgucuccggcgccgucaacuacggcucccucgacuuccgccaccgcgucucccucacccccgaccgcgaccucuccaccgcccacauggacauccgcggccucacccaggacgacaccgccaccuacuucugcgcccgccagaaguucgcccgcggcgaccagggcugguucuucgaccucuggggccgcggcacccucaucgucgucuccuccgccuccaccaagggccccuccgucuucccccacgaccuccgc

SEQ ID NO: 18219 - RNA, 423 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucgccucccucgacuuccgcaaccgcaucucccucucccgcgaccgcgaccucuccaccgccuacauggacauccgcggccucacccaggacgacaccgccaccuacuucugcgcccgccagaaguucgccucccgcuacuccggcgaccagggcuccuacuucgaccucuggggccgcggcacccucaucugcgucuccuccgccuccacccgcgcccaccgccuccccccccgcuccgcc

SEQ ID NO: 18220 - RNA, 414 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgcccgcggcgaccagggcugguucuucgaccucuggggccgcggcacccucaucgucgucuccuccgccuccccccgcgcccaccgcuccuccccccgcuccgcc

SEQ ID NO: 18221 - RNA, 417 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccuccgccuccaccaagggccccuccgucuucccccacgacuccgcc

SEQ ID NO: 18222 - RNA, 414 nt, Artificial Sequence
  derived and/or modified sequence opt2 from anti-HIV-1_HeavyChain
caggcccaccucguccaguccggcuccggcgucaagaagcccggcgccuccguccgcgucuccugcuggaccuccgaggacaucuucaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccuccgccuccaccaagggccccuccgucuucccccacgaccuccgc

SEQ ID NO: 18223 - RNA, 414 nt, Artificial Sequence
  derived and/or modified sequence opt2 from anti-HIV-1_HeavyChain
caggcccagcucgagcaguccggcuccggcgucaagaagcccggcgccuccguccgcgucuccugcuggaccuccgaggacaucuucaagaccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccuccgccuccaccaagggccccuccgucuucccccacgaccuccgc

SEQ ID NO: 18224 - RNA, 417 nt, Artificial Sequence
  derived and/or modified sequence opt2 from anti-HIV-1_HeavyChain
caggcccaccucgagcaguccggccgcgaggucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccuccgccuccaccaagggccccuccgucuucccccacgaccuccgc

SEQ ID NO: 18225 - RNA, 384 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucuccggcgccgucaacuucggcucccccaacuuccgccaccgcaucucccucacccgcgaccgcgaccucuucaccgcccacauggacauccgcggccucacccagggcgacaccgccaccuacuacugcgcccgccagaaguucgagucccgcuacaccggcggccagggcugguacuucgaccucuggggccgcggcacccacaucgucgucuccucc

SEQ ID NO: 18226 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagggcuccgagcucauccacuggguccgccaggcccccggccagggccucgaguggaucggcugggucaagaccgucaccggcgccgucaacuucggcuccgccuacuuccgccaccgcgucucccucacccgcgaccgcgaccucuucaccgcccacauggacauccgcggccucacccagggcgacaccgccaccuacuacugcgcccgccagaaguucuacaagggcggccagggcugguacuucgaccucuggggccgcggcacccucaucgucgucuccucc

SEQ ID NO: 18227 - RNA, 381 nt, Artificial Sequence
  derived and/or modified sequence opt2 from anti-HIV-1_HeavyChain
cagguccagcucguccaguccggcgccgaggucaagaagcccggcgccuccgucaaggucuccugcaaggccuccggcuacaccuucaccgacuacuaccuccacuggguccgccaggcccccggccagggccucgacugggucggcuggaucaaccccaacuccggcggcaccaacuacgcccagaaguuccagggccgcgucgccaugacccgcgacaccucccucuccuccgucuaccucgaccucaacucccucaccuccgccgacuccggcaccuacuucugcgcccgccagaccuucaagcccgacuucuacuucgccgaccagggcugguccuucaaccucuggggccgcggcgcccacuucaucgucuccucc

SEQ ID NO: 18228 - RNA, 414 nt, Artificial Sequence
  derived and/or modified sequence opt2 from anti-HIV-1_HeavyChain
caggccgaccucgagcaguccggcuccggcgucaagaagcccggcgccuccguccgcgucuccugcuggaccuccgaggacaucuucgagcgcaccaacuacguccacuggguccgccaggcccccggccgcggccucgaguggaucggcugguccaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccuccgccuccaccaagggccccuccgucuucccccacgaccuc

SEQ ID NO: 18229 - RNA, 381 nt, Artificial Sequence
  derived and/or modified sequence opt2 from anti-HIV-1_HeavyChain
caggucuacauggagcaggccggcggcggcaugaagaagcccggcgccuccaugaccgucuccugcaagaccgccgacgaggacaucuucgacgccgccuacaugcacuggguccgccaggcccccggccagaccuucgaguggcucggcuggaugaagcccgucaccggcgccgucaacuacgcccgccaguuccagggccgcgucuccuucuaccgcacccgcgagcucggcaucgccuacauggaccuccgcgaccucaaguucgacgacaccgccgucuacuucugcgcccgcaagaccaagggcgacgucuccggcgacgaccgcggcuucuucuucgaccucuggggccgcggcacccgcgucaucgucuccucc

SEQ ID NO: 18230 - RNA, 384 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgagcgcaccgagcucaucuacuggguccgccaggcccccggccgcggccucgaguggaucggcugggucaagaccgucuccggcaccgucaacuucggcuccuccgacuuccgcaaccgcaucucccucacccgcgaccgcgaccucuccaccgcccacauggacauccgcggccucacccaggacgacaccgccaccuacuucugcgcccgccagaaguucgagucccucuacuccgacgaccagggcuccuacuucgaccucuggggccgcggcacccucaucaucgucuccucc

SEQ ID NO: 18231 - RNA, 414 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgagcgcaccaaccucauccacuggguccgccaggcccccggccagggccucgaguggaucggcugggucaaggccgucuccggcgccgucaacuacggcucccucgacuuccgccaccgcgucucccucacccgcgaccgcgaccucuccaccgcccacauggacauccgcggccucacccaggacgacaccgccaccuacuucugcgcccgccagaaguucgcccgcggcgaccagggcugguucuucgaccucuggggccgcggcacccucaucgucgucuccuccgccuccaccaagggccccuccgucuucccccacgaccuc

SEQ ID NO: 18232 - RNA, 381 nt, Artificial Sequence
  derived and/or modified sequence opt2 from anti-HIV-1_HeavyChain
caggucuacauggagcaggccggcggcggcgucaagaagcccggcgccuccgucacccucuccugcaagaccgccggcgaggacgucuucgacgccgccuacaugcacuggguccgccaggcccccggccagaccuucgaguggcucggcuggaugaagcccgucaccggcgccgucaacuacgcccgcaaguuccagggccgcgucuccuucuaccgcacccgcgagcucggcaucgccuacauggaccuccgcaaccuccgcuucgacgacaccgccgucuacuucugcgcccgcaagaccgccggcgacgucuccggcgacaagcgcggcuucuucuucgaccucuggggccgcggcucccgcgucaucgucuccucc

SEQ ID NO: 18233 - RNA, 384 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgagcgcaccgagcucaucuacuggguccgccaggcccccggccgcggccucgaguggaucggcugggucaagaccgucuccggcaccgucaacuucggcuccuccgacuuccgcaaccgcaucucccucacccgcgaccgcgaccucuccaccgcccacauggacauccgcggccucacccaggacgacaccgccaccuacuucugcgcccgccagaaguucgagucccucuacuccgacgaccagggcuccuacuucgaccucuggggccgcggcacccucaucaccgucuccucc

SEQ ID NO: 18234 - RNA, 429 nt, Artificial Sequence
  derived and/or modified sequence opt2 from anti-HIV-1_HeavyChain
caggcccaccucgagcaguccggcuccggcgucaagaagcccggcgccuccguccgcgucuccugcugguccuccgaggacaucuucgagcgcaccgagcucauccacuggguccgccaggcccccggccagggccucgaguggaucggcugggucaagaccgucaccggcgccgucaacuucggcucccucgacuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccuccgccuccaccaagggccccuccggccucccccccaccaucugccgc

SEQ ID NO: 18235 - RNA, 417 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucgcccgcggcgaccagggcugguucuucgaccucuggggccgcggcacccucaucgucgucuccuccgccuccaccaagggccccuccgucuucccccacgaccuccgc

SEQ ID NO: 18236 - RNA, 417 nt, Artificial Sequence
  derived and/or modified sequence opt2 from anti-HIV-1_HeavyChain
caggcccaccucgagcaguccggcuccggcgucaagaagcccggcaccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccuccgccuccaccaagggccccuccgucuucccccacgaccuccgc

SEQ ID NO: 18237 - RNA, 417 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgccaccgcgucucccucacccgcggccgcgaccucuucaccgcccacauggacauccgcggccucacccagggcgacaccgccaccuacuacugcgcccgccagaaguucgagcgcggcggccagggcugguacuucgaccucuggggccgcggcacccucaucgucgucuccuccgccuccaccaagggccccuccgucuucccccacgaccuccgc

SEQ ID NO: 18238 - RNA, 411 nt, Artificial Sequence
  derived and/or modified sequence opt2 from anti-HIV-1_HeavyChain
caggcccaccucggcgccaacugguccggcgucaagaagcucggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuccaccgcccacauggacauccgcggccucacccaggacgacaccgccaccuacuucugcgcccgccagaaguucgcccgcggcgaccagggcugguucuucgaccucuggggccgcggcacccucaucgucgucuccuccgccuccaccaagggccccuccgucuucccccagauc

SEQ ID NO: 18239 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccucc

SEQ ID NO: 18240 - RNA, 423 nt, Artificial Sequence
  derived and/or modified sequence opt2 from anti-HIV-1_HeavyChain
caggcccagcucgagcaguccggcgucggcgucaagaagcccggcgccuccguccgcgucuccugccucgccuccgaggacaucuucaagaccgagcucauccacuggguccgccaggcccccggccagggccucgaguggaucggcugggucaagaccgucaccggcgccgucaacuucggcucccagaucuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccuccgccuccaccaagggccccuccgucuucccccacgaccuccgc

SEQ ID NO: 18241 - RNA, 411 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucgcccaccagaucuccgaccgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccuccgccuccaccaagggccccuccgucuuccccaccaucugc

SEQ ID NO: 18242 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcuccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguacuacgccggcggccagggcugguacuucgaccucuggggccgcggcacccucaucugcgucuccucc

SEQ ID NO: 18243 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucuccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccucc

SEQ ID NO: 18244 - RNA, 375 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgagcgcaccgagcucauccacuggguccgccaggcccccggccgcggccucgaguggaucggcugggucaaggccgucuccggcgccgucaacuacggcucccucgacuuccgccaccgcgucucccucacccgcgaccgcgaccucuucaccgcccacauggacauccgcggccucacccaggacgacaccgccaccuacuucugcgcccgccagaaguucgcccgcggcgaccagggcugguucuucgaccucuggggccgcggcacccucaucgucgucuccucc

SEQ ID NO: 18245 - RNA, 381 nt, Artificial Sequence
  derived and/or modified sequence opt2 from anti-HIV-1_HeavyChain
caggucuacauggagcaggccggcggcggcgucaagaagcccggcgccuccgucacccucuccugcaagaccgccgacgagggcgucuucgacgccgccuacaugcacuggguccgccaggcccccggccagaccuucgaguggcucggcuggaugaagcccgucaccggcgccgucaacuacgcccgcaaguuccagggccgcgucuccuucuaccgcacccgcgagcucggcaucgccuacauggaccuccgcaaccuccgcuucgacgacaccgccgucuacuucugcgcccgcaagaccgccggcgacgucuccggcgacaagcgcggcuucuucuucgaccucuggggccgcggcucccgcgucaucgucuccucc

SEQ ID NO: 18246 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagggcuccgagcucauccacuggguccgccaggcccccggccagggccucgaguggaucggcugggucaagaccgucaccggcgccgucaacuucggcuccgccuacuuccgccaccgcgucucccucacccgcgaccgcgaccucuucaccgcccacauggacauccgcggccucacccagggcgacaccgccaccuacuucugcgcccgccagaaguacuacgccggcggccagggcugguacuucgaccucuggggccgcggcacccucaucgucgucuccucc

SEQ ID NO: 18247 - RNA, 378 nt, Artificial Sequence
  derived and/or modified sequence opt2 from anti-HIV-1_HeavyChain
caggucuacauggagcagcccggcgucgaggucaccaagcccggcgccuccgucacccucuccugcaagaccgccgaggacgucuucgacgccgccuacaugcacuggguccgccaggcccccggccagaccuucgaguggcucggcuggaucaagcccgucaccggcgccgucaacuacgcccgcaaguuccagggccgcgucuccuucuaccgcacccgcgagcucggcaucgccuacauggaccuccgcaaccuccgcuucgacgacaccgccgucuacuucugcgcccgcaagaccgccggcgacgucuccggcgacaagcgcggcuucuucuucgaccucuggggccgcggcucccgcgucaucgucuccucc

SEQ ID NO: 18248 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucgagcgcggcggccagggcuggaucuucgaccucuggggccgcggcacccucaucaucgucuccucc

SEQ ID NO: 18249 - RNA, 384 nt, Artificial Sequence
  derived and/or modified sequence opt2 from anti-HIV-1_HeavyChain
caggcccaccucguccaguccggcuccgaggucaagaagcccggcgccuucguccgcgucuccugcuggaccuccgaggacaucuucgaggagaccgagcucauccacuggguccgccaggcccccggccagggccucgaguggaucggcugggucaagaccgucaccggcgccgucaacuucggcucccucgacuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccucc

SEQ ID NO: 18250 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcaaggccuccgaggacaucuucgagcgcaccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccucc

SEQ ID NO: 18251 - RNA, 375 nt, Artificial Sequence
  derived and/or modified sequence opt2 from anti-HIV-1_HeavyChain
caggcccaccucgagcaguccggcuccgaggucaagaagcccggcgccuccguccgcgucuccugcuggaccuccgaggacaucuucgagcgcaccgagcucauccacuggguccgccaggcccccggccagggccucgaguggaucggcugggucaagaccgucuccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccucc

SEQ ID NO: 18252 - RNA, 375 nt, Artificial Sequence
  derived and/or modified sequence opt2 from anti-HIV-1_HeavyChain
caggcccaccucguccaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccucc

SEQ ID NO: 18253 - RNA, 375 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuccaccgcccacauggacauccgcggccucacccaggacgacaccgccaccuacuucugcgcccgccagaaguucgagcgcggcggccagggcugguacuucgaccucuggggccgcggcacccucaucugcgucuccucc

SEQ ID NO: 18254 - RNA, 375 nt, Artificial Sequence
  derived and/or modified sequence opt2 from anti-HIV-1_HeavyChain
caggcccaccucgagcaguccggcuccggcgucaagaagccccgcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccucc

SEQ ID NO: 18255 - RNA, 381 nt, Artificial Sequence
  derived and/or modified sequence opt2 from anti-HIV-1_HeavyChain
cagguccagcucgagcaggccggcgccggcgucaagaagcccggccccuccgucacccucuccugcaagaccgccgacgaggacgucuucgacgccgccuacaugcacuggguccgccaggcccccggccagaccuucgaguggcucggcuggaugaagcccgucaccggcgccgucuccuacgcccgcaaguuccagggccgcgucuccuucuacaugacccgcgagcucggcauggccuacauggaccuccgcaaccuccgcuucgacgacaccgccgucuacuucugcgcccgcaagaccgccggcgacgucuccggcgacaaccgcggcuacuucuucgaccucuggggccgcggcucccgcgucaucgucuccucc

SEQ ID NO: 18256 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucuccggcgccgucaacuucggcucccccaacuuccgccagcgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccucc

SEQ ID NO: 18257 - RNA, 381 nt, Artificial Sequence
  derived and/or modified sequence opt2 from anti-HIV-1_HeavyChain
caggucuucauggagcaggccggcgccggcaugaagaagcccggcgccuccaugaccgucuccugcaagaccgccgacgaggacgucuucgacgccgccuacaugcacuggguccgccaggcccccggccagaccuucgaguggcucggcuggaugaagcccgucaccggcgccgucaacuacgcccgcaaguuccagggccgcgucuccuucuaccgcacccgcgagcucggcaucgccuacauggaccuccgcaaccuccgcuucgacgacaccgccgucuacuucugcgcccgcaagaccgccggcgacgucuccggcgacaagcgcggcuucuucuucgaccucuggggccgcggcucccgcgucaucgucuccucc

SEQ ID NO: 18258 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgccuccugcuggaccuccgaggacaucuucgagcgcaccgagcucauccacuggguccgccaggcccccggccagggccucgaguggaucggcugggucaagaucgucuccggcgccgucaacuucggcucccccaacuuccgccagcgcgucucccucacccgcgaccgcgaccucuucaccgcccacauggacauccgcggccucacccagggcgacaccgccaccuacuucugcgcccgccagaaguucgagcgcggcggccagggcuggaucuucgaccucuggggccgcggcacccucaucgccgucuccucc

SEQ ID NO: 18259 - RNA, 381 nt, Artificial Sequence
  derived and/or modified sequence opt2 from anti-HIV-1_HeavyChain
caggucuacauggagcaggccggcggcggcaugaagaagcccggcgccuccaugaccgucuccugcaagaccgccgacgaggacaucuucgacgccgccuacaugcacuggguccgccaggcccgcggccagaccuucgaguggcucggcuggaugaagcccgucaccggcgccgucaacuacgcccgccaguuccagggccgcgucuccuucuaccgcacccgcgagcucggcaucgccuacauggaccuccgcgaccucaaguucgacgacaccgccgucuacuucugcgcccgcaagaccaagggcgacgucuccggcgacgaccgcggcuucuucuucgaccucuggggccgcggcacccgcgucaucgucuccucc

SEQ ID NO: 18260 - RNA, 384 nt, Artificial Sequence
  derived and/or modified sequence opt2 from anti-HIV-1_HeavyChain
caggcccaccucgagcaguccggcgccggcgucaaggagcccggcgccuccguccgcgucuccugcugguccuccgaggacaucuucgagcgcaccgagcucauccacuggguccgccaggcccccggccagggccucgaguggaucggcugggucaagaccgucaccggcgccgucaacuucggcucccucgacuuccgccaccgcaucucccucacccgcgaccgcgaccuccucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccucc

SEQ ID NO: 18261 - RNA, 384 nt, Artificial Sequence
  derived and/or modified sequence opt2 from anti-HIV-1_HeavyChain
cagguccagcucguccaguccggcuccgccaugaagaagcccggcgccuccguccgcgucuccugcuggaccuccgaggacaucuucgagcgcaccgagcucaucuacuggguccgccaggcccccggccgcggccucgaguggaucggcugggucaagaccgucuccggcaccgucaacuucggcuccuccgacuuccgcaaccgcaucucccucacccgcgaccgcgaccucuccaccgcccacauggacauccgcggccucacccaggacgacaccgccaccuacuucugcgcccgccagaaguucgagucccucuacuccgacgaccagggcuccuacuucgaccucuggggccgcggcacccucaucaucgucuccucc

SEQ ID NO: 18262 - RNA, 384 nt, Artificial Sequence
  derived and/or modified sequence opt2 from anti-HIV-1_HeavyChain
caggcccaccucguccaguccgccuccggcgucaagcgccccggcgccuccguccgcgucuccugcuggaccuccgaggacaucuucgagcgcaccgagcucaucuacuggguccgccaggcccccggccagggccucgaguggaucggcugggucaagaccgucuccggcgccgucaacuucggcucccaggacuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccucc

SEQ ID NO: 18263 - RNA, 381 nt, Artificial Sequence
  derived and/or modified sequence opt2 from anti-HIV-1_HeavyChain
caggucuacauggagcaggccggcggcggcgucaagaagcccggcgccuccgucacccucuccugcaagaccgccgacgaggacgucuucgacgccgccuacaugcacuggguccgccaggcccccggccagaccuucgaguggcucggcuggaugaagcccgucaccggcgccgucuccuacgcccgcaaguuccagggccgcgucuccuucuacaugacccgcgagcucggcauggccuacauggaccuccgcaaccuccgcuucgacgacaccgccgucuacuucugcgcccgcaagaccgccggcgacgucuccggcgacaagcgcggcuucuucuucgaccucuggggccgcggcucccgcgucaucgucuccucc

SEQ ID NO: 18264 - RNA, 372 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagggcuacaugauccacuggguccgccaggcccccggccagggccucgaguggaucggcugggucaagaccgucaccggcgccgucaacuucggcuccgccuacuuccgccaccgcgucucccucacccgcgaccgcgaccucuucaccgcccacauggacauccgcggccucacccagggcgacaccgccaccuacuucugcgcccgccagaaguucuacaagggcggccagggcugguacuucgaccucuggggccgcggcacccucaucgucgucuccucc

SEQ ID NO: 18265 - RNA, 375 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgagcgcaccgagcucauccacuggguccgccaggcccccggccgcggccucgaguggaucggcugggucaaggccgucuccggcgccgucaacuacggcucccucgacuuccgccaccgcgucucccucacccgcgaccgcgaccucuucaccgcccacauggacauccgcggccucacccaggacgacaccgccaccuacuucugcgcccgccagaaguucgcccgcggcgaccagggcugguucuucgaccucuggggccgcggcacccucaucugcgucuccucc

SEQ ID NO: 18266 - RNA, 375 nt, Artificial Sequence
  derived and/or modified sequence opt2 from anti-HIV-1_HeavyChain
caggcccaccucguccaguccggcuccggcgucaagaaguccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccucc

SEQ ID NO: 18267 - RNA, 378 nt, Artificial Sequence
  derived and/or modified sequence opt2 from anti-HIV-1_HeavyChain
caggucuacauggagcgcgccggcgccggcgucaagaagcccggcgccuccgucacccucuccugcaagaccgccgacgaggacgucuucggcgccuacaugcacuggguccgccaggcccccggccagaccuucgaguggcucggcuggaugaagcccgucaccggcgccgucuccuacgcccgcaaguuccagggccgcgucuccuucuacaugacccgcgagcucggcauggccuacauggaccuccgcaaccuccgcuucgacgacaccgccgucuacuucugcgcccgcaagaccgccggcgacgucuccggcgacaaccgcggcuacuucuucgaccucuggggccgcggcucccgcgucaucgucuccucc

SEQ ID NO: 18268 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagggcuccgagcucauccacuggguccgccaggcccccggccagggccucgaguggaucggcugggucaagaccgucaccggcgccgucaacuucggcuccgccuacuuccgccaccgcgucucccucacccgcgaccgcgaccucuucaccgcccacauggacauccgcggccucacccagggcgacaccgccaccuacuucugcgcccgccagaaguucuacaagggcggccagggcugguacuucgaccucuggggccgcggcacccucaucgucgucuccucc

SEQ ID NO: 18269 - RNA, 375 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgagcgcaccgagcucaucuacuggguccgccaggcccccggccgcggccucgaguggaucggcugggucaagaccgucuccggcaccgucaacuucggcuccuccgacuuccgcaaccgcgucucccucacccgcgaccgcgaccucuucaccgcccacauggacauccgcggccucacccaggacgacaccgccaccuacuucugcgcccgccagaaguucgcccgcggcgaccagggcugguucuucgaccucuggggccgcggcacccucaucgucgucuccucc

SEQ ID NO: 18270 - RNA, 384 nt, Artificial Sequence
  derived and/or modified sequence opt2 from anti-HIV-1_HeavyChain
caggcccaccucguccaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucgccggcgccgucaacuucuccucccucgacuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccucc

SEQ ID NO: 18271 - RNA, 384 nt, Artificial Sequence
  derived and/or modified sequence opt2 from anti-HIV-1_HeavyChain
caggcccaccucgagcaguccggcuccggcgucaagaaguccggcgccuccgcccgcgucuccugcugguccuccgaggacaucuucgagcgcaccgagcucauccacuggguccgccaggcccccggccagggccucgaguggaucggcugggucaagaccgucaccggcgccgucaacuucggcucccucgacuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccucc

SEQ ID NO: 18272 - RNA, 369 nt, Artificial Sequence
  derived and/or modified sequence opt2 from anti-HIV-1_HeavyChain
cuccuccagcucguccaguccggcgccgaggucaagaagcccggcgccuccgucaaggucaccugcaaggccuccggcuacaccuucaccggcuacauccacuggguccgccaggcccccggccagggccucgaguggaucggcugggucaaggccgucuccggcgccgucaacuacggcucccucgacuuccgccaccgcgucucccucacccacgaccgcgaccucuccaccgcccacauggacauccgcggccucacccaggacgacaccgccaccuacuucugcgcccgccagaaguucgcccgcggcgaccagggcugguucuucgaccucuggggccgcggcacccucaucgucgucuccucc

SEQ ID NO: 18273 - RNA, 369 nt, Artificial Sequence
  derived and/or modified sequence opt2 from anti-HIV-1_HeavyChain
cagguccagcucguccaguccggcgccgaggucaagaagcccggcgccuccgucaaggucuccugcaaggccuccggcugcaccuucaccggcuacuacaugcacuggguccgccaggcccccggccagggccucgaguggaugggcuggaucaaccccaacuccggcggcaccaacuacgcccagaaguuccagggccgcgucaccaugacccgcgacaccuccaucuccaccgccuacauggagcucucccgccuccgcuccgacgacaccgccgucuacuacugcgcccgccagaaguucgcccgcggcgaccagggcugguucuucgaccucuggggccgcggcacccucaucgucgucuccucc

SEQ ID NO: 18274 - RNA, 369 nt, Artificial Sequence
  derived and/or modified sequence opt2 from anti-HIV-1_HeavyChain
cagguccagcucguccaguccggcaccgagcuccgcaagcccggcgccuccgucaaggucuccugcaaggccuccggcuacaccuucuccggcuccuacauccacuggguccgccaggcccccggccagggccucgagugggucggcuggaucaaccccuccuccggcgccacccagugcgccaagaaguuccaggacaaggucaccaugacccgcgacaccaccaacaacaccgucuacauggaggucaaccgccucaucuccgacgacaccgccaccuacuucugcgcccgccagaaguucgcccgcggcgaccagggcugguucuucgaccucuggggccgcggcacccucaucgucgucuccucc

SEQ ID NO: 18275 - RNA, 372 nt, Artificial Sequence
  derived and/or modified sequence opt2 from anti-HIV-1_HeavyChain
cagguccuccucguccaguccggcgccgaggucaagaagcccggcuccuccgucaaggucuccugcaagaccuccggcgacucccucaccaaguacgcccuccacugggcccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccucc

SEQ ID NO: 18276 - RNA, 372 nt, Artificial Sequence
  derived and/or modified sequence opt2 from anti-HIV-1_HeavyChain
cagguccagcucguccaguccggcaccgaggucaagacccccggcgccuccgucaaggucuccugcaaggccuccggcuacaccuucaccaacuacgacaucaacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccucc

SEQ ID NO: 18277 - RNA, 372 nt, Artificial Sequence
  derived and/or modified sequence opt2 from anti-HIV-1_HeavyChain
cagguccagcucguccaguccggcgacgaggucaagaagcccggcgccuccgucaaggucuccugcaaggccuccggcaagggcuuccccaccucccucgucaccuggguccgccaggcccccggccagggccucgaguggaucggcugggucaaggccgucuccggcgccgucaacuacggcucccucgacuuccgccaccgcgucucccucacccgcgaccgcgaccucuucaccgcccacauggacauccgcggccucacccaggacgacaccgccaccuacuucugcgcccgccagaaguucgcccgcggcgaccagggcugguucuucgaccucuggggccgcggcacccucaucgucgucuccucc

SEQ ID NO: 18278 - RNA, 372 nt, Artificial Sequence
  derived and/or modified sequence opt2 from anti-HIV-1_HeavyChain
cagguccagcucguccaguccggcgccgaggucaagaagcccggcuccuccgucaaggucuccugcaagaccuccggcgacauccucaccaacuacggccucaacuggguccgccaggcccccggccagggccucgaguggaucggcugggucaaggccgucuccggcgccgucaacuacggcucccucgacuuccgccaccgcgucucccucacccgcgaccgcgaccucuccaccgcccacauggacauccgcggccucacccaggacgacaccgccaccuacuucugcgcccgccagaaguucgcccgcggcgaccagggcugguucuucgaccucuggggccgcggcacccucaucgucgucuccucc

SEQ ID NO: 18279 - RNA, 372 nt, Artificial Sequence
  derived and/or modified sequence opt2 from anti-HIV-1_HeavyChain
cagguccagcucguccaguccggcgccgaggucaagaagcccggcgccuccguccgcgucuccugcaagaccuccggcuaccccuucucccgcuacggcaucuccuggguccgccaggcccccggccagggccucgucuggauggccugggucaaggccgucuccggcgccgucaacuacggcucccucgacuuccgccaccgcgucucccucacccgcgaccgcgaccucuccaccgcccacauggacauccgcggccucacccaggacgacaccgccaccuacuucugcgcccgccagaaguucgcccgcggcgaccagggcugguucuucgaccucuggggccgcggcacccucaucgucgucuccucc

SEQ ID NO: 18280 - RNA, 372 nt, Artificial Sequence
  derived and/or modified sequence opt2 from anti-HIV-1_HeavyChain
cgcgagcagcucguccaguccggcgccgaggucaagaagcccggcgccuccgucaaggucuccugcaagaccuccggcaacaccuucggcuccuacgacuucaacuggguccgccaggcccccggccagggccucgaguggaucggcugggucaagaucgucuccggcgccgucaacuucggcucccccaacuuccgccagcgcgucucccucacccgcgaccgcgaccucuucaccgcccacauggacauccgcggccucacccagggcgacaccgccaccuacuucugcgcccgccagaaguucgagcgcggcggccagggcuggaucuucgaccucuggggccgcggcacccucaucgccgucuccucc

SEQ ID NO: 18281 - RNA, 372 nt, Artificial Sequence
  derived and/or modified sequence opt2 from anti-HIV-1_HeavyChain
cagguccagcucguccaguccggcgccgaggucaagaagcccggcgccuccgucaaggucuccugcaaggccuccggcuacaccuucaccuccuacuacaugcacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguacuacgccggcggccagggcugguacuucgaccucuggggccgcggcacccucaucgucgucuccucc

SEQ ID NO: 18282 - RNA, 372 nt, Artificial Sequence
  derived and/or modified sequence opt2 from anti-HIV-1_HeavyChain
cagguccagcucguccaguccggcgccgaggucaagaagcccggcgccuccgucaaggucuccugcaaggccuccggcuacaccuucaccuccuacuacaugcacuggguccgccaggcccccggccagggccucgaguggaucggcugggucaagaccgucaccggcaccgucaacuucggcucccucaacuuccgccagcgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccucc

SEQ ID NO: 18283 - RNA, 372 nt, Artificial Sequence
  derived and/or modified sequence opt2 from anti-HIV-1_HeavyChain
cagguccagcucggccaguccggcgccgagaugaagaagcccggcuccuccgucaaggucuccugcaaggccuccggcggcaccuuccgccacucccccaucuccuggguccgccaggcccccggccagggccucgaguggaucggcugggucaaggccgucuccggcgccgucaacuacggcucccucgacuuccgccaccgcgucucccucacccgcgaccgcgaccucuccaccgcccacauggacauccgcggccucacccaggacgacaccgccaccuacuucugcgcccgccagaaguucgcccgcggcgaccagggcugguucuucgaccucuggggccgcggcacccucaucgucgucuccucc

SEQ ID NO: 18284 - RNA, 369 nt, Artificial Sequence
  derived and/or modified sequence opt2 from anti-HIV-1_HeavyChain
cagguccagcucguccaguccggcgccgagguccgcacccccggcgccuccgucaaggucuccugcaaggccuccggcuacaacuucaucgccuaccacguccacuggguccgccaggcccccggccagggccucaccuggaugggcuggaucaaccccgacuccggcgacaccgucuacgcccagaacuucgucgaccgcgucaugaugacccgcaacaccuccauccagaccgucuaccucgagcucaacguccucacccucgaggacaccgccaccuacuucugcgcccgccagaaguucgcccgcggcgaccagggcugguucuucgaccucuggggccgcggcacccucaucgucgucuccucc

SEQ ID NO: 18285 - RNA, 372 nt, Artificial Sequence
  derived and/or modified sequence opt2 from anti-HIV-1_HeavyChain
cagguccagcucguccaguccggcgccgaggucaagaagcccggcgccuccgucaaggucuccugcaaggccuccggcuacaccuucaccgucuacuacaugcacuggguccgccaggcccccggccgcggccucgaguggaucggcugggucaaggccgucuccggcgccgucaacuacggcucccucgacuuccgccaccgcgucucccucacccgcgaccgcgaccucuucaccgcccacauggacauccgcggccucacccaggacgacaccgccaccuacuucugcgcccgccagaaguucgcccgcggcgaccagggcugguucuucgaccucuggggccgcggcacccucaucgucgucuccucc

SEQ ID NO: 18286 - RNA, 375 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccucc

SEQ ID NO: 18287 - RNA, 372 nt, Artificial Sequence
  derived and/or modified sequence opt2 from anti-HIV-1_HeavyChain
cagguccagcucguccaguccggcgccgaggucaagaagcccggcgccuccgucaaggucuccugcaaggccuccggcuacaccuucaucggcuacuacaugcacuggguccgccaggcccccggccagggccucgaguggaugggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccucc

SEQ ID NO: 18288 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucuccggcgccgucaacuucggcucccucaacuuccgccaccgcgucucccucacccgcgaccgcgaccucuucaccgcccacauggacauccgcggccucacccagggcgacaccgccaccuacuucugcgcccgccagaaguucgcccgcggcgaccagggcugguucuucgaccucuggggccgcggcacccucaucgucgucuccucc

SEQ ID NO: 18289 - RNA, 372 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucaaggaccgcaucgaccacuggguccgccaggcccccggccagggccucgaguggaucggcugggucaaggccgucuccggcgccgucaacuacggcucccucgacuuccgccaccgcgucucccucacccgcgaccgcgaccucuucaccgcccacauggacauccgcggccucacccaggacgacaccgccaccuacuucugcgcccgccagaaguucgcccgcggcgaccagggcugguucuucgaccucuggggccgcggcacccucaucgucgucuccucc

SEQ ID NO: 18290 - RNA, 375 nt, Artificial Sequence
  derived and/or modified sequence opt2 from anti-HIV-1_HeavyChain
cagguccagcucgcccaguccggcgccgaggucaagaagcucggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuucaccgcccacauggacauccgcggccucacccaggacgacaccgccaucuacuucugcgcccgccagaaguucgcccgcggcgaccagggcugguucuucgaccucuggggccgcggcacccucaucgucgucuccucc

SEQ ID NO: 18291 - RNA, 372 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuccaaggccgagcucauccacuggguccgccaggcccccggccagggccucgaguggaucggcugggucaagaccgucuccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccucc

SEQ ID NO: 18292 - RNA, 372 nt, Artificial Sequence
  derived and/or modified sequence opt2 from anti-HIV-1_HeavyChain
accgcccaccucgagcaguccggcuccggcguccgccgccccggcgccuccguccgcgucuccugcuggaccuccggcgacaucuucaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccucc

SEQ ID NO: 18293 - RNA, 372 nt, Artificial Sequence
  derived and/or modified sequence opt2 from anti-HIV-1_HeavyChain
caggcccaccucgagcaguccggcuccggcgucaagcgccccggcgccuccguccgcgucuccugcuggaccuccgaggacaucuucaacaccgagcucauccacuggguccgccaggcccccggccagggccucgaguggaucggcugggucaagaccgucuccggcgccgucaacuucggcucccucaacuuccgccaccgcgucucccucacccgcgaccgcgaccucuucaccgcccacauggacauccgcggccucacccagggcgacaccgccaccuacuucugcgcccgccagaaguucgcccgcggcgaccagggcugguucuucgaccucuggggccgcggcacccucaucgucgucuccucc

SEQ ID NO: 18294 - RNA, 372 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucaagaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuccaccgcccacauggacauccgcggccucacccaggacgacaccgccaccuacuucugcgcccgccagaaguucgcccgcggcgaccagggcugguucuucgaccucuggggccgcggcacccucaucgucgucuccucc

SEQ ID NO: 18295 - RNA, 372 nt, Artificial Sequence
  derived and/or modified sequence opt2 from anti-HIV-1_HeavyChain
cagguccagcucguccaguccggcgccgaggucaagaagcccggcgccuccguccgcgucuccugcaaggccuccggcuacaccuucaccgccuacuacauccacuggguccgccaggcccccggccagggccucgaguggaucggcugggucaagaccgucuccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccucc

SEQ ID NO: 18296 - RNA, 372 nt, Artificial Sequence
  derived and/or modified sequence opt2 from anti-HIV-1_HeavyChain
caggcccaccucgagcaguccggcuccgaguccaagaagcccggcgccuccguccgcgucuccugcugguccuccgaggacaucuucaagaccgagcucauccacuggguccgccaggcccccggccagggccucgaguggaucggcugggucaagaucgucuccggcgccgucaacuucggcucccccaacuuccgccagcgcgucucccucacccgcgaccgcgaccucuucaccgcccacauggacauccgcggccucacccagggcgacaccgccaccuacuucugcgcccgccagaaguucgagcgcggcggccagggcuggaucuucgaccucuggggccgcggcacccucaucgccgucuccucc

SEQ ID NO: 18297 - RNA, 375 nt, Artificial Sequence
  derived and/or modified sequence opt2 from anti-HIV-1_HeavyChain
caggcccaccucgagcaguccggcuccgaggucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccucc

SEQ ID NO: 18298 - RNA, 372 nt, Artificial Sequence
  derived and/or modified sequence opt2 from anti-HIV-1_HeavyChain
caggcccaccucgagcaggucugggccggcgucaagaagcucggcgccuccguccgcgucuccugcuggaccuccgaggacaucuucaagaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuccaccgcccacauggacauccgcggccucacccaggacgacaccgccaccuacuucugcgcccgccagaaguucgcccgcggcgaccagggcugguucuucgaccucuggggccgcggcacccucaucgucgucuccucc

SEQ ID NO: 18299 - RNA, 372 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcuccgagcucauccacuggguccgccaggcccccggccagggccucgaguggaucggcugggucaagaccgucaccggcgccgucaacuucggcuccaacuuccgccagcgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccucc

SEQ ID NO: 18300 - RNA, 375 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgccucccucgacuuccgccaccgcgucucccucacccgcgaccgcgaccucuccaccgcccacauggacauccgcggccucacccaggacgacaccgccaccuacuucugcgcccgccagaaguucgcccgcggcgaccagggcugguucuucgaccucuggggccgcggcacccucaucgucgucuccucc

SEQ ID NO: 18301 - RNA, 375 nt, Artificial Sequence
  derived and/or modified sequence opt2 from anti-HIV-1_HeavyChain
caggcccaccucgagcaguccggcuccggcgucaagaagcccggcaccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgcccgcggcgaccagggcugguucuucgaccucuggggccgcggcacccucaucgucgucuccucc

SEQ ID NO: 18302 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccggcggcaucuucgagcgcaccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccucc

SEQ ID NO: 18303 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcugguccuccgaggacaucuucgagcgcaccgagcucauccacuggguccgccaggcccccggccagggccucgaguggaucggcugggucaagaccgucaccggcgccgucaacuucggcucccucgacuuccgccaccgcaucucccucacccgcgaccgcgaccucuucaccgcccacauggacauccgcggccucacccaggacgacaccgccaccuacuucugcgcccgccagaaguucgcccgcggcgaccagggcugguucuucgaccucuggggccgcggcacccucaucgucgucuccucc

SEQ ID NO: 18304 - RNA, 372 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucgagcgcggcggccagggcuggaucuucgaccucuggggccgcggcacccucaucgccgucuccucc

SEQ ID NO: 18305 - RNA, 375 nt, Artificial Sequence
  derived and/or modified sequence opt2 from anti-HIV-1_HeavyChain
caggcccaccucgagcaguccggcuccggcgucaagcgccccggcgccuccguccgcgucuccugcuggaccuccgaggacaucuucgagaccaccgagcucauccacuggguccgccaggcccccggccagggccucgaguggaucggcugggucaagaccgucuccggcgccgucaacuucggcucccucaacuuccgccaccgcgucucccucacccgcgaccgcgaccucuucaccgcccacauggacauccgcggccucacccagggcgacaccgccaccuacuucugcgcccgccagaaguucgcccgcggcgaccagggcugguucuucgaccucuggggccgcggcacccucaucgucgucuccucc

SEQ ID NO: 18306 - RNA, 375 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccagcgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccucc

SEQ ID NO: 18307 - RNA, 372 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaaccucguccaccagaucuccgaccgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccucc

SEQ ID NO: 18308 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcuccuccgacuuccgccagcgcgucucccucacccgcggccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccucc

SEQ ID NO: 18309 - RNA, 375 nt, Artificial Sequence
  derived and/or modified sequence opt2 from anti-HIV-1_HeavyChain
caggcccaccucgagcaguccggcgccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccucc

SEQ ID NO: 18310 - RNA, 375 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgacaccaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuccaccgcccacauggacauccgcggccucacccaggacgacaccgccaccuacuucugcgcccgccagaaguucgcccgcggcgaccagggcugguucuucgaccucuggggccgcggcacccucaucgucgucuccucc

SEQ ID NO: 18311 - RNA, 372 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucaagaccgagcucauccacuggguccgccaggcccccggccagggccucgaguggaucggcugggucaagaccgucuccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccucc

SEQ ID NO: 18312 - RNA, 375 nt, Artificial Sequence
  derived and/or modified sequence opt2 from anti-HIV-1_HeavyChain
cagguccaccucgagcaguccggcuccggcgucaagaagcucggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuucaccgcccacauggacauccgcggccucacccaggacgacaccgccaccuacuucugcgcccgccagaaguucgcccgcggcgaccagggcugguucuucgaccucuggggccgcggcacccucaucgucgucuccucc

SEQ ID NO: 18313 - RNA, 372 nt, Artificial Sequence
  derived and/or modified sequence opt2 from anti-HIV-1_HeavyChain
caggcccaccucgagcaguccgccuccggcgucaagcgccccggcgccuccguccgcgucuccugcuggaccuccgaggacaucuucgagcgcuccgagcucaucuacuggguccgccaggcccccggccagggccucgaguggaucggcugggucaagaccgucuccggcgccgucaaccucgcccccaacuuccgccagcgcgucucccucacccgcgaccgcgaccucuucaccgcccacauggacauccgcggccucacccagggcgacaccgccaccuacuucugcgcccgccagaaguucgagcgcggcggccagggcuggaucuucgaccucuggggccgcggcacccucaucgccgucuccucc

SEQ ID NO: 18314 - RNA, 372 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucaaguccgagcucauccacuggguccgccaggcccccggccagggccucgaguggaucggcugggucaagaccgucaccggcgccgucaacuucggcuccuccgacuuccgccagcgcgucucccucacccgcgacggcgaccucuucaccgcccacauggacauccgcggccucacccagggcgacaccgccaccuacuucugcgcccgccagaaguucuacgccggcggccagggcugguacuucgaccucuggggccgcggcacccucaucaucgucuccucc

SEQ ID NO: 18315 - RNA, 375 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucaccuccgaccgcgaccucuccaccgcccacauggacauccgcggccucacccaggacgacaccgccaccuacuucugcgcccgccagaaguucgcccgcggcgaccagggcugguucuucgaccucuggggccgcggcacccucaucgucgucuccucc

SEQ ID NO: 18316 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuccaccgcccacauggacauccgcggccucacccaggacgacaccgccaccuacuucugcgcccgccagaaguucgcccgcggcgaccagggcugguucuucgaccucuggggccgcggcacccucaucgucgucuccucc

SEQ ID NO: 18317 - RNA, 372 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccucc

SEQ ID NO: 18318 - RNA, 372 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggccaccagaucuccgaccgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccucc

SEQ ID NO: 18319 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccaggacgacaccgccaccuacuucugcgcccgccagaaguucgcccgcggcgaccagggcugguucuucgaccucuggggccgcggcacccucaucgucgucuccucc

SEQ ID NO: 18320 - RNA, 372 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacauccucaagaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuucaccgcccacauggacauccgcggccucacccaggacgacaccgccaccuacuucugcgcccgccagaaguucgcccgcggcgaccagggcugguucuucgaccucuggggccgcggcacccucaucgucgucuccucc

SEQ ID NO: 18321 - RNA, 372 nt, Artificial Sequence
  derived and/or modified sequence opt2 from anti-HIV-1_HeavyChain
guccgcuccgucguccagugcgaggccggcgucaagaagcccggcgccuccgucaagaucuccugcgccaccuccggcuacgccuucacccucuacuaccuccacuggguccgccaggcccccggccagggccucgaguggaucggcugggucaagaccgucaccggcgccgucaacuucggcuccgccuacuuccgccaccgcgucucccucacccccgaccgcgaccucuucaccgcccacauggacauccgcggccucacccagggcgacaccgccaccuacuucugcgcccgccagaaguucuacaagggcggccagggcugguacuucgaccucuggggccgcggcacccucaucgucgucuccucc

SEQ ID NO: 18322 - RNA, 375 nt, Artificial Sequence
  derived and/or modified sequence opt2 from anti-HIV-1_HeavyChain
caggcccaccucgagcaguccggcuccggcgucaagaagcucggcgccuccguccgcgucuccugccucgacuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuucaccgcccacauggacauccgcggccucacccaggacgacaccgccaccuacuucugcgcccgccagaaguucgcccgcggcgaccagggcugguucuucgaccucuggggccgcggcacccucaucgucgucuccucc

SEQ ID NO: 18323 - RNA, 375 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgccucccucgacuuccgcaaccgcaucucccucucccgcgaccgcgaccucuccaccgcccacauggacauccgcggccucacccaggacgacaccgccaccuacuucugcgcccgccagaaguucgcccgcggcgaccagggcugguucuucgaccucuggggccgcggcacccucaucgucgucuccucc

SEQ ID NO: 18324 - RNA, 375 nt, Artificial Sequence
  derived and/or modified sequence opt2 from anti-HIV-1_HeavyChain
caggcccaccucgagcaguccggcuccggcgucaagaagcucggcgccuccgucaaguccuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuccaccgcccacauggacauccgcggccucacccaggacgacaccgccaccuacuucugcgcccgccagaaguucgcccgcggcgaccagggcugguucuucgaccucuggggccgcggcacccucaucgucgucuccucc

SEQ ID NO: 18325 - RNA, 375 nt, Artificial Sequence
  derived and/or modified sequence opt2 from anti-HIV-1_HeavyChain
caggcccaccucgagcaguccggcgccggcgucaagaagcccggcgccuccguccgcgucuccugcuggaccuccgaggacaucuucgagcgcaccgagcucauccacuggguccgccaggcccccggccagggccucgaguggaucggcugggucaagaucgucuccggcgccgucaacuucggcucccccaacuuccgccagcgcgucucccucacccgcgaccgcgaccucuucaccgcccacauggacauccgcggccucacccagggcgacaccgccaccuacuucugcgcccgccagaaguucgagcgcggcggccagggcuggaucuucgaccucuggggccgcggcacccucaucgccgucuccucc

SEQ ID NO: 18326 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcuggaugaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccucc

SEQ ID NO: 18327 - RNA, 375 nt, Artificial Sequence
  derived and/or modified sequence opt2 from anti-HIV-1_HeavyChain
caggcccaccucgagcaguccggcuccgaggucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccucc

SEQ ID NO: 18328 - RNA, 375 nt, Artificial Sequence
  derived and/or modified sequence opt2 from anti-HIV-1_HeavyChain
caggcccaccucgagcaguccggcgccggcgucaagaagcucggcgccuccguccgcgucuccugcuggaccuccggcgacaucuucgagcgcaccgagcucauccacuggguccgccaggcccccggccagggccucgaguggaucggcugggucaaggccgucuccggcgccgucaacuacggcucccucgacuuccgccagcgcgucucccucacccgcgaccgcgaccucuucaccgcccacaucgacauccgcggccucacccagggcgacaccgccaccuacuucugcgcccgccagaaguucgagcgcggcggccagggcuggaucuucgaccucuggggccgcggcacccucaucgccgucuccucc

SEQ ID NO: 18329 - RNA, 375 nt, Artificial Sequence
  derived and/or modified sequence opt2 from anti-HIV-1_HeavyChain
caggcccaccucgagcaguccggcuccggcgucaagaagcucggcgccuccguccgcgucuccugcugggccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuccaccgcccacauggacauccgcggccucacccaggacgacaccgccaccuacuucugcgcccgccagaaguucgcccgcggcgaccagggcugguucuucgaccucuggggccgcggcacccucaucgucgucuccucc

SEQ ID NO: 18330 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcaccgucaacuucggcucccagaacuuccgccagcgcgucucccucacccgcgaccgcgaccucuucaccgcccacauggacauccgcggccucacccagggcgacaccgccaccuacuucugcgcccgccagaaguucgagcgcggcggccagggcuggaucuucgaccucuggggccgcggcacccucaucgccgucuccucc

SEQ ID NO: 18331 - RNA, 375 nt, Artificial Sequence
  derived and/or modified sequence opt2 from anti-HIV-1_HeavyChain
caggcccaccucgagcaguccggcuccggcgucaagcgccccggcgccuccguccgcgucuccugcuggaccuccgaggacaucuucgagaccaccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccucc

SEQ ID NO: 18332 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacauccuccgcaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccucc

SEQ ID NO: 18333 - RNA, 372 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucaagaccgagcucauccacuggguccgccaggcccccggccagggccucgaguggaucggcugggucaagaccgucaccggcaccgucaacuucggcucccucaacuuccgccagcgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccucc

SEQ ID NO: 18334 - RNA, 375 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuucaccgcccacauggacauccgcggccucacccaggacgacaccgccaccuacuucugcgcccgccagaaguucgcccgcggcgaccagggcugguucuucgaccucuggggccgcggcacccucaucgucgucuccucc

SEQ ID NO: 18335 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccucc

SEQ ID NO: 18336 - RNA, 375 nt, Artificial Sequence
  derived and/or modified sequence opt2 from anti-HIV-1_HeavyChain
cagguccagcucguccaguccggcgccgaggucaagaagcccggcgccuccguccgcgucuccugcuggaccuccgaggacaucuucgagcgcuccgagcucaucuacuggguccgccaggcccccggccgcggccucgaguggaucggcuggaucaagcucgucuccggcgccgucaacuucggcuccgucgacuuccgcgaccgcgucucccucacccgcgaccgcgaccucuucaccgcccacauggacauccgcggccucacccaggacgacaccgccaccuacuucugcgcccgccagaaguucgcccgcggcgaccagggcugguucuucgaccucuggggccgcggcacccucaucgucgucuccucc

SEQ ID NO: 18337 - RNA, 375 nt, Artificial Sequence
  derived and/or modified sequence opt2 from anti-HIV-1_HeavyChain
caggcccaccucgagcagucccgcuccggcgucaagaagcccggcgccuccguccgcgucuccugcuggaccuccgaggacaucuucgagcgcaccgagcucauccacuggguccgccaggcccccggccagggccucgaguggaucggcugggucaaggccgucuccggcgccgucaacuucggcucccccaacuuccgccaccgcgucucccucacccgcgaccgcgaccucuccaccgcccacauggacauccgcggccucacccaggacgacaccgccaccuacuucugcgcccgccagaaguucgcccgcggcgaccagggcugguucuucgaccucuggggccgcggcacccucaucgucgucuccucc

SEQ ID NO: 18338 - RNA, 375 nt, Artificial Sequence
  derived and/or modified sequence opt2 from anti-HIV-1_HeavyChain
caguccuaccucgagcaguccggcuccgccaugaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgccucccucgacuuccgcaaccgcaucucccucucccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccucc

SEQ ID NO: 18339 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaagaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuucaccgcccacauggacauccgcggccucacccaggacgacaccgccaccuacuucugcgcccgccagaaguucgcccgcggcgaccagggcugguucuucgaccucuggggccgcggcacccucaucgucgucuccucc

SEQ ID NO: 18340 - RNA, 372 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccucc

SEQ ID NO: 18341 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucuccggcgccgucaacuucggcucccccaacuuccgccaccgcgucucccucacccgcgaccgcgaccucuucaccgcccacauggacauccgcggccucacccaggacgacaccgccaccuacuucugcgcccgccagaaguucgcccgcggcgaccagggcugguucuucgaccucuggggccgcggcacccucaucgucgucuccucc

SEQ ID NO: 18342 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaucgucuccggcgccgucaacuucggcucccccaacuuccgccagcgcgucucccucacccgcgaccgcgaccucuucaccgcccacauggacauccgcggccucacccagggcgacaccgccaccuacuucugcgcccgccagaaguucgcccgcggcgaccagggcugguucuucgaccucuggggccgcggcacccucaucgucgucuccucc

SEQ ID NO: 18343 - RNA, 375 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccucc

SEQ ID NO: 18344 - RNA, 375 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgccucccucgacuuccgcaaccgcaucucccucucccgcgaccgcgaccucuccaccgcccacauggacauccgcggccucacccagggcgacaccgccaccuacuucugcgcccgccagaaguucgagcgcggcggccagggcugguacuucgaccucuggggccgcggcacccucaucgucgucuccucc

SEQ ID NO: 18345 - RNA, 375 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgccucccucgacuuccgccagcgcgucucccucacccgcgaccgcgaccucuucaccgcccacauggacauccgcggccucacccagggcgacaccgccaccuacuucugcgcccgccagaaguucgagcgcggcggccagggcuggaucuucgaccucuggggccgcggcacccucaucgccgucuccucc

SEQ ID NO: 18346 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcaccgucaacuucggcucccucaacuuccgccagcgcgucucccucacccgcgaccgcgaccucuucaccgcccacauggacauccgcggccucacccagggcgacaccgccaccuacuucugcgcccgccagaaguucgagcgcggcggccagggcuggaucuucgaccucuggggccgcggcacccucaucgccgucuccucc

SEQ ID NO: 18347 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccucc

SEQ ID NO: 18348 - RNA, 375 nt, Artificial Sequence
  derived and/or modified sequence opt2 from anti-HIV-1_HeavyChain
cgccacaccgucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucuccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccucc

SEQ ID NO: 18349 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccucc

SEQ ID NO: 18350 - RNA, 375 nt, Artificial Sequence
  derived and/or modified sequence opt2 from anti-HIV-1_HeavyChain
cgccacaccugggagcaguccggcuccggcgucaagaagcucggcgccuccguccgcgucuccugcuggaccuccgaggacaucuucgagcgcaccgagcucauccacuggguccgccaggcccccggccagggccucgaguggaucggcuggaugaaggccgucuccggcgccgucaacuacggcucccucgacuuccgccaccgcgucucccucacccgcgaccgcgaccucuccaccgcccacaucgacauccgcggccucacccaggacgacaccgccaccuacuucugcgcccgccagaaguucgcccgcggcgaccagggcugguucuucgaccucuggggccgcggcacccucaucgucgucuccucc

SEQ ID NO: 18351 - RNA, 375 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccucc

SEQ ID NO: 18352 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcuggaucuucgaccucuggggccgcggcacccucaucgccgucuccucc

SEQ ID NO: 18353 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcuccuccgacuuccgccaccgcgucucccucacccgcgaccgcgaccucuucaccgcccacauggacauccgcggccucacccagggcgacaccgccaccuacuucugcgcccgccagaaguacuacgccggcggccagggcugguacuucgaccucuggggccgcggcacccucaucgucgucuccucc

SEQ ID NO: 18354 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacaugggcauccgcggccucacccagggcgacaccgccaccuacuucugcgcccgccagaaguucuacgccggcggccagggcugguacuucgaccucuggggccgcggcacccucaucgucgucuccucc

SEQ ID NO: 18355 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcuccuccgacuuccgccagcgcgucuuccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccucc

SEQ ID NO: 18356 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuccaccgcccacauggacauccgcggccucacccaggacgacaccgccaccuacuucugcgcccgccagaaguucgcccgcggcgaccagggcugguucuucgaccucuggggccgcggcacccucaucgucgucuccucc

SEQ ID NO: 18357 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcucccaggacuuccgcgaccgcuucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccucc

SEQ ID NO: 18358 - RNA, 375 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgacgccaccggccucaucuacuggguccgccaggcccccggccagggccucgaguggaucggcugggucaagaucgucuccggcaccgucaacuucgccucccucgacuuccgccagcgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccucc

SEQ ID NO: 18359 - RNA, 375 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuccaccgccuacauggacauccgcggccucacccaggacgacaccgccaccuacuucugcgcccgccagaaguucgcccgcggcgaccagggcugguucuucgaccucuggggccgcggcacccucaucgucgucuccucc

SEQ ID NO: 18360 - RNA, 375 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuucaccgcccacauggacauccgcggccucacccaggacgacaccgccaucuaccucugcgcccgccagaaguucgcccgcggcgaccagggcugguucuucgaccucuggggccgcggcacccucaucgucgucuccucc

SEQ ID NO: 18361 - RNA, 375 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgccucccucgacuuccgcaaccgcaucucccucucccgcgaccgcgaccucuccaccgcccacauggacauccgcggccucacccagggcgacaccgccaccuacuucugcgcccgccagaaguucgagcgcggcggccagggcuggaucuucgaccucuggggccgcggcacccucaucgccgucuccucc

SEQ ID NO: 18362 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccucc

SEQ ID NO: 18363 - RNA, 375 nt, Artificial Sequence
  derived and/or modified sequence opt2 from anti-HIV-1_HeavyChain
caggcccaccccgagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccucc

SEQ ID NO: 18364 - RNA, 375 nt, Artificial Sequence
  derived and/or modified sequence opt2 from anti-HIV-1_HeavyChain
cgcgcccaccucgagcaguccggcuccggcguccgcaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccucc

SEQ ID NO: 18365 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucuccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcuggaucuucgaccucuggggccgcggcacccucaucgccgucuccucc

SEQ ID NO: 18366 - RNA, 375 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccucc

SEQ ID NO: 18367 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccacaucgucgucuccucc

SEQ ID NO: 18368 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaucgucuccggcgccgucaacuucggcucccccaacuuccgccagcgcgucucccucacccgcgaccgcgaccucuucaccgcccacauggacauccgcggccucacccagggcgacaccgccaccuacuucugcgcccgccagaaguucgagcgcggcggccagggcuggaucuucgaccucuggggccgcggcacccucaucgccgucuccucc

SEQ ID NO: 18369 - RNA, 375 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgccuccuccgacuuccgccaccgcgucucccucacccgcgaccgcgaccucuccaccgcccacauggacauccgcggccucacccaggacgacaccgccaccuacuucugcgcccgccagaaguucgcccgcggcgaccagggcugguucuucgaccucuggggccgcggcacccucaucgucgucuccucc

SEQ ID NO: 18370 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaucgucuccggcgccgucaacuucggcucccccaacuuccgccagcgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccucc

SEQ ID NO: 18371 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcuccgagcucauccacuggguccgccaggcccccggccagggccucgaguggaucggcugggucaagaccgucaccggcgccgucaacuucggcucccccaacuuccgccagcgcgucucccucacccgcgaccgcgaccucuucaccgcccacauggacauccgcggccucaccgagggcgacaccgccaccuacuucugcgcccgccagaaguucuacgccggcggccagggcugguacuucgaccucuggggccgcggcacccucaucgucgucuccucc

SEQ ID NO: 18372 - RNA, 375 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgagcgcaccgagcucauccacuggguccgccaggcccccggccagggccucgaguggaucggcugggucaaggccgucuccggcgccgccaacuacggcucccucgacuuccgccaccgcgucucccucacccgcgaccgcgaccucuucaccgcccacauggacauccgcggccucacccaggacgacaccgccaccuacuucugcgcccgccagaaguucgcccgcggcgaccagggcugguucuucgaccucuggggccgcggcacccucaucgucgucuccucc

SEQ ID NO: 18373 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucuccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccucc

SEQ ID NO: 18374 - RNA, 375 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgagcgcaccgagcucauccacuggguccgccaggcccccggccagggccucgaguggaucggcugggucaaggccgucuccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccucc

SEQ ID NO: 18375 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaucgucuccggcgccgucaacuucggcucccccaacuuccgccagcgcgucucccucacccgcgaccgcgaccucuucaccgcccacauggacauccgcggccucacccagggcgacaccgccaccuaccucugcgcccgccagaaguucgagcgcggcggccagggcuggaucuucgaccucuggggccgcggcacccucaucgccgucuccucc

SEQ ID NO: 18376 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcugguccuccgaggacaucuucgagcgcaccgagcucauccacuggguccgccaggcccccggccagggccucgaguggaucggcugggucaagaccgucuccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccucc

SEQ ID NO: 18377 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcaccgucaacuucggcucccucaacuuccgccagcgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccucc

SEQ ID NO: 18378 - RNA, 375 nt, Artificial Sequence
  derived and/or modified sequence opt2 from anti-HIV-1_HeavyChain
caggcccaccucgagcaguccgccuccggcgucaagcgccccggcgccuccguccgcgucuccugcuggaccuccgaggacaucuucgagcgcuccgagcucaucuacuggguccgccaggcccccggccagggccucgaguggaucggcugggucaagaccgucuccggcgccgucaacuucggcuccaccgacuuccgcgagcgcgucucccucacccgcgaccgcgaccucuucaccgcccacauggacauccgcggccucacccagggcgacaccgccaccuacuucugcgcccgccagaaguucgcccgcggcgaccagggcugguucuucgaccucuggggccgcggcacccucaucgucgucuccucc

SEQ ID NO: 18379 - RNA, 375 nt, Artificial Sequence
  derived and/or modified sequence opt2 from anti-HIV-1_HeavyChain
cagguccaccucgagcaguccggcuccggcgucaagaagcccggcgccuccguccgcgucuccugcuggaccuccgaggacaucuucgagcgcuccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguacuacgccggcggccagggcugguacuucgaccucuggggccgcggcacccucaucgucgucuccucc

SEQ ID NO: 18380 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacaucugcggccucacccagggcgacaccgccaccuacuucugcgcccgccagaaguucuacgccggcggccagggcugguacuucgaccucuggggccgcggcacccucaucgucgucuccucc

SEQ ID NO: 18381 - RNA, 375 nt, Artificial Sequence
  derived and/or modified sequence opt2 from anti-HIV-1_HeavyChain
caggcccaccucgagcaguccggcuccggcgucaagaagcccgaggccuccguccgcgucuccugcuggaccuccgaggacaucuucgagaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccucc

SEQ ID NO: 18382 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgccagcgcgucucccucacccgcgaccgcgaccucuucaccgcccacauggacauccgcggccucacccagggcgacaccgccaccuacuucugcgcccgccagaaguucgagcgcggcggccagggcuggaucuucgaccucuggggccgcggcacccucaucgccgucuccucc

SEQ ID NO: 18383 - RNA, 375 nt, Artificial Sequence
  derived and/or modified sequence opt2 from anti-HIV-1_HeavyChain
caggcccaccucgagcaguccgccuccggcgucaagcgccccggcgccuccguccgcgucuccugcuggaccuccgaggacaucuucgagcgcaccgagcucaucuacuggguccgccaggcccccggccagggccucgaguggaucggcugggucaagaccgucuccggcgccgucaacuucggcucccaggacuuccgcgaccgcuucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccucc

SEQ ID NO: 18384 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaucgucuccggcgccgucaacuucggcucccccaacuuccgccagcgcgucucccucacccgcgaccgcgaccucuucaccgcccacauggacauccgcggccucacccagggcgacaccgccaccuacuucugcgcccgccagaaguucgagcgcggcggccagggcuggaucuucgaccucuggggccgcggcacccucaucgccgucuccucc

SEQ ID NO: 18385 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgccaccgcgucucccucacccgcgaccgcgaccccuucaccgcccacauggacauccgcggccucacccagggcgacaccgccaccuacuucugcgcccgccagaaguucgagcgcggcggccagggcugguacuucgaccucuggggccgcggcacccucaucgucgucuccucc

SEQ ID NO: 18386 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaaguccggccucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccucc

SEQ ID NO: 18387 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaaggccgucuccggcaccgucaacuacggcucccucgacuuccgccaccgcgucucccucacccgcgaccgcgaccucuucaccgcccacauggacauccgcggccucacccaggacgacaccgccaccuacuucugcgcccgccagaaguucgcccgcggcgaccagggcugguucuucgaccucuggggccgcggcacccucaucgucgucuccucc

SEQ ID NO: 18388 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagggcuccgagcucauccacuggguccgccaggcccccggccagggccucgaguggaucggcugggucaagaccgucaccggcgccgucaacuucggcuccgccuacuuccgccaccgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccucc

SEQ ID NO: 18389 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcugguccuccgaggacaucuucgagcgcaccgagcucauccacuggguccgccaggcccccggccagggccucgaguggaucggcugggucaagaccgucaccggcgccgucaacuucggcucccucgacuuccgccaccgcaucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccucc

SEQ ID NO: 18390 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcugguccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuccaccgcccacauggacauccgcggccucacccaggacgacaccgccacccacuucugcgcccgccagaaguucgcccgcggcgaccagggcugguucuucgaccucuggggccgcggcacccucaucgucgucuccucc

SEQ ID NO: 18391 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagggcaccgagcucauccacuggguccgccaggcccccggccagggccucgaguggaucggcugggucaagaucgucuccggcgccgucaacuucggcucccccaacuuccgccagcgcgucucccucacccgcgaccgcgaccucuucaccgcccacauggacauccgcggccucacccagggcgacaccgccaccuacuucugcgcccgccagaaguucgagcgcggcggccagggcuggaucuucgaccucuggggccgcggcacccucaucgccgucuccucc

SEQ ID NO: 18392 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgccagcgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccucc

SEQ ID NO: 18393 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagggcuccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccucc

SEQ ID NO: 18394 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucuccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgcccgcggcgaccagggcugguucuucgaccucuggggccgcggcacccucaucgucgucuccucc

SEQ ID NO: 18395 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgagggcaucuucgagcgcaccgagcucauccacuggguccgccaggcccccggccagggccucgaguggaucggcugggucaagaucgucuccggcgccgucaacuucggcucccccaacuuccgccagcgcgucucccucacccgcgaccgcgaccucuucgccgcccacauggacauccgcggccucacccagggcgacaccgccaccuacuucugcgcccgccagaaguucgagcgcggcggccagggcuggaucuucgaccucuggggccgcggcacccucaucgccgucuccucc

SEQ ID NO: 18396 - RNA, 375 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgagcgcgccgagcucauccacuggguccgccaggcccccggccagggccucgaguggaucggcugggucaaggccgucuccggcgccgucaacuacggcucccucgacuuccgccaccgcgucucccucacccgcgaccgcgaccucuucaccgcccacauggacauccgcggccucacccaggacgacaccgccaucuacuucugcgcccgccagaaguucuacgccggcggccagggcugguacuucgaccucuggggccgcggcacccucaucgucgucuccucc

SEQ ID NO: 18397 - RNA, 375 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccccaacuuccgccagcgcgucucccucacccgcgaccgcgaccucuucaccgcccacauggacauccgcggccucacccagggcgacaccgccaccuacuucugcgcccgccagaaguucgagcgcggcggccagggcuggaucuucgaccucuggggccgcggcacccucaucgccgucuccucc

SEQ ID NO: 18398 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuacggcucccucaacuuccgcucccgcaucucccucacccgcgaccgcgaccucuucaccgcccacauggacauccgcggccucaccgagggcgacaccgccaccuacuucugcgcccgccagaaguucuacgccggcggccagggcugguacuucgaccucuggggccgcggcacccucaucgucgucuccucc

SEQ ID NO: 18399 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucuccggcgccgucaacuucggcucccccaacuuccgccagcgcgucucccucacccgcgaccgcgaccucuucaccgcccacauggacauccgcggccucacccagggcgacaccgccaccuacuucugcgcccgccagaaguucgagcgcggcggccagggcuggaucuucgaccucuggggccgcggcacccucaucgccgucuccucc

SEQ ID NO: 18400 - RNA, 375 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgagcgcaccgagcucauccacuggguccgccaggcccccggccagggccucgaguggauccgcugggucaaggccgucuccggcgccgucaacuacggcucccucgacuuccgccaccgcgucucccucacccgcgaccgcgaccucuccaccgcccacauggacauccgcggccucacccaggacgacaccgccaccuacuucugcgcccgccagaaguucgcccgcggcgaccagggcugguucuucgaccucuggggccgcggcacccucaucgucgucuccucc

SEQ ID NO: 18401 - RNA, 375 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccagauggacauccgcggccucacccagggcgacaccgccaccuacuucugcgcccgccagaaguucuacgccggcggccagggcugguacuucgaccucuggggccgcggcacccucaucgucgucuccucc

SEQ ID NO: 18402 - RNA, 372 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucgcccaccagaucuccgaccgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccucc

SEQ ID NO: 18403 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaaggucgucuccggcgccgucaacuucggcucccccaacuuccgccagcgcgucucccucacccgcgaccgcgaccucuucaccgcccacauggacauccgcggccucacccagggcgacaccgccaccuacuucugcgcccgccagaaguucgagcgcggcggccagggcuggaucuucgaccucuggggccgcggcacccucaucgccgucuccucc

SEQ ID NO: 18404 - RNA, 375 nt, Artificial Sequence
  derived and/or modified sequence opt2 from anti-HIV-1_HeavyChain
cagguccaccucgagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccucc

SEQ ID NO: 18405 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcugguccuccgaggacaucuucgagcgcaccgagcucauccacuggguccgccaggcccccggccagggccucgaguggaucggcugggucaagaccgucaccggcgccgucaacuucggcucccucgacuuccgccaccgcaucucccucacccgcgaccgcgaccucuucaccgcccacauggacauccgcggccucacccagggcgacaccgccaccuacuucugcgcccgccagaaguucgagcgcggcggccagggcuggaucuucgaccucuggggccgcggcacccucaucgccgucuccucc

SEQ ID NO: 18406 - RNA, 375 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgccucccucgacuuccgcaaccgcaucucccucucccgcgaccgcgaccucuccaccgccuacauggacauccgcggccucacccaggacgacaccgccaccuacuucugcgcccgccagaaguucgcccgcggcgaccagggcugguucuucgaccucuggggccgcggcacccucaucgucgucuccucc

SEQ ID NO: 18407 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuaccucugcgcccgccagaaguucgagcgcggcggccagggcugguacuucgaccucuggggccgcggcacccucaucgucgucuccucc

SEQ ID NO: 18408 - RNA, 372 nt, Artificial Sequence
  derived and/or modified sequence opt2 from anti-HIV-1_HeavyChain
cgccacaccugggagcaguccggcuccggcgucaagaagcccggcgccuccguccgcgucuccugcuggaccuccgaggacaucuucaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccucc

SEQ ID NO: 18409 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucaccgagggcgacaccgccaccuacuucugcgcccgccagaaguucuacgccggcggccagggcugguacuucgaccucuggggccgcggcacccucaucgucgucuccucc

SEQ ID NO: 18410 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcuccgccuacuuccgccaccgcgucucccucacccgcgaccgcgaccucuucaccgcccacauggacauccgcggccucacccagggcgacaccgccaccuacuucugcgcccgccagaaguucuacaagggcggccagggcugguacuucgaccucuggggccgcggcacccucaucgucgucuccucc

SEQ ID NO: 18411 - RNA, 375 nt, Artificial Sequence
  derived and/or modified sequence opt2 from anti-HIV-1_HeavyChain
caggcccaccucgagcaguccggccccggcgucaagaagcucggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuucaccgcccacauggacauccgcggccucacccaggacgacaccgccaccuacuucugcgcccgccagaaguucgcccgcggcgaccagggcugguucuucgaccucuggggccgcggcacccucaucgucgucuccucc

SEQ ID NO: 18412 - RNA, 375 nt, Artificial Sequence
  derived and/or modified sequence opt2 from anti-HIV-1_HeavyChain
cgcgcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaucgucuccggcgccgucaacuucggcucccccaacuuccgccagcgcgucucccucacccgcgaccgcgaccucuucaccgcccacauggacauccgcggccucacccagggcgacaccgccaccuacuucugcgcccgccagaaguucgagcgcggcggccagggcuggaucuucgaccucuggggccgcggcacccucaucgccgucuccucc

SEQ ID NO: 18413 - RNA, 375 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccucc

SEQ ID NO: 18414 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcugguccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuucaccgcccacauggacauccgcggccucacccaggacgacaccgccaucuacuucugcgcccgccagaaguucgcccgcggcgaccagggcugguucuucgaccucuggggccgcggcacccucaucgucgucuccucc

SEQ ID NO: 18415 - RNA, 375 nt, Artificial Sequence
  derived and/or modified sequence opt2 from anti-HIV-1_HeavyChain
caggcccaccucgagcaguccggcuccggcgucaagaaggucggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuucaccgcccacauggacauccgcggccucacccaggacgacaccgccaucuacuucugcgcccgccagaaguucgcccgcggcgaccagggcugguucuucgaccucuggggccgcggcacccucaucgucgucuccucc

SEQ ID NO: 18416 - RNA, 375 nt, Artificial Sequence
  derived and/or modified sequence opt2 from anti-HIV-1_HeavyChain
cagguccagcucguccaguccggcgccgagcucaagaagcccggcuccuccguccgcgucuccugcuggaccuccgaggacaucuucgagggcuccgagcucauccacuggguccgccaggcccccggccagggccucgaguggaucggcugggucaagaccgucaccggcgccgucaacuucggcuccgccuacuuccgccaccgcgucucccucacccgcgaccgcgaccucuucaccgcccacauggacauccgcggccucacccagggcgacaccgccaccuacuucugcgcccgccagaaguucuacaagggcggccagggcugguacuucgaccucuggggccgcggcacccucaucgucgucuccucc

SEQ ID NO: 18417 - RNA, 375 nt, Artificial Sequence
  derived and/or modified sequence opt2 from anti-HIV-1_HeavyChain
caggcccaccucgagcaguccggcuccggcgucaagaagcccggcgucuccguccgcgucuccugcuggaccuccgaggacaucuucgagcgcaccgagcucauccacuggguccgccaggcccccggccagggccucgaguggaucggcugggucaagaucgucuccggcgccgucaacuucggcucccccaacuuccgccagcgcgucucccucacccgcgaccgcgaccucuucaccgcccacauggacauccgcggccucacccagggcgacaccgccaccuacuucugcgcccgccagaaguucgagcgcggcggccagggcuggaucuucgaccucuggggccgcggcacccucaucgccgucuccucc

SEQ ID NO: 18418 - RNA, 375 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgagcgcaccgagcucauccacuggguccgccaggcccccggccagggccucgaguggaucggcugggucaaggucgucuccggcgccgucaacuacggcucccucgacuuccgccaccgcgucucccucacccgcgaccgcgaccucuucaccgcccacauggacauccgcggccucacccaggacgacaccgccaccuacuucugcgcccgccagaaguucgcccgcggcgaccagggcugguucuucgaccucuggggccgcggcacccucaucgucgucuccucc

SEQ ID NO: 18419 - RNA, 375 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuucaccgcccacauggacauccgcggccucacccaggacgacaccgccgccuacuucugcgcccgccagaaguucgcccgcggcgaccagggcugguucuucgaccucuggggccgcggcacccucaucgucgucuccucc

SEQ ID NO: 18420 - RNA, 375 nt, Artificial Sequence
  derived and/or modified sequence opt2 from anti-HIV-1_HeavyChain
caggcccaccucgagcaguccggcuccggcguccgcaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccucc

SEQ ID NO: 18421 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcaccgucaacuucggcucccucaacuuccgccagcgcgucucccucacccgcgaccgcgaccucuucaccgcccacauggacauccgcggccucacccagggcgacaccgccaccuacuucugcgcccgccagaaguucuacaagggcggccagggcugguacuucgaccucuggggccgcggcacccucaucgucgucuccucc

SEQ ID NO: 18422 - RNA, 375 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuucaccgcccacauggacauccgcggccucacccaggacgacaccgccaccuacuucugcgcccgccagaaguucgcccgcggcgaccagggcugguucuucgaccucuggggccgcggcacccucaucgucgucuccucc

SEQ ID NO: 18423 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcugguccuccgaggacaucuucgagcgcaccgagcucauccacuggguccgccaggcccccggccagggccucgaguggaucggcugggucaagaccgucaccggcgccgucaacuucggcucccucgacuuccgccaccgcgucucccucacccgcgaccgcgaccucuucaccgcccacauggacauccgcggccucacccagggcgacaccgccaccuacuucugcgcccgccagaaguucgcccgcggcgaccagggcugguucuucgaccucuggggccgcggcacccucaucgucgucuccucc

SEQ ID NO: 18424 - RNA, 375 nt, Artificial Sequence
  derived and/or modified sequence opt2 from anti-HIV-1_HeavyChain
caggcccaccucgagcaguccggcuccggcgucaagcgccccggcgccuccguccgcgucuccugcuggaccuccgaggacaucuucgagaccaccgagcucauccacuggguccgccaggcccccggccagggccucgaguggaucggcugggucaagaccgucuccggcgccgucaacuucggcucccucaacuuccgccaccgcgucucccucacccgcgaccgcgaccucuucaccgcccacauggacauccgcggccucacccagggcgacaccgccaccuacuucugcgcccgccagaaguucuacaagggcggccagggcugguacuucgaccucuggggccgcggcacccucaucgucgucuccucc

SEQ ID NO: 18425 - RNA, 375 nt, Artificial Sequence
  derived and/or modified sequence opt2 from anti-HIV-1_HeavyChain
caggcccaccucgagcaguccgccuccggcguccgccgccccggcgccuccguccgcgucuccugcuggaccuccgaggacaucuucgagcgcuccgagcucaucuacuggguccgccaggcccccggccgcggccucgaguggaucggcuggaucaagcucgucuccggcgccgucaacuucggcuccgucgacuuccgcgaccgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccucc

SEQ ID NO: 18426 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcugguccuccgaggacaucuucgagcgcaccgagcucauccacuggguccgccaggcccccggccagggccucgaguggaucggcugggucaagaucgucuccggcgccgucaacuucggcucccccaacuuccgccagcgcgucucccucacccgcgaccgcgaccucuucaccgcccacauggacauccgcggccucacccagggcgacaccgccaccuacuucugcgcccgccagaaguucgagcgcggcggccagggcuggaucuucgaccucuggggccgcggcacccucaucgccgucuccucc

SEQ ID NO: 18427 - RNA, 375 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgagcgcaccgagcucauccacuggguccgccaggcccccggccagggccucgaguggaucggcugggucaagaccgucuccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccucc

SEQ ID NO: 18428 - RNA, 375 nt, Artificial Sequence
  derived and/or modified sequence opt2 from anti-HIV-1_HeavyChain
caggcccaccucgagcaguccggcuccggcgucaagcgccccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacaugggcauccgcggccucacccagggcgacaccgccaccuacuucugcgcccgccagaaguucuacgccggcggccagggcugguacuucgaccucuggggccgcggcacccucaucgucgucuccucc

SEQ ID NO: 18429 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuucaccgcccacauggacauccgcggccucacccaggacgacaccgccaucuacuucugcgcccgccagaaguucgcccgcggcgaccagggcugguucuucgaccucuggggccgcggcacccucaucgucgucuccucc

SEQ ID NO: 18430 - RNA, 375 nt, Artificial Sequence
  derived and/or modified sequence opt2 from anti-HIV-1_HeavyChain
cagucccaccucgagcaguccggcuccgccaugaagaagcucggcgccuccguccgcguccccugcuggaccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuucaccgcccacauggacauccgcggccucacccaggacgacaccgccaccuacuucugcgcccgccagaaguucgcccgcggcgaccagggcugguucuucgaccucuggggccgcggcacccucaucgucgucuccucc

SEQ ID NO: 18431 - RNA, 375 nt, Artificial Sequence
  derived and/or modified sequence opt2 from anti-HIV-1_HeavyChain
cagguccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaucgucuccggcgccgucaacuucggcucccccaacuuccgccagcgcgucucccucacccgcgaccgcgaccucuucaccgcccacauggacauccgcggccucacccagggcgacaccgccaccuacuucugcgcccgccagaaguucgagcgcggcggccagggcuggaucuucgaccucuggggccgcggcacccucaucgccgucuccucc

SEQ ID NO: 18432 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuucaccgcccacauggacauccgcggccucacccaggacgacaccgccaccuacuucugcgcccgccagaaguucgcccgcggcgaccagggcugguucuucgaccucuggggccgcggcacccucaucgucgucuccucc

SEQ ID NO: 18433 - RNA, 375 nt, Artificial Sequence
  derived and/or modified sequence opt2 from anti-HIV-1_HeavyChain
caggcccaccucgagcaguccgccuccggcguccgccgccccggcgccuccguccgcgucuccugcuggaccuccgaggacaucuucgagcgcuccgagcucaucuacuggguccgccaggcccccggccgcggccucgaguggaucggcugggucaagaccgucuccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccucc

SEQ ID NO: 18434 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgccagcgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccucc

SEQ ID NO: 18435 - RNA, 375 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgagcgcaccgagcucaucuacuggguccgccaggcccccggccgcggccucgaguggaucggcugggucaagaccgucuccggcaccgucaacuucggcuccuccgacuuccgcaaccgcaucucccucacccgcgaccgcgaccucuccaccgcccacauggacauccgcggccucacccaggacgacaccgccaccuacuucugcgcccgccagaaguucuacgccggcggccagggcugguacuucgaccucuggggccgcggcacccucaucgucgucuccucc

SEQ ID NO: 18436 - RNA, 375 nt, Artificial Sequence
  derived and/or modified sequence opt2 from anti-HIV-1_HeavyChain
cagguccagcucgagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccucc

SEQ ID NO: 18437 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccgcggccucgaguggaucggcugggucaaggccgucuccggcgccgucaacuacggcucccucgacuuccgccaccgcgucucccucacccgcgaccgcgaccucuucaccgcccacauggacauccgcggccucacccaggacgacaccgccaccuacuucugcgcccgccagaaguucgcccgcggcgaccagggcugguucuucgaccucuggggccgcggcacccucaucgucgucuccucc

SEQ ID NO: 18438 - RNA, 375 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccucc

SEQ ID NO: 18439 - RNA, 375 nt, Artificial Sequence
  derived and/or modified sequence opt2 from anti-HIV-1_HeavyChain
caggcccaccucgagcaguccgccuccggcgucaagcgccccggcgccuccguccgcgucuccugcuggaccuccgaggacaucuucgagcgcuccgagcucaucuacuggguccgccaggcccccggccagggccucgaguggaccggcugggucaagaccgucuccggcgccgucaacuucggcuccaccgacuuccgcgagcgcgucucccucacccgcgaccgcgaccucuucaccgcccacauggacauccgcggccucacccagggcgacaccgccaccuacuucugcgcccgccagaaguucgcccgcggcgaccagggcugguucuucgaccucuggggccgcggcacccucaucgucgucuccucc

SEQ ID NO: 18440 - RNA, 375 nt, Artificial Sequence
  derived and/or modified sequence opt2 from anti-HIV-1_HeavyChain
cagguccaccucgagcaguccggcuccggcgucaagaagcucggcgccuccguccgcgucuccugcuggaccuccgaggacaucuucgagcgcaccgagcucauccacuggguccgccaggcccccggccgcggccucgaguggaucggcugggucaaggccgucuccggcgccgucaacuacggcucccucgacuuccgccaccgcgucucccucacccgcgaccgcgaccucuucaccgcccacauggacauccgcggccucacccaggacgacaccgccaccuacuucugcgcccgccagaaguucgcccgcggcgaccagggcugguucuucgaccucuggggccgcggcacccucaucgucgucuccucc

SEQ ID NO: 18441 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcuccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguacuacgccggcggccagggcugguacuucgaccucuggggccgcggcacccucaucgucgucuccucc

SEQ ID NO: 18442 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccucc

SEQ ID NO: 18443 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcggcaccgccaccuacuucugcgcccgccagaaguucuacgccggcggccagggcugguacuucgaccucuggggccgcggcacccucaucgucgucuccucc

SEQ ID NO: 18444 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucuccggcgccgucaacuucggcucccccaacuuccgccaccgcgucucccucacccgcgaccgcgaccucuucaccgcccacauggacaucugcggccucacccagggcgacaccgccaccuacuucugcgcccgccagaaguucgagcgcggcggccagggcugguacuucgaccucuggggccgcggcacccucaucgucgucuccucc

SEQ ID NO: 18445 - RNA, 375 nt, Artificial Sequence
  derived and/or modified sequence opt2 from anti-HIV-1_HeavyChain
caggcccaccucgagcaguccggcuccggcguccgcaaggucggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuucaccgcccacauggacauccgcggccucacccaggacgacaccgccaucuacuucugcgcccgccagaaguucgcccgcggcgaccagggcugguucuucgaccucuggggccgcggcacccucaucgucgucuccucc

SEQ ID NO: 18446 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguacuacgccggcggccagggcugguacuucgaccucuggggccgcggcacccucaucgucgucuccucc

SEQ ID NO: 18447 - RNA, 375 nt, Artificial Sequence
  derived and/or modified sequence opt2 from anti-HIV-1_HeavyChain
cagguccagcucguccaguccggcgccgaggucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccucc

SEQ ID NO: 18448 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggccucuccgacuuccgccagcgcgucucccucacccgcgaccgcggccucuucaccgcccacauggacauccgcggccucacccagggcgacaccgccaccuacuucugcgcccgccagaaguucuacgccggcggccagggcugguacuucgaccucuggggccgcggcacccucaucgucgucuccucc

SEQ ID NO: 18449 - RNA, 375 nt, Artificial Sequence
  derived and/or modified sequence opt2 from anti-HIV-1_HeavyChain
caggcccaccucgagcaguccggcuccggcgucaagaagcccggcaccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgccagcgcgucucccucacccgcgaccgcgaccucuucaccgcccacauggacauccgcggccucacccagggcgacaccgccaccuacuucugcgcccgccagaaguucgagcgcggcggccagggcuggaucuucgaccucuggggccgcggcacccucaucgccgucuccucc

SEQ ID NO: 18450 - RNA, 375 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgccucccucgacuuccgcaaccgcaucucccucucccgcgaccgcgaccucuccaccgcccacauggacauccgcggccucacccaggacgacaccgccaccuacuucugcgcccgccagaaguucgagcgcggcggccagggcugguacuucgaccucuggggccgcggcacccucaucgucgucuccucc

SEQ ID NO: 18451 - RNA, 375 nt, Artificial Sequence
  derived and/or modified sequence opt2 from anti-HIV-1_HeavyChain
cagguccagcucguccaguccggcgccgaggucaagaagcccggcgccuccguccgcgucuccugcuggaccuccgaggacaucuucgagggcuccgagcucauccacuggguccgccaggcccccggccagggccucgaguggaucggcugggucaagaccgucaccggcgccgucaacuucggcuccgccuacuuccgccaccgcgucucccucacccgcgaccgcgaccucuucaccgcccacauggacauccgcggccucacccagggcgacaccgccaccuacuucugcgcccgccagaaguucuacaagggcggccagggcugguacuucgaccucuggggccgcggcacccucaucgucgucuccucc

SEQ ID NO: 18452 - RNA, 375 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgccuccuccgacuuccgcaaccgcaucucccucucccgcgaccgcgaccucuccaccgcccacauggacauccgcggccucacccaggacgacaccgccaccuacuucugcgcccgccagaaguucgagcgcggcggccagggcuggaucuucgaccucuggggccgcggcacccucaucgccgucuccucc

SEQ ID NO: 18453 - RNA, 375 nt, Artificial Sequence
  derived and/or modified sequence opt2 from anti-HIV-1_HeavyChain
cagguccagcucguccaguccggcaccgaggucaagaagcccggcgccuccguccgcgucuccugcaaggccuccggcuacaccuucgagaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccucc

SEQ ID NO: 18454 - RNA, 375 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgagcgcaccgagcucaucuacuggguccgccaggcccccggccgcggccucgaguggaucggcugggucaagaccgucuccggcaccgucaacuucggcuccuccgacuuccgcaaccgcaucucccucacccgcgaccgcgaccucuccaccgcccacauggacauccgcggccucacccaggacgacaccgccaccuacuucugcgcccgccagaaguucgagcgcggcggccagggcuggaucuucgaccucuggggccgcggcacccucaucgccgucuccucc

SEQ ID NO: 18455 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcugguccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuccaccgcccacauggacauccgcggccucacccaggacgacaccgccaccuacuucugcgcccgccagaaguucgcccgcggcgaccagggcugguucuucgaccucuggggccgcggcacccucaucgucgucuccucc

SEQ ID NO: 18456 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccaggacgacaccgccaucuacuucugcgcccgccagaaguucgcccgcggcgaccagggcugguucuucgaccucuggggccgcggcacccucaucgucgucuccucc

SEQ ID NO: 18457 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccucgacuuccgccaccgcaucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccucc

SEQ ID NO: 18458 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaaguccgagcucguccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucgagcgcggcggccagggcuggaucuucgaccucuggggccgcggcacccucaucgccgucuccucc

SEQ ID NO: 18459 - RNA, 375 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuucaccgcccacauggacauccgcggccucacccagggcgacaccgccaccuacuucugcgcccgccagaaguucgcccgcggcgaccagggcugguucuucgaccucuggggccgcggcacccucaucgucgucuccucc

SEQ ID NO: 18460 - RNA, 375 nt, Artificial Sequence
  derived and/or modified sequence opt2 from anti-HIV-1_HeavyChain
caggcccaccgcgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccucc

SEQ ID NO: 18461 - RNA, 372 nt, Artificial Sequence
  derived and/or modified sequence opt2 from anti-HIV-1_HeavyChain
caggcccaccucgagcaguccggcuccggcgucaagaagcccggcgccuccguccgcgucuccugccucgccuccgaggacaucuucaagaccgagcucauccacuggguccgccaggcccccggccagggccucgaguggaucggcugggucaagaucgucuccggcgccgucaacuucggcucccccaacuuccgccagcgcgucucccucacccgcgaccgcgaccucuucaccgcccacauggacauccgcggccucacccagggcgacaccgccaccuacuucugcgcccgccagaaguucgagcgcggcggccagggcuggaucuucgaccucuggggccgcggcacccucaucgccgucuccucc

SEQ ID NO: 18462 - RNA, 375 nt, Artificial Sequence
  derived and/or modified sequence opt2 from anti-HIV-1_HeavyChain
caggcccaccucgagcaguccggcuccggcgucaagaaggucggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuucaccgcccacauggacauccgcggccucacccaggacgacaccgccaucuacuucugcgcccgccagaaguucgagcgcggcggccagggcuggaucuucgaccucuggggccgcggcacccucaucgccgucuccucc

SEQ ID NO: 18463 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucgcccgcggcgaccagggcugguucuucgaccucuggggccgcggcacccucaucgucgucuccucc

SEQ ID NO: 18464 - RNA, 375 nt, Artificial Sequence
  derived and/or modified sequence opt2 from anti-HIV-1_HeavyChain
caggcccaccucgagcaguccgccuccggcgucaagcgccccggcgccuccguccgcgucuccugcuggaccuccgaggacaucuucgagcgcuccgagcucaucuacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccucc

SEQ ID NO: 18465 - RNA, 375 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguacuacgccggcggccagggcugguacuucgaccucuggggccgcggcacccucaucgucgucuccucc

SEQ ID NO: 18466 - RNA, 375 nt, Artificial Sequence
  derived and/or modified sequence opt2 from anti-HIV-1_HeavyChain
cagguccagcucguccaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaucgucuccggcgccgucaacuucggcucccccaacuuccgccagcgcgucucccucacccgcgaccgcgaccucuucaccgcccacauggacauccgcggccucacccagggcgacaccgccaccuacuucugcgcccgccagaaguucgagcgcggcggccagggcuggaucuucgaccucuggggccgcggcacccucaucgccgucuccucc

SEQ ID NO: 18467 - RNA, 375 nt, Artificial Sequence
  derived and/or modified sequence opt2 from anti-HIV-1_HeavyChain
cgccacaccugggagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaucgucuccggcgccgucaacuucggcucccccaacuuccgccagcgcgucucccucacccgcgaccgcgaccucuucaccgcccacauggacauccgcggccucacccagggcgacaccgccaccuacuucugcgcccgccagaaguucgagcgcggcggccagggcuggaucuucgaccucuggggccgcggcacccucaucgccgucuccucc

SEQ ID NO: 18468 - RNA, 372 nt, Artificial Sequence
  derived and/or modified sequence opt2 from anti-HIV-1_HeavyChain
cgccacaccugggagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaaccucgcccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccucc

SEQ ID NO: 18469 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagggcuccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccucc

SEQ ID NO: 18470 - RNA, 375 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgccuccuccgacuuccgcaaccgcaucucccucucccgcgaccgcgaccucuccaccgcccacauggacauccgcggccucacccagggcgacaccgccaccuacuucugcgcccgccagaaguacuacgccggcggccagggcugguacuucgaccucuggggccgcggcacccucaucgucgucuccucc

SEQ ID NO: 18471 - RNA, 375 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgagcgcaccgagcucauccacuggguccgccaggcccccggccagggccucgaguggaucggcugggucaagaucgucuccggcgccgucaacuucggcucccccaacuuccgccagcgcgucucccucacccgcgaccgcgaccucuucaccgcccacauggacauccgcggccucacccagggcgacaccgccaccuacuucugcgcccgccagaaguucgagcgcggcggccagggcuggaucuucgaccucuggggccgcggcacccucaucgccgucuccucc

SEQ ID NO: 18472 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucuacaagggcggccagggcugguacuucgaccucuggggccgcggcacccucaucgucgucuccucc

SEQ ID NO: 18473 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgcccgcggcgaccagggcugguucuucgaccucuggggccgcggcacccucaucgucgucuccucc

SEQ ID NO: 18474 - RNA, 375 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgagcgcaccgagcucauccacuggguccgccaggcccccggccgcggccucgaguggaucggcugggucaaggccgucuccggcgccgucaacuacggcucccucgacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccucc

SEQ ID NO: 18475 - RNA, 375 nt, Artificial Sequence
  derived and/or modified sequence opt2 from anti-HIV-1_HeavyChain
caggcccgccccggcaccuccggcuccggcgucaagaagcccggcgccuccguccgcgucuccugcugguccuccgaggacaucuucgagcgcaccgagcucauccacuggguccgccaggcccccggccagggccucgaguggaucggcugggucaagaccgucaccggcgccgucaacuucggcucccucgacuuccgccagcgcgucucccucacccgcgaccgcgaccucuucaccgcccacauggacauccgcggccucacccagggcgacaccgccaccuacuucugcgcccgccagaaguucgagcgcggcggccagggcuggaucuucgaccucuggggccgcggcacccucaucgccgucuccucc

SEQ ID NO: 18476 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucaccgagggcgacaccgccaccuacuucugcgcccgccagaaguucgagcgcggcggccagggcuggaucuucgaccucuggggccgcggcacccucaucgccgucuccucc

SEQ ID NO: 18477 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaaggccaucuccggcgccgucaacuacggcucccucgacuuccgccaccgcgucucccucacccgcgaccgcgaccucuucaccgcccacauggacauccgcggccucacccaggacgacaccgccaccuacuucugcgcccgccagaaguucgcccgcggcgaccagggcugguucuucgaccucuggggccgcggcacccucaucgucgucuccucc

SEQ ID NO: 18478 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuccggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccucc

SEQ ID NO: 18479 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcgccgagcucauccacuggguccgccaggcccccggccagggccucgaguggaucggcugggucaagaccgucuccggcgccgucaacuucggcucccucaacuuccgccaccgcgucucccucacccgcgaccgcgaccucuucaccgcccacauggacauccgcggccucacccagggcgacaccgccaccuacuucugcgcccgccagaaguucgcccgcggcgaccagggcugguucuucgaccucuggggccgcggcacccucaucgucgucuccucc

SEQ ID NO: 18480 - RNA, 375 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuccaccgcccacauggacauccgcggccucacccaggacgacaccgccaccuacuucugcgcccgccagaaguucgcccgcggcgaccagggcugguucuucgaccucuggggccgcggcacccucgucaccgucuccucc

SEQ ID NO: 18481 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccucaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccucc

SEQ ID NO: 18482 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgccaccgcgucucccucacccgcgaccgcgaccucuccaccgcccacauggacauccgcggccucacccaggacgacaccgccaccuacuucugcgcccgccagaaguucgcccgcggcgaccagggcugguucuucgaccucuggggccgcggcacccucaucgucgucuccucc

SEQ ID NO: 18483 - RNA, 375 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgacaccaccgagcucaucuacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguacuacgccggcggccagggcugguacuucgaccucuggggccgcggcacccucaucgucgucuccucc

SEQ ID NO: 18484 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgccuccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccucc

SEQ ID NO: 18485 - RNA, 375 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuucaccgcccacauggacauccgcggccucacccaggacgacaccgccaccuacuucugcgcccgccagaaguucgagcgcggcggccagggcugguacuucgaccucuggggccgcggcacccucaucgucgucuccucc

SEQ ID NO: 18486 - RNA, 375 nt, Artificial Sequence
  derived and/or modified sequence opt2 from anti-HIV-1_HeavyChain
caggcccaccucgagcaguccgccuccggcgucaagcgccccggcgccuccguccgcgucuccugcuggaccuccgaggacaucuucgagcgcuccgagcucaucuacuggguccgccaggcccccggccagggccucgaguggaucggcugggucaagaccgucuccggcgccgucaacuucggcuccaccgacuuccgcgagcgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccucc

SEQ ID NO: 18487 - RNA, 375 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgagcgcaccgagcucauccacuggguccgccaggcccccggccagggccucgaguggaucggcugggucaaggccgucuccggcgucgucaacuacggcucccucgacuuccgccaccgcgucucccucacccgcgaccgcgaccucuccaccgcccacauggacauccgcggccucacccaggacgacaccgccaccuacuucugcgcccgccagaaguucgcccgcggcgaccagggcugguucuucgaccucuggggccgcggcacccucaucgucgucuccucc

SEQ ID NO: 18488 - RNA, 375 nt, Artificial Sequence
  derived and/or modified sequence opt2 from anti-HIV-1_HeavyChain
caggcccaccucgagcaguccggcuccggcgucaagaaggucggcgccuccguccgcgucuccugcuggaccuccgaggacaucuucgagcgcaccgagcucauccacuggguccgccaggcccccggccagggccucgaguggaucggcugggucaagaccgucuccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccucc

SEQ ID NO: 18489 - RNA, 375 nt, Artificial Sequence
  derived and/or modified sequence opt2 from anti-HIV-1_HeavyChain
caggccuaccucgagcaguccggcuccaucaugaagaagcccggcgccuccguccgcgucuccugcuggaccuccgaggacaucuucgaccgcaccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccucc

SEQ ID NO: 18490 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaaguccgagcucauccacuggguccgccucgcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccucc

SEQ ID NO: 18491 - RNA, 375 nt, Artificial Sequence
  derived and/or modified sequence opt2 from anti-HIV-1_HeavyChain
gaggcccaccucgagcaguccggcuccggcgucaagaagcccggcgccuccguccgcgucuccugcuggaccuccgaggacaucuucgagcgcaccgagcucacccacuggguccgccaggcccccggccagggccucgaguggaucggcugggucaagaccgucaccggcgccgucaacuucggcucccccaacuuccgccagcgcgucucccucacccgcgaccgcgaccucuucaccgcccacauggacauccgcggccucacccagggcgacaccgccaccuacuucugcgcccgccagaaguucgagcgcggcggccagggcuggaucuucgaccucuggggccgcggcacccucaucgccgucuccucc

SEQ ID NO: 18492 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuacgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuucaccgcccacauggacauccgcggccucacccaggacgacaccgccaucuacuucugcgcccgccagaaguucgcccgcggcgaccagggcugguucuucgaccucuggggccgcggcacccucaucgucgucuccucc

SEQ ID NO: 18493 - RNA, 375 nt, Artificial Sequence
  derived and/or modified sequence opt2 from anti-HIV-1_HeavyChain
cagguccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccucc

SEQ ID NO: 18494 - RNA, 375 nt, Artificial Sequence
  derived and/or modified sequence opt2 from anti-HIV-1_HeavyChain
caggcccaccucgagcaguccggcuccggcgucaagaaggucggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuccaccgcccacauggacauccgcggccucacccaggacgacaccgccaccuacuucugcgcccgccagaaguucgcccgcggcgaccagggcugguucuucgaccucuggggccgcggcacccucaucgucgucuccucc

SEQ ID NO: 18495 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucuccggcgccgucaacuucggcccccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccucc

SEQ ID NO: 18496 - RNA, 375 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuccaccgcccacauggacauccgcggccucacccaggacgacaccgccaccuacuucugcgcccgccagaaguucgagcgcggcggccagggcuggaucuucgaccucuggggccgcggcacccucaucgccgucuccucc

SEQ ID NO: 18497 - RNA, 375 nt, Artificial Sequence
  derived and/or modified sequence opt2 from anti-HIV-1_HeavyChain
caggcccaccucgagcaguccggcuccggcguccgcaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccucc

SEQ ID NO: 18498 - RNA, 375 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgagcgcaccgagcucauccacuggguccgccaggcccccggccgcggccucgaguggaucggcugggucaaggccgucuccggcgccgucaacuacggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccucc

SEQ ID NO: 18499 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucuccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcgcccucaucgucgucuccucc

SEQ ID NO: 18500 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcuccgccuacuuccgccaccgcgucucccucacccgcgaccgcgaccucuucaccgcccacauggacauccgcggccucacccagggcgacaccgccaccuacuucugcgcccgccagaaguucuacaagggcggccagggcugguacuucgaccucuggggccgcggcacccucaucgucgucuccucc

SEQ ID NO: 18501 - RNA, 375 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgagcgcaccgagcucaucuacuggguccgccaggcccccggccgcggccucgaguggaucggcugggucaagaccgucuccggcaccgucaacuucggcucccucgacuuccgccaccgcgucucccucacccgcgaccgcgaccucuccaccgcccacauggacauccgcggccucacccaggacgacaccgccaccuacuucugcgcccgccagaaguucgcccgcggcgaccagggcugguucuucgaccucuggggccgcggcacccucaucgucgucuccucc

SEQ ID NO: 18502 - RNA, 375 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgccuccuccgacuuccgcaaccgcaucucccucucccgcgaccgcgaccucuccaccgcccacauggacauccgcggccucacccaggacgacaccgccaccuacuucugcgcccgccagaaguucuacgccggcggccagggcugguacuucgaccucuggggccgcggcacccucaucgucgucuccucc

SEQ ID NO: 18503 - RNA, 375 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgagcgcaccgagcucauccacuggguccgccaggcccccggccagggccucgaguggaucggcugggucaaggccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccucc

SEQ ID NO: 18504 - RNA, 375 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgagcgcaccgagcucaucuacuggguccgccaggcccccggccgcggccucgaguggaucggcugggucaagaccgucuccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccucc

SEQ ID NO: 18505 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacgccgccaccuacuucugcgcccgccagaaguucgagcgcggcggccagggcugguacuucgaccucuggggccgcggcacccucaucgucgucuccucc

SEQ ID NO: 18506 - RNA, 375 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgagcgcaccgagcucauccacuggguccgccaggcccccggccgcggccucgaguggaucggcugggucaaggccgucuccggcgccgucaacuacggcucccucgacuuccgccaccgcgucucccucacccgcgaccgcgaccucuucaccgcccacauggacauccgcggccucacccaggacgacaccgccaccuacuucugcgcccgccagaaguucuacgccggcggccagggcugguacuucgaccucuggggccgcggcacccucaucgucgucuccucc

SEQ ID NO: 18507 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaucgucuccggcgccgucaacuucggcucccccaacuuccgccagcgcgucucccucacccgcgaccgcgaccucuucgccgcccacauggacauccgcggccucacccagggcgacaccgccaccuacuucugcgcccgccagaaguucgagcgcggcggccagggcuggaucuucgaccucuggggccgcggcacccucaucgccgucuccucc

SEQ ID NO: 18508 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucgcccagggcgacaccgccaccuacuucugcgcccgccagaaguucgagcgcggcggccagggcugguacuucgaccucuggggccgcggcacccucaucgucgucuccucc

SEQ ID NO: 18509 - RNA, 375 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgccuccuccgacuuccgcaaccgcaucucccucucccgcgaccgcgaccucuccaccgcccacauggacauccgcggccucacccaggacgacaccgccaccuacuucugcgcccgccagaaguucgagcgcggcggccagggcugguacuucgaccucuggggccgcggcacccucaucgucgucuccucc

SEQ ID NO: 18510 - RNA, 375 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgccucccucgacuuccgcaaccgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccucc

SEQ ID NO: 18511 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaucgucuccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccucc

SEQ ID NO: 18512 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaaguccgagcucauccacuggguccgccgcgcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccucc

SEQ ID NO: 18513 - RNA, 375 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccagcgcgucucccucacccgcgaccgcgaccucuucaccgcccacauggacauccgcggccucacccagggcgacaccgccaccuacuucugcgcccgccagaaguucgagcgcggcggccagggcuggaucuucgaccucuggggccgcggcacccucaucgccgucuccucc

SEQ ID NO: 18514 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcugguccuccgaggacaucuucgagcgcaccgagcucauccacuggguccgccaggcccccggccagggccucgaguggaucggcugggucaagaccgucaccggcgccgucaacuucggcucccucgacuuccgccaccgcaucucccucacccgcgaccgcgaccucuucaccgcccacauggacauccgcggccucacccagggcgacaccgccaccuacuucugcgcccgccagaaguucuacaagggcggccagggcugguacuucgaccucuggggccgcggcacccucaucgucgucuccucc

SEQ ID NO: 18515 - RNA, 375 nt, Artificial Sequence
  derived and/or modified sequence opt2 from anti-HIV-1_HeavyChain
caggcccaccucgagcaguccggcuccggcgucaagaagcccggcaccuccguccgcgucuccugcuggaccuccgaggacaucuucgagaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccucc

SEQ ID NO: 18516 - RNA, 375 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgccucccucgacuuccgcaaccgcaucucccucucccgcgaccgcgaccucuccaccgcccacauggacauccgcggccucacccaggacgacaccgccaccuacuucugcgcccgccagaaguucuacgccggcggccagggcugguacuucgaccucuggggccgcggcacccucaucgucgucuccucc

SEQ ID NO: 18517 - RNA, 375 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgagcgcaccggccucauccacuggguccgccaggcccccggccagggccucgaguggaucggcugggucaaggccgucuccggcgccgucaacuacggcucccucgacuuccgccaccgcgucucccucacccgcgaccgcgaccucuucaccgcccacauggacauccgcggccucacccaggacgacaccgccaccuacuucugcgcccgccagaaguucgcccgcggcgaccagggcugguucuucgaccucuggggccgcggcacccucaucgucgucuccucc

SEQ ID NO: 18518 - RNA, 375 nt, Artificial Sequence
  derived and/or modified sequence opt2 from anti-HIV-1_HeavyChain
caggcccaccucgagcaguccggcuccggcgucaagaagcccggcaccuccguccgcgucuccugcuggaccuccgaggacgucuucgagcgcaccgagcucauccacuggguccgccaggcccccggccagggccucgaguggaucggcugggucaagaccgucaucggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccucc

SEQ ID NO: 18519 - RNA, 372 nt, Artificial Sequence
  derived and/or modified sequence opt2 from anti-HIV-1_HeavyChain
caggcccaccucgagcaguccggcgccggcgucaagaagcccggcgccuccguccgcgucuccugcuggaccuccgaggacaucuucaagaccgagcucauccacuggguccgccaggcccccggccagggccucgaguggaucggcugggucaagaucgucuccggcgccgucaacuucggcucccccaacuuccgccagcgcgucucccucacccgcgaccgcgaccucuucaccgcccacauggacauccgcggccucacccagggcgacaccgccaccuacuucugcgcccgccagaaguucgagcgcggcggccagggcuggaucuucgaccucuggggccgcggcacccucaucgccgucuccucc

SEQ ID NO: 18520 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucuccggcgccgucaacuucggcucccccgacuuccgccaccgcgucucccucacccgcgaccgcgaccucuucaccgcccacauggacauccgcggccucacccagggcgacaccgccaccuacuucugcgcccgccagaaguucgcccgcggcgaccagggcugguucuucgaccucuggggccgcggcacccucaucgucgucuccucc

SEQ ID NO: 18521 - RNA, 375 nt, Artificial Sequence
  derived and/or modified sequence opt2 from anti-HIV-1_HeavyChain
caggcccaccucgagcaguccggcuccggcgucaagcgccccggcgccuccguccgcgucuccugcuggaccuccgaggacaucuucgagaccaccgagcucauccacuggguccgccaggcccccggccagggccucgaguggaucggcugggucaagaccgucuccggcgccgucaacuucggcucccucaacuuccgccaccgcaucucccucacccgcgaccgcgaccucuucaccgcccacauggacauccgcggccucacccagggcgacaccgccaccuacuucugcgcccgccagaaguucgcccgcggcgaccagggcugguucuucgaccucuggggccgcggcacccucaucgucgucuccucc

SEQ ID NO: 18522 - RNA, 375 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuccaccgcccacauggacauccgcggccucacccaggacgacaccgccaucuacuucugcgcccgccagaaguucgcccgcggcgaccagggcugguucuucgaccucuggggccgcggcacccucaucgucgucuccucc

SEQ ID NO: 18523 - RNA, 375 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgagcgcaccgagcucauccacuggguccgccaggcccccggccagggccucgaguggaccggcugggucaaggccgucuccggcgccgucaacuacggcucccucgacuuccgccaccgcgucucccucacccgcgaccgcgaccucuccaccgcccacauggacauccgcggccucacccaggacgacaccgccaccuacuucugcgcccgccagaaguucgcccgcggcgaccagggcugguucuucgaccucuggggccgcggcacccucaucgucgucuccucc

SEQ ID NO: 18524 - RNA, 375 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuucaccgcccacauggacauccgcggccccacccaggacgacaccgccaccuacuucugcgcccgccagaaguucgcccgcggcgaccagggcugguucuucgaccucuggggccgcggcacccucaucgucgucuccucc

SEQ ID NO: 18525 - RNA, 375 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuccaccgcccacauggacauccgcggccucacccagggcgacaccgccaccuacuucugcgcccgccagaaguucgagcgcggcggccagggcugguacuucgaccucuggggccgcggcacccucaucgucgucuccucc

SEQ ID NO: 18526 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcugguccuccgaggacaucuucgagcgcaccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccucc

SEQ ID NO: 18527 - RNA, 375 nt, Artificial Sequence
  derived and/or modified sequence opt2 from anti-HIV-1_HeavyChain
cgccacaccuggaacgaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcaccgucaacuucggcucccucaacuuccgccagcgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccucc

SEQ ID NO: 18528 - RNA, 375 nt, Artificial Sequence
  derived and/or modified sequence opt2 from anti-HIV-1_HeavyChain
caggcccaccucgagcaguccggcgccggcgucaagcgccccggcgccuccguccgcgucuccugcuggaccuccgaggacaucuucgagaccaccgagcucauccacuggguccgccaggcccccggccagggccucgaguggaucggcugggucaagaccgucuccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccucc

SEQ ID NO: 18529 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaaggccgucuccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccucc

SEQ ID NO: 18530 - RNA, 375 nt, Artificial Sequence
  derived and/or modified sequence opt2 from anti-HIV-1_HeavyChain
caggcccaccucggcaccauccucggccucgaguccaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccuccauccucgcccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccucc

SEQ ID NO: 18531 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgccaccgcgucucccucacccgcgaccgcgcccucuucaccgcccacauggacauccgcggccucacccagggcgacaccgccaccuacuucugcgcccgccagaaguucgcccgcggcgaccagggcugguucuucgaccucuggggccgcggcacccucaucgucgucuccucc

SEQ ID NO: 18532 - RNA, 375 nt, Artificial Sequence
  derived and/or modified sequence opt2 from anti-HIV-1_HeavyChain
cgcguccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccucc

SEQ ID NO: 18533 - RNA, 375 nt, Artificial Sequence
  derived and/or modified sequence opt2 from anti-HIV-1_HeavyChain
caggcccaccucgagcaguccggcgccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgccagcgcgucucccucacccgcgaccgcgaccucuccaccgcccacauggacauccgcggccucacccaggacgacaccgccaccuacuucugcgcccgccagaaguucgcccgcggcgaccagggcugguucuucgaccucuggggccgcggcacccucaucgucgucuccucc

SEQ ID NO: 18534 - RNA, 375 nt, Artificial Sequence
  derived and/or modified sequence opt2 from anti-HIV-1_HeavyChain
cagguccagcucguccaguccggcgccgaggucaagcgccccggcgccuccgucaaggucuccugcuggaccuccgaggacaucuucgagcgcaccgagcucauccacuggguccgccaggcccccggccagggccucgaguggaucggcugggucaagaccgucuccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccucc

SEQ ID NO: 18535 - RNA, 375 nt, Artificial Sequence
  derived and/or modified sequence opt2 from anti-HIV-1_HeavyChain
cgccacgaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaucgucuccggcgccgucaacuucggcucccccaacuuccgccagcgcgucucccucacccgcgaccgcgaccucuucaccgcccacauggacauccgcggccucacccagggcgacaccgccaccuacuucugcgcccgccagaaguucgagcgcggcggccagggcuggaucuucgaccucuggggccgcggcacccucaucgccgucuccucc

SEQ ID NO: 18536 - RNA, 375 nt, Artificial Sequence
  derived and/or modified sequence opt2 from anti-HIV-1_HeavyChain
cgccacaccugggagcaggucugguccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccucc

SEQ ID NO: 18537 - RNA, 375 nt, Artificial Sequence
  derived and/or modified sequence opt2 from anti-HIV-1_HeavyChain
cgccacaccuggaacaaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuccaccgcccacauggacauccgcggccucacccaggacgacaccgccaccuacuucugcgcccgccagaaguucgcccgcggcgaccagggcugguucuucgaccucuggggccgcggcacccucaucgucgucuccucc

SEQ ID NO: 18538 - RNA, 375 nt, Artificial Sequence
  derived and/or modified sequence opt2 from anti-HIV-1_HeavyChain
cgccacaccugggagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucgagcgcggcggccagggcuggaucuucgaccucuggggccgcggcacccucaucgccgucuccucc

SEQ ID NO: 18539 - RNA, 375 nt, Artificial Sequence
  derived and/or modified sequence opt2 from anti-HIV-1_HeavyChain
caggcccaccucgagcaguccggcuccggcgucaagcgccccggcgccuccguccgcgucuccugcuggaccuccgaggacaucuucgagaccaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuccaccgcccacauggacauccgcggccucacccaggacgacaccgccaccuacuucugcgcccgccagaaguucgcccgcggcgaccagggcugguucuucgaccucuggggccgcggcacccucaucgucgucuccucc

SEQ ID NO: 18540 - RNA, 375 nt, Artificial Sequence
  derived and/or modified sequence opt2 from anti-HIV-1_HeavyChain
cgccacgaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccucc

SEQ ID NO: 18541 - RNA, 375 nt, Artificial Sequence
  derived and/or modified sequence opt2 from anti-HIV-1_HeavyChain
cgccacaccugggagcaguccggcuccggcgucaagaagcucggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuccaccgcccacauggacauccgcggccucacccaggacgacaccgccaccuacuucugcgcccgccagaaguucgcccgcggcgaccagggcugguucuucgaccucuggggccgcggcacccucaucgucgucuccucc

SEQ ID NO: 18542 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugccucgccuccgaggacaucuucgagaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccucc

SEQ ID NO: 18543 - RNA, 375 nt, Artificial Sequence
  derived and/or modified sequence opt2 from anti-HIV-1_HeavyChain
caggcccaccucgagcaguccggcgccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccucc

SEQ ID NO: 18544 - RNA, 375 nt, Artificial Sequence
  derived and/or modified sequence opt2 from anti-HIV-1_HeavyChain
cgccacaccugggagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccucc

SEQ ID NO: 18545 - RNA, 375 nt, Artificial Sequence
  derived and/or modified sequence opt2 from anti-HIV-1_HeavyChain
cgccacaccugggagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccacggcgacaccgccaccuacuucugcgcccgccagaaguucgagcgcggcggccagggcugguacuucgaccucuggggccgcggcacccucaucgucgucuccucc

SEQ ID NO: 18546 - RNA, 375 nt, Artificial Sequence
  derived and/or modified sequence opt2 from anti-HIV-1_HeavyChain
cgccacaccugggagcaguccggcuccggcgucaagaagcucggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccucc

SEQ ID NO: 18547 - RNA, 375 nt, Artificial Sequence
  derived and/or modified sequence opt2 from anti-HIV-1_HeavyChain
caggcccaccucgagcaguccggcgccggcgucaagaagcucggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuucaccgcccacauggacauccgcggccucacccaggacgacaccgccaccuacuucugcgcccgccagaaguucgcccgcggcgaccagggcugguucuucgaccucuggggccgcggcacccucaucgucgucuccucc

SEQ ID NO: 18548 - RNA, 375 nt, Artificial Sequence
  derived and/or modified sequence opt2 from anti-HIV-1_HeavyChain
caggcccaccucgagcaguccggcuccggcgucaagaagcccggcgccuccgucgaggucuccugcuggaccuccgaggacaucuucgagcgcaccgagcucauccacuggguccgccaggcccccggccagggccucgaguggaucggcugggucaagaccgucuccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgcccgcggcgaccagggcugguucuucgaccucuggggccgcggcacccucaucgucgucuccucc

SEQ ID NO: 18549 - RNA, 372 nt, Artificial Sequence
  derived and/or modified sequence opt2 from anti-HIV-1_HeavyChain
caggcccaccucgagcaguccggcgccggcgucaagaagcucggcgccuccguccgcgucuccugcuggaccuccgaggacaucuucaagaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuccaccgcccacauggacauccgcggccucacccaggacgacaccgccaccuacuucugcgcccgccagaaguucgcccgcggcgaccagggcugguucuucgaccucuggggccgcggcacccucaucgucgucuccucc

SEQ ID NO: 18550 - RNA, 375 nt, Artificial Sequence
  derived and/or modified sequence opt2 from anti-HIV-1_HeavyChain
cgccacaccugggagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccucc

SEQ ID NO: 18551 - RNA, 375 nt, Artificial Sequence
  derived and/or modified sequence opt2 from anti-HIV-1_HeavyChain
cgccacaccugggagcgcaucugguccggcgucaagaagcccggcgccuccguccgcgucuccugcuggaccuccgaggacaucuucgagcgcaccgagcucauccacuggguccgccaggcccccggccagggccucgaguggaucggcugggucaagaucgucuccggcgccgucaacuucggcucccccaacuuccgccagcgcgucucccucacccgcgaccgcgaccucuucaccgcccacauggacauccgcggccucacccagggcgacaccgccaccuacuucugcgcccgccagaaguucgagcgcggcggccagggcuggaucuucgaccucuggggccgcggcacccucaucgccgucuccucc

SEQ ID NO: 18552 - RNA, 375 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuccaccgcccacauggacauccgccgccucacccaggacgacaccgccaccuacuucugcgcccgccagaaguucgcccgcggcgaccagggcugguucuucgaccucuggggccgcggcacccucaucgucgucuccucc

SEQ ID NO: 18553 - RNA, 375 nt, Artificial Sequence
  derived and/or modified sequence opt2 from anti-HIV-1_HeavyChain
cgccacaccgucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccucc

SEQ ID NO: 18554 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcuccuccgacuuccgccagcgcgucucccucacccccgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccucc

SEQ ID NO: 18555 - RNA, 375 nt, Artificial Sequence
  derived and/or modified sequence opt2 from anti-HIV-1_HeavyChain
cgccacaccgucgagcaguccggcuccggcgucaagaaggucggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuucaccgcccacauggacauccgcggccucacccaggacgacaccgccaucuacuucugcgcccgccagaaguucgcccgcggcgaccagggcugguucuucgaccucuggggccgcggcacccucaucgucgucuccucc

SEQ ID NO: 18556 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcugggccuccgaggacaucuucgagcgcaccgagcucauccacuggguccgccaggcccccggccagggccucgaguggaucggcugggucaagaccgucuccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccucc

SEQ ID NO: 18557 - RNA, 375 nt, Artificial Sequence
  derived and/or modified sequence opt2 from anti-HIV-1_HeavyChain
cgccacaccugggagcaggucugguccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccucc

SEQ ID NO: 18558 - RNA, 375 nt, Artificial Sequence
  derived and/or modified sequence opt2 from anti-HIV-1_HeavyChain
cgccacaccuggcgccaguccggcuccggcgucaagaagcucggcgccuccguccgcgucuccugcuggaccuccgaggacaucuucgagcgcaccgagcucauccacuggguccgccaggcccccggccagggccucgaguggaucggcugggucaaggccgucuccggcgucgucaacuacggcucccucgacuuccgccaccgcgucucccucacccgcgaccgcgaccucuccaccgcccacauggacauccgcggccucacccaggacgacaccgccaccuacuucugcgcccgccagaaguucgcccgcggcgaccagggcugguucuucgaccucuggggccgcggcacccucaucgucgucuccucc

SEQ ID NO: 18559 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccggcgacaucuucgagcgcaccgagcucauccacuggguccgccaggcccccggccagggccucgaguggaucggcugggucaagaucgucuccggcgccgucaacuucggcucccccaacuuccgccagcgcgucucccucacccgcgaccgcgaccucuucaccgcccacauggacauccgcggccucacccagggcgacaccgccaccuacuucugcgcccgccagaaguucgagcgcggcggccagggcuggaucuucgaccucuggggccgcggcacccucaucgccgucuccucc

SEQ ID NO: 18560 - RNA, 375 nt, Artificial Sequence
  derived and/or modified sequence opt2 from anti-HIV-1_HeavyChain
cgccacaccgucgagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccucc

SEQ ID NO: 18561 - RNA, 375 nt, Artificial Sequence
  derived and/or modified sequence opt2 from anti-HIV-1_HeavyChain
caggcccaccucgagcaguccggcuccggcgucaagaagcgcugggccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuucaccgcccacauggacauccgcggccucacccaggacgacaccgccaccuacuucugcgcccgccagaaguucgcccgcggcgaccagggcugguucuucgaccucuggggccgcggcacccucaucgucgucuccucc

SEQ ID NO: 18562 - RNA, 375 nt, Artificial Sequence
  derived and/or modified sequence opt2 from anti-HIV-1_HeavyChain
cgccacaccgucgagcaguccggcuccggcgucaagcgccccggcgccuccguccgcgucuccugcuggaccuccgaggacaucuucgagaccaccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccucc

SEQ ID NO: 18563 - RNA, 375 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcggccucuucaccgcccacauggacauccgcggccucacccaggacgacaccgccaccuacuucugcgcccgccagaaguucgcccgcggcgaccagggcugguucuucgaccucuggggccgcggcacccucaucgucgucuccucc

SEQ ID NO: 18564 - RNA, 375 nt, Artificial Sequence
  derived and/or modified sequence opt2 from anti-HIV-1_HeavyChain
cagguccaccucgagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgccaacuucggcuccuccgacuuccgccagcgcgucucccucacccccgaccgcgaccucuucaccgcccacauggacauccgcggccucacccagggcgacaccgccaccuacuucugcgcccgccagaaguucuacaagggcggccagggcugguacuucgaccucuggggccgcggcacccucaucgucgucuccucc

SEQ ID NO: 18565 - RNA, 375 nt, Artificial Sequence
  derived and/or modified sequence opt2 from anti-HIV-1_HeavyChain
caggcccaccucgagcaguccggcgccggcgucaagaagcccggcgccuccguccgcgucuccugcuggaccuccgaggacaucuucgacaccaccgagcucauccacuggguccgccaggcccccggccagggccucgaguggaucggcugggucaagaucgucuccggcgccgucaacuucggcucccccaacuuccgccagcgcgucucccucacccgcgaccgcgaccucuucaccgcccacauggacauccgcggccucacccagggcgacaccgccaccuacuucugcgcccgccagaaguucgagcgcggcggccagggcuggaucuucgaccucuggggccgcggcacccucaucgccgucuccucc

SEQ ID NO: 18566 - RNA, 375 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccucccgcgacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuccaccgcccacauggacauccgcggccucacccaggacgacaccgccaccuacuucugcgcccgccagaaguucgcccgcggcgaccagggcugguucuucgaccucuggggccgcggcacccucaucgucgucuccucc

SEQ ID NO: 18567 - RNA, 375 nt, Artificial Sequence
  derived and/or modified sequence opt2 from anti-HIV-1_HeavyChain
caggcccaccucgagcaguccggcuccggcgucaagaagcucggcgccuccguccgcgucuccugccucgccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuccaccgcccacauggacauccgcggccucacccaggacgacaccgccaccuacuucugcgcccgccagaaguucgcccgcggcgaccagggcugguucuucgaccucuggggccgcggcacccucaucgucgucuccucc

SEQ ID NO: 18568 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggcccuccgaggacaucuucgagcgcaccgagcucauccacuggguccgccaggcccccggccagggccucgaguggaucggcugggucaagaccgucaccggcaccgucaacuucggcucccucaacuuccgccagcgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccucc

SEQ ID NO: 18569 - RNA, 375 nt, Artificial Sequence
  derived and/or modified sequence opt2 from anti-HIV-1_HeavyChain
cgcgcccaccucgagcaguccggcuccgaguggaagaagcucggcgccuccguccgcgucuccugcuggaccuccggcgacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuucaccgcccacauggacauccgcggccucacccaggacgacaccgccaccuacuucugcgcccgccagaaguucgcccgcggcgaccagggcugguucuucgaccucuggggccgcggcacccucaucgucgucuccucc

SEQ ID NO: 18570 - RNA, 375 nt, Artificial Sequence
  derived and/or modified sequence opt2 from anti-HIV-1_HeavyChain
cgccacaccgucgagcaguccggcuccggcgucaagaagcucggcgccuccgucaacgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuucaccgcccacauggacauccgcggccucacccaggacgacaccgccaccuacuucugcgcccgccagaaguucgcccgcggcgaccagggcugguucuucgaccucuggggccgcggcacccucaucgucgucuccucc

SEQ ID NO: 18571 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagcccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccucc

SEQ ID NO: 18572 - RNA, 375 nt, Artificial Sequence
  derived and/or modified sequence opt2 from anti-HIV-1_HeavyChain
cgccacaccuggaacaaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccucc

SEQ ID NO: 18573 - RNA, 375 nt, Artificial Sequence
  derived and/or modified sequence opt2 from anti-HIV-1_HeavyChain
caggcccacuccgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaucgucuccggcgccgucaacuucggcucccccaacuuccgccagcgcgucucccucacccgcgaccgcgaccucuucaccgcccacauggacauccgcggccucacccagggcgacaccgccaccuacuucugcgcccgccagaaguucgagcgcggcggccagggcuggaucuucgaccucuggggccgcggcacccucaucgccgucuccucc

SEQ ID NO: 18574 - RNA, 375 nt, Artificial Sequence
  derived and/or modified sequence opt2 from anti-HIV-1_HeavyChain
caggcccaccucgagcaguccggcgccggcgucaagcgccccggcgccuccguccgcgucuccugcuggaccuccgaggacaucuucgagaccaccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccucc

SEQ ID NO: 18575 - RNA, 375 nt, Artificial Sequence
  derived and/or modified sequence opt2 from anti-HIV-1_HeavyChain
ggccacaccugggagcaguccggcgccggcgucaagaagcucggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuucaccgcccacauggacauccgcggccucacccaggacgacaccgccaucuacuucugcgcccgccagaaguucgcccgcggcgaccagggcugguucuucgaccucuggggccgcggcacccucaucgucgucuccucc

SEQ ID NO: 18576 - RNA, 375 nt, Artificial Sequence
  derived and/or modified sequence opt2 from anti-HIV-1_HeavyChain
ggcacccccggcuccgaguccggcuccggcgucaagaagcucggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuccaccgcccacauggacauccgcggccucacccaggacgacaccgccaccuacuucugcgcccgccagaaguucgcccgcggcgaccagggcugguucuucgaccucuggggccgcggcacccucaucgucgucuccucc

SEQ ID NO: 18577 - RNA, 375 nt, Artificial Sequence
  derived and/or modified sequence opt2 from anti-HIV-1_HeavyChain
ggcacccccggcuccgaguccggcuccggcgucaagaugcccggcgccuccguccgcgucuccugcuggaccuccgaggacaucuucgagcgcaccgagcucauccacuggguccgccaggcccccggccagggccucgaguggaucggcugggucaagaccgucuccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccucc

SEQ ID NO: 18578 - RNA, 375 nt, Artificial Sequence
  derived and/or modified sequence opt2 from anti-HIV-1_HeavyChain
cgccacaccugggagcaguccggcgccggcgucaagaagcccggcgccuccguccgcgucuccugcuggaccuccgaggacaucuucgagcgcaccgagcucauccacuggguccgccaggcccccggccagggccucgaguggaucggcugggucaagaccgucuccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccucc

SEQ ID NO: 18579 - RNA, 375 nt, Artificial Sequence
  derived and/or modified sequence opt2 from anti-HIV-1_HeavyChain
ggcacccccggcaacaaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccucc

SEQ ID NO: 18580 - RNA, 375 nt, Artificial Sequence
  derived and/or modified sequence opt2 from anti-HIV-1_HeavyChain
caggcccaccucgagcaguccggcgccggcgucaagaagcccggcgccuccguccgcgucuccugcugguccuccgaggacaucuucgagcgcaccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccucc

SEQ ID NO: 18581 - RNA, 375 nt, Artificial Sequence
  derived and/or modified sequence opt2 from anti-HIV-1_HeavyChain
ggcacccccggcaacaaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcuggaucuucgaccucuggggccgcggcacccucaucgccgucuccucc

SEQ ID NO: 18582 - RNA, 375 nt, Artificial Sequence
  derived and/or modified sequence opt2 from anti-HIV-1_HeavyChain
ggcacccccggcaacaaguccggcuccggcgucaagaagcccggcgccuccguccgcgucuccugcugguccuccgaggacaucuucgagcgcaccgagcucauccacuggguccgccaggcccccggccagggccucgaguggaucggcugggucaagaccgucaccggcgccgucaacuucggcucccucgacuuccgccaccgcaucucccucacccgcgaccgcgaccucuucaccgcccacauggacauccgcggccucacccagggcgacaccgccaccuacuucugcgcccgccagaaguucgagcgcggcggccagggcuggaucuucgaccucuggggccgcggcacccucaucgccgucuccucc

SEQ ID NO: 18583 - RNA, 375 nt, Artificial Sequence
  derived and/or modified sequence opt2 from anti-HIV-1_HeavyChain
caggcccaccucgagcaguccgccuccggcgucaagcgccccggcggcuggguccgcgucuccugcuggaccuccgaggacaucuucgagcgcuccgagcucaucuacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccucc

SEQ ID NO: 18584 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccuccuccggcgccgucaacuucggcucccccaacuuccgcacccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccucc

SEQ ID NO: 18585 - RNA, 375 nt, Artificial Sequence
  derived and/or modified sequence opt2 from anti-HIV-1_HeavyChain
caggcccaccucgagcaguccggcgccggcgucaagaagcccggcgccuccguccgcgucuccugcuggaccuccgaggacaucuucgagcgcaccgagcucauccacuggguccgccaggcccccggccagggccucgaguggaucggcugggucaagaccgucuccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccucc

SEQ ID NO: 18586 - RNA, 375 nt, Artificial Sequence
  derived and/or modified sequence opt2 from anti-HIV-1_HeavyChain
cgccacaccugggagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccucc

SEQ ID NO: 18587 - RNA, 375 nt, Artificial Sequence
  derived and/or modified sequence opt2 from anti-HIV-1_HeavyChain
ggcaccaccuggaacaaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccucc

SEQ ID NO: 18588 - RNA, 375 nt, Artificial Sequence
  derived and/or modified sequence opt2 from anti-HIV-1_HeavyChain
cgccacaccuggaacgaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccucc

SEQ ID NO: 18589 - RNA, 375 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccggcaacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuccaccgcccacauggacauccgcggccucacccaggacgacaccgccaccuacuucugcgcccgccagaaguucgcccgcggcgaccagggcugguucuucgaccucuggggccgcggcacccucaucgucgucuccucc

SEQ ID NO: 18590 - RNA, 378 nt, Artificial Sequence
  derived and/or modified sequence opt2 from anti-HIV-1_HeavyChain
cgcugcuccauggagcagcccggcugguccgagaagcccggcgccuccgucacccucuccugcaagaccgccgacgaggacgucuucgacgccgccuacaugcacuggguccgccaggcccccggccagaccuucgaguggcucggcuggaugaagcccgucaccggcgccgucuccuacgcccgcaaguuccagggccgcgucuccuucuacaugacccgcgagcucggcauggccuacauggaccuccgcaaccuccgcuucgacgacaccgccgucuacuucugcgcccgcaagaccgccggcgacgucuccggcgacaaccgcggcuacuucuucgaccucuggggccgcggcucccgcgucaucgucuccucc

SEQ ID NO: 18591 - RNA, 375 nt, Artificial Sequence
  derived and/or modified sequence opt2 from anti-HIV-1_HeavyChain
cgccacaccuccgagcaguccggcuccggcgucaagaagcccggcgccuccguccgcgucuccugcuggaccuccgaggacaucuucgagcgcuccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguacuacgccggcggccagggcugguacuucgaccucuggggccgcggcacccucaucgucgucuccucc

SEQ ID NO: 18592 - RNA, 375 nt, Artificial Sequence
  derived and/or modified sequence opt2 from anti-HIV-1_HeavyChain
cgccacaccgucgagcaguccggcgccggcgucaagaagcccggcgccuccguccgcgucuccugcuggaccuccgaggacaucuucgagcgcaccgagcucauccacuggguccgccaggcccccggccagggccucgaguggaucggcugggucaagaccgucuccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccucc

SEQ ID NO: 18593 - RNA, 375 nt, Artificial Sequence
  derived and/or modified sequence opt2 from anti-HIV-1_HeavyChain
ggcacccccuggaacgaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccucc

SEQ ID NO: 18594 - RNA, 375 nt, Artificial Sequence
  derived and/or modified sequence opt2 from anti-HIV-1_HeavyChain
cgccacgaccucgagcccuccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccucgacuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucguc

SEQ ID NO: 18595 - RNA, 375 nt, Artificial Sequence
  derived and/or modified sequence opt2 from anti-HIV-1_HeavyChain
cgccacaccgucgagcaguccggcuccggcgucaagaagcucggcgccuccguccgcgucuccugccucgccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuccaccgcccacauggacauccgcggccucacccaggacgacaccgccaccuacuucugcgcccgccagaaguucgcccgcggcgaccagggcugguucuucgaccucuggggccgcggcacccucaucgucgucuccucc

SEQ ID NO: 18596 - RNA, 375 nt, Artificial Sequence
  derived and/or modified sequence opt2 from anti-HIV-1_HeavyChain
caggcccaccucgagcaguccggcuccgaguccaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccucc

SEQ ID NO: 18597 - RNA, 375 nt, Artificial Sequence
  derived and/or modified sequence opt2 from anti-HIV-1_HeavyChain
ggcacccccggcuccgaguccgccuccggcguccgccgccccggcgccuccguccgcgucuccugcuggaccuccgaggacaucuucgagcgcuccgagcucaucuacuggguccgccaggcccccggccgcggccucgaguggaucggcuggaucaagcucgucuccggcgccgucaacuucggcuccgucgacuuccgcgaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccucc

SEQ ID NO: 18598 - RNA, 375 nt, Artificial Sequence
  derived and/or modified sequence opt2 from anti-HIV-1_HeavyChain
cagguccaccucgagcaguccggcuccggcgucaagaagcccggcgccuccguccgcgucuccugcuggaccuccgaggacaucuucgagaaguccgagcucauccaguggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccucc

SEQ ID NO: 18599 - RNA, 375 nt, Artificial Sequence
  derived and/or modified sequence opt2 from anti-HIV-1_HeavyChain
ggcacccccggcuccgaguccggcuccggcgucaagaaggucggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuucaccgcccgcauggacauccgcggccucacccaggacgacaccgccaucuacuucugcgcccgccagaaguucgcccgcggcgaccagggcugguucuucgaccucuggggccgcggcacccucaucgucgucuccucc

SEQ ID NO: 18600 - RNA, 375 nt, Artificial Sequence
  derived and/or modified sequence opt2 from anti-HIV-1_HeavyChain
ggcacccccggcuccgaguccggcuccggcgucaagcgccccggcgccuccguccgcgucuccugcuggaccuccgaggacaucuucgagaccaccgagcucauccacuggguccgccaggcccccggccagggccucgaguggaucggcugggucaagaccgucuccggcgccgucaacuucggcucccucaacuuccgccaccgcgucucccucacccgcgaccgcgaccucuccaccgcccacauggacauccgcggccucacccaggacgacaccgccaccuacuucugcgcccgccagaaguucgcccgcggcgaccagggcugguucuucgaccucuggggccgcggcacccucaucgucgucuccucc

SEQ ID NO: 18601 - RNA, 372 nt, Artificial Sequence
  derived and/or modified sequence opt2 from anti-HIV-1_HeavyChain
cgcgcccaccucgagcaguccggcgccggcgucaagaagcccggcggcuggguccgcgucuccugcuggaccuccgaggacaucuucaagaccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccucc

SEQ ID NO: 18602 - RNA, 378 nt, Artificial Sequence
  derived and/or modified sequence opt2 from anti-HIV-1_HeavyChain
cagguccagcucaugcaguccggcgccgaggucaagcgccccggcgccuccgucaagaucuccugcaccgccuccggcuucacccucaccgaccacuacaugcacuggguccgccaggcccccggccagaccuucgaguggcucggcuggaugaagcccgucaccggcgccgucaacuacgcccgcaaguuccagggccgcgucuccuucuaccgcacccgcgagcucggcaucgccuacauggaccuccgcaaccuccgcuucgacgacaccgccgucuacuucugcgcccgcaagaccgccggcgacgucuccggcgacaagcgcggcuucuucuucgaccucuggggccgcggcucccgcgucaucgucuccucc

SEQ ID NO: 18603 - RNA, 378 nt, Artificial Sequence
  derived and/or modified sequence opt2 from anti-HIV-1_HeavyChain
cagguccagcucguccaguccggcgccgaggucaagaagcccggcgccuccgucaaggucuccugcaaggccuccggcuacaacuucaccggcuacuaccuccacuggguccgccaggcccccggccagaccuucgaguggcucggcuggaugaagcccgucaccggcgccgucuccuacgcccgcaaguuccagggccgcgucuccuucuacaugacccgcgagcucggcauggccuacauggaccuccgcaaccuccgcuucgacgacaccgccgucuacuucugcgcccgcaagaccgccggcgacgucuccggcgacaaccgcggcuacuucuucgaccucuggggccgcggcucccgcgucaucgucuccucc

SEQ ID NO: 18604 - RNA, 375 nt, Artificial Sequence
  derived and/or modified sequence opt2 from anti-HIV-1_HeavyChain
ggcacccccggcuccaaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccucc

SEQ ID NO: 18605 - RNA, 378 nt, Artificial Sequence
  derived and/or modified sequence opt2 from anti-HIV-1_HeavyChain
cagguccagcucguccaguccggcgccgagcucaagaagcccggcgccuccgucaaggucuccugcgaggccuccggcuacuccuucaccgaccaccacauccacuggguccgccaggcccccggccagggccucgaguggcucggcuggaugaaccccaacaacggcgacaccgccuacgcccagaccuuccucggccgcgucaccaugacccgcgacaccuccaucaacaccgccuacauggagcucucccgccucaccuccgacgacaccgccgucuacuucugcgcccgcaagaccgccggcgacgucuccggcgacaagcgcggcuucuucuucgaccucuggggccgcggcucccgcgucaucgucuccucc

SEQ ID NO: 18606 - RNA, 378 nt, Artificial Sequence
  derived and/or modified sequence opt2 from anti-HIV-1_HeavyChain
caggucuacauguccucccgcggcggcaugaagaagcccggcgccuccaugaccgucuccugcaagaccgccgacgaggacaucuucgacgccgccuacaugcacuggguccgccaggcccccggccagaccuucgaguggcucggcuggaugaagcccgucaccggcgccgucaacuacgcccgccaguuccagggccgcgucuccuucuaccgcacccgcgagcucggcaucgccuacauggaccuccgcgaccucaaguucgacgacaccgccgucuacuucugcgcccgcaagaccaagggcgacgucuccggcgacgaccgcggcuucuucuucgaccucuggggccgcggcacccgcgucaucgucuccucc

SEQ ID NO: 18607 - RNA, 378 nt, Artificial Sequence
  derived and/or modified sequence opt2 from anti-HIV-1_HeavyChain
cagguccagcucguccaguccggcgccgaggucaagaagcccggcgccuccgucaaggucuccugcaaggccuccggcuacaccuucaccgccuacuacaugcacuggcuccgccaggcccccggccagggccucgaguggaugggcuggaucaacccccacuccggcggcaccaacuucgcccagaaguuccagggccgcgucaccaugacccgcgacaccuccaucaccaccgccuacauggagcucucccgccuccgcuccgacgacaccgccaccuacuucugcgcccgccagaaguucgccucccgcuacuccggcgaccagggcuccuacuucgaccucuggggccgcggcacccucaucgucgucuccucc

SEQ ID NO: 18608 - RNA, 375 nt, Artificial Sequence
  derived and/or modified sequence opt2 from anti-HIV-1_HeavyChain
cgcgcccaccucgagcaguccggcgccggcgucaagaagcucggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuucaccgcccacauggacauccgcggccucacccaggacgacaccgccaccuacuucugcgcccgccagaaguucgcccgcggcgaccagggcugguucuucgaccucuggggccgcggcacccucaucgucgucuccucc

SEQ ID NO: 18609 - RNA, 378 nt, Artificial Sequence
  derived and/or modified sequence opt2 from anti-HIV-1_HeavyChain
cagguccgccucguccaguccggcgccgacgucaagcagcccggcgccuccgucaaggucuccugcaaggccuccggcuacaccuucaccgacuacuacaugcacuggguccgccaggcccccggccagaccuucgaguggcucggcuggaugaagcccgucaccggcgccgucuccuacgcccgcaaguuccagggccgcgucuccuucuacaugacccgcgagcucggcauggccuacauggaccuccgcaaccuccgcuucgacgacaccgccgucuacuucugcgcccgcaagaccgccggcgacgucuccggcgacaaccgcggcuacuucuucgaccucuggggccgcggcucccgcgucaucgucuccucc

SEQ ID NO: 18610 - RNA, 378 nt, Artificial Sequence
  derived and/or modified sequence opt2 from anti-HIV-1_HeavyChain
caggcccaccucggcaacaaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccucc

SEQ ID NO: 18611 - RNA, 381 nt, Artificial Sequence
  derived and/or modified sequence opt2 from anti-HIV-1_HeavyChain
caggucuacauggagcaguccggcggcggcgucaagaagcccggcgccuccgucacccucuccugcaagaccgccgacgaggacgucuucgacgccgccuacaugcacuggguccgccaggcccccggccagaccuucgaguggcucggcuggaugaagcccgucaccggcgccgucaacuacgcccgcaaguuccagggccgcgucuccuucuaccgcacccgcgagcucggcaucgccuacauggaccuccgcaaccuccgcuucgacgacaccgccgucuacuucugcacccgcaagaccgccggcgacgucuccggcgacaagcgcggcuucuucuucgaccucuggggccgcggcucccgcgucaucgucuccucc

SEQ ID NO: 18612 - RNA, 381 nt, Artificial Sequence
  derived and/or modified sequence opt2 from anti-HIV-1_HeavyChain
caggucuacgucgagcagcccggcggcggcgucaagaagcccggcgccuccgucacccucuccugcaagaccgccgacgaggacgucuucgacgccaccuacaugcacuggguccgccaggcccccggccagaccuucgaguggcucggcuggaugaagcccgucaccggcgccgucaacuacgcccgcaaguuccagggccgcgucuccuucuaccgcacccgcgagcucggcaucgccuacauggaccuccgcaaccuccgcuucgacgacaccgccgucuacuucugcgcccgcaagaccgccggcgacgucuccggcgacaagcgcggcuucuucuucgaccucuggggccgcggcucccgcgucaucgucuccucc

SEQ ID NO: 18613 - RNA, 381 nt, Artificial Sequence
  derived and/or modified sequence opt2 from anti-HIV-1_HeavyChain
caggucuacauggagcaggccggcgucgaggucgagaagcccggcgccuccgucacccucuccugcaagaccgccgacgaggacgucuucgacgccgccuacaugcacuggguccgccaggcccccggccagaccuucgaguggcucggcuggaugaagcccgucaccggcgccgucuccuacgcccgcaaguuccagggccgcgucuccuucuacaugacccgcgagcucggcauggccuacauggaccuccgcaaccuccgcuucgacgacaccgccgucuacuucugcgcccgcaagaccgccggcgacgucuccggcgacaaccgcggcuacuucuucgaccucuggggccgcggcucccgcgucaucgucuccucc

SEQ ID NO: 18614 - RNA, 381 nt, Artificial Sequence
  derived and/or modified sequence opt2 from anti-HIV-1_HeavyChain
caggucuacauggagcaggccggcgccggcgucaagaagcccggcgccuccgucacccucuccugcaagaccgccgacgaggacgucuucgacgccgccuacaugcacuggguccgccaggcccccggccagaccuucgaguggcucggcuggaugaagcccgucaccggcgccgucuccuacgcccgcaaguuccagggccgcgucuccuucuacaugacccgcgagcucggcauggccuacauggaccuccgcaaccuccgcuucgacgacaccgccgucuacuucugcgcccgcaagaccgccggcgacgucuccggcgacaaccgcggcuacuucuucgaccucuggggccgcggcucccgcgucaucgucuccucc

SEQ ID NO: 18615 - RNA, 381 nt, Artificial Sequence
  derived and/or modified sequence opt2 from anti-HIV-1_HeavyChain
cagguccacauggagcaggccggcgccggcgucaagaagcccggcgccuccgucacccucuccugcaagaccgccgacgaggacgucuucgacgccgccuacaugcacuggguccgccaggcccccggccagaccuucgaguggcucggcuggaugaagcccgucaccggcgccgucaacuacgcccgcaaguuccagggccgcgucuccuucuaccgcacccgcgagcucggcaucgccuacauggaccuccgcaaccuccgcuucgacgacaccgccgucuacuucugcgcccgcaagaccgccggcgacgucuccggcgacaagcgcggcuucuucuucgaccucuggggccgcggcucccgcgucaucgucuccucc

SEQ ID NO: 18616 - RNA, 381 nt, Artificial Sequence
  derived and/or modified sequence opt2 from anti-HIV-1_HeavyChain
caggucuacauggagcaggccggcgccgaggucaagaagcccggcgccuccgucacccucuccugcgagaccgccgacgaggacgucuucgacgccgccuacaugcacuggguccgccaggcccccggccagaccuucgaguggcucggcuggaugaagcccgucaccggcgccgucaacuacgcccgcaaguuccagggccgcgucuccuucuaccgcacccgcgagcucggcaucgccuacauggaccuccgcaaccuccgcuucgacgacaccgccgucuacuucugcgcccgcaagaccgccggcgacgucuccggcgacaagcgcggcuucuucuucgaccucuggggccgcggcucccgcgucaucgucuccucc

SEQ ID NO: 18617 - RNA, 381 nt, Artificial Sequence
  derived and/or modified sequence opt2 from anti-HIV-1_HeavyChain
caggucuacauggagcagcccggcggcggcgucaagaagcccggcgccuccgucacccucuccugcaagaccgccgacgaggacgucuucgacgccgccuacaugcacuggguccgccaggcccccggccagaccuucgaguggcucggcuggaugaagcccgucaccggcgccgucaacuacgcccgcaaguuccagggccgcgucuccuucuaccgcacccgcgagcucggcaucgccuacauggaccuccgcaaccuccgcuucgacgacaccgccgucuacuucugcgcccgcaagaccgccggcgacgucuccggcgacaagcgcggcuucuucuucgaccucuggggccgcggcucccgcgucaucgucuccucc

SEQ ID NO: 18618 - RNA, 372 nt, Artificial Sequence
  derived and/or modified sequence opt2 from anti-HIV-1_HeavyChain
gccacccccuggaacaaguccggcuccggcgucaagaagcccggcgccuccguccgcgucuccugcuggaccuccgaggacaucuucgagcgcaccgagcucucccucguccgccaggcccccggccagggccucgaguggaucggcuggaugaagaccgucaccggcgccgucaacuucggcucccccaacuuccgccacggcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccucc

SEQ ID NO: 18619 - RNA, 381 nt, Artificial Sequence
  derived and/or modified sequence opt2 from anti-HIV-1_HeavyChain
caggucuacauggagcaggccggcgccggcaugaagaagcccggcgccuccaugaccgccuccugcaagaccgccgacgaggacaucuucgacgccgccuacaugcacuggguccgccaggcccccggccagaccuucgaguggcucggcuggaugaagcccgucaccggcgccgucaacuacgcccgccaguuccagggccgcgucuccuucuaccgcacccgcgagcucggcaucgccuacauggaccuccgcgaccucaaguucgacgacaccgccgucuacuucugcgcccgcaagaccaagggcgacgucuccggcgacgaccgcggcuucuucuucgaccucuggggccgcggcacccgcgucaucgucuccucc

SEQ ID NO: 18620 - RNA, 378 nt, Artificial Sequence
  derived and/or modified sequence opt2 from anti-HIV-1_HeavyChain
cagguccagcucguccaguccggcgccgaggucaagaagcccggcgccuccgucaaggucuccugcaaggccuccggcuacaccuucaccggcuacuacaugcacuggguccgccaggcccccggccagaccuucgaguggcucggcuggaugaagcccgucaccggcgccgucaacuacgcccgccaguuccagggccgcgucuccuucuaccgcacccgcgagcucggcaucgccuacauggaccuccgcgaccucaaguucgacgacaccgccgucuacuucugcgcccgcaagaccaaggccgacgucuccggcgacgaccgcggcuucuucuucgaccucuggggccgcggcacccgcgucaucgucuccucc

SEQ ID NO: 18621 - RNA, 381 nt, Artificial Sequence
  derived and/or modified sequence opt2 from anti-HIV-1_HeavyChain
cgcgucuacauggagcaggccggcgccggcgucaagaagcccggcgccuccgucacccucuccugcaagaccgccgacgaggacgucuucgacgccgccuacaugcacuggguccgccaggcccccggccagaccuucgaguggcucggcuggaugaagcccgucaccggcgccgucuccuacgcccgcaaguuccagggccgcgucuccuucaccaugacccgcgagcucggcauggccuacauggaccuccgcaaccuccgcuucgacgacaccgccgucuacuucugcgcccgcaagaccgccggcgacgucuccggcgacaaccgcggcuacuucuucgaccucuggggccgcggcucccgcgucaucgucuccucc

SEQ ID NO: 18622 - RNA, 381 nt, Artificial Sequence
  derived and/or modified sequence opt2 from anti-HIV-1_HeavyChain
caggucuacauggagcaguccggcggcggcgucaagaagcccggccccuccgucacccucuccugcaagaccgccgacgaggacgucuucgacgccgccuacaugcacuggguccgccaggcccccggccagaccuucgaguggcucggcuggaugaagcccgucaccggcgccgucaacuacgcccgcaaguuccagggccgcgucuccuucuaccgcacccgcgagcucggcaucgccuacauggaccuccgcaaccuccgcuucgacgacaccgccgucuacuucugcgcccgcaagaccgccggcgacgucuccggcgacaagcgcggcuucuucuucgaccucuggggccgcggcucccgcgucaucgucuccucc

SEQ ID NO: 18623 - RNA, 378 nt, Artificial Sequence
  derived and/or modified sequence opt2 from anti-HIV-1_HeavyChain
cagguccagcucguccaguccggcgccgaggucaagaagcccggcgccuccgucaaggucuccugcaaggccuccggcuacaccuucaccggcuacuacauccacuggaugcgccaggcccccggccagggccucgaguggaugggcuggaucaaccccaacuccggcgccgucuccuacgcccgcaaguuccagggccgcgucuccuuccuccacgaccagggcauccgcauggccuacauggaccuccgcaaccuccgcuucgacgacaccgccgucuacuucugcgcccgcaagaccgccggcgacgucuccggcgacaaccgcggcuacuucuucgaccucuggggccgcggcucccgcgucaucgucuccucc

SEQ ID NO: 18624 - RNA, 381 nt, Artificial Sequence
  derived and/or modified sequence opt2 from anti-HIV-1_HeavyChain
cagguccacauggagcaggccggcgucgaggucgagaagcccggcgccuccgucacccucuccugcaagaccgccgacgaggacgucuucgacgccgccuacaugcacuggguccgccaggcccccggccagaccuucgaguggcucggcuggaugaagcccgucaccggcgccgucaacuacgcccgcaaguuccagggccgcgucuccuucuaccgcacccgcgagcucggcaucgccuacauggaccuccgcaaccuccgcuucgacgacaccgccgucuacuucugcgcccgcaagaccgccggcgacgucuccggcgacaagcgcggcuucuucuucgaccucuggggccgcggcucccgcgucaucgucuccucc

SEQ ID NO: 18625 - RNA, 381 nt, Artificial Sequence
  derived and/or modified sequence opt2 from anti-HIV-1_HeavyChain
caggucuacauggagcaggccggcgccggcgucaagaagcccggcgccuccgccacccucuccugcaagaccgccgacgaggacgucuucgacgccgccuacaugcacuggguccgccaggcccccggccagaccuucgaguggcucggcuggaugaagcccgucaccggcgccgucuccuacgcccgcaaguuccagggccgcgucuccuucuacaugacccgcgagcucggcauggccuacauggaccuccgcaaccuccgcuucgacgacaccgccgucuacuucugcgcccgcaagaccgccggcgacgucuccggcgacaaccgcggcuacuucuucgaccucuggggccgcggcucccgcgucaucgucuccucc

SEQ ID NO: 18626 - RNA, 375 nt, Artificial Sequence
  derived and/or modified sequence opt2 from anti-HIV-1_HeavyChain
ggccacgaccucgagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaaggccgucuccggcgccgucaacuacggcucccucgacuuccgccaccgcgucucccucacccgcgaccgcgaccucuucaccgcccacauggacauccgcggccucacccaggacgacaccgccaucuacuucugcgcccgccagaaguucgcccgcggcgaccagggcugguucuucgaccucuggggccgcggcacccucaucgucgucuccucc

SEQ ID NO: 18627 - RNA, 378 nt, Artificial Sequence
  derived and/or modified sequence opt2 from anti-HIV-1_HeavyChain
caggcccaccgcggcaccaucuggggccucgaggucaagaagcccggcggcuggguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccucc

SEQ ID NO: 18628 - RNA, 381 nt, Artificial Sequence
  derived and/or modified sequence opt2 from anti-HIV-1_HeavyChain
cagguccacauggagcaggccggcgccggcgucgagaagcccggcgccuccgucacccucuccugcaagaccgccgacgaggacgucuucgacgccgccuacaugcacuggguccgccaggcccccggccagaccuucgaguggcucggcuggaugaagcccgucaccggcgccgucuccuacgcccgcaaguuccagggccgcgucuccuucuacaugacccgcgagcucggcauggccuacauggaccuccgcaaccuccgcuucgacgacaccgccgucuacuucugcgcccgcaagaccgccggcgacgucuccggcgacaaccgcggcuacuucuucgaccucuggggccgcggcucccgcgucaucgucuccucc

SEQ ID NO: 18629 - RNA, 381 nt, Artificial Sequence
  derived and/or modified sequence opt2 from anti-HIV-1_HeavyChain
caggucuacauggagcaguccggcggcggcgucaagaagcccggcgccuccgucacccucuccugcaagaccgccgacgaggacgucuucgacgccgccuacaugcacuggguccgccaggcccccggccagaccuucgaguggcucggcuggaugaagcccgucaccggcgccgucuccuacgcccgcaaguuccagggccgcgucuccuucuacaugacccgcgagcucggcauggccuacauggaccuccgcaaccuccgcuucgacgacaccgccgucuacuucugcgcccgcaagaccgccggcgacgucuccggcgacaaccgcggcuacuucuucgaccucuggggccgcggcucccgcgucaucgucuccucc

SEQ ID NO: 18630 - RNA, 381 nt, Artificial Sequence
  derived and/or modified sequence opt2 from anti-HIV-1_HeavyChain
caggucuacauggagcaguccggcggcggcgucaagaagcccggcgccuccgucacccucuccugcaagaccgccgacgaggacgucuucgacgccgccuacaugcacuggguccgccaggcccccggccagaccuucgaguggcucggcuggaugaagcccgucaccggcgccgucaacuacgcccgcaaguuccagggccgcgucuccuucuaccgcacccgcgagcucggcaucgccuacauggaccuccgcaaccuccgcuucgacgacaccgccgucuacuucugcgcccgcaagaccgccggcgacgucuccggcgacaagcgcggcuucuucuucgaccucuggggccgcggcucccgcgucaucgucuccucc

SEQ ID NO: 18631 - RNA, 381 nt, Artificial Sequence
  derived and/or modified sequence opt2 from anti-HIV-1_HeavyChain
gaggucuacauggagcaguccggcggcggcgucaagaagcccggcgccuccgucacccucuccugcaagaccgccuccgaggacgucuucgacgccgccuacaugcacuggguccgccaggcccccggccagaccuucgaguggcucggcuggaugaagcccgucaccggcgccgucaacuacgcccgcaaguuccagggccgcgucuccuucuaccgcacccgcgagcucggcaucgccuacauggaccuccgcaaccuccgcuucgacgacaccgccgucuacuucugcgcccgcaagaccgccggcgacgucuccggcgacaagcgcggcuucuucuucgaccucuggggccgcggcucccgcgucaucgucuccucc

SEQ ID NO: 18632 - RNA, 381 nt, Artificial Sequence
  derived and/or modified sequence opt2 from anti-HIV-1_HeavyChain
cagguccagcucguccaguccggcgccgaggucaagaagcccggcgccuccgucacccucuccugcaagaccgccgacgaggacgucuucgacgccgccuacaugcacuggguccgccaggcccccggccagaccuucgaguggcucggcuggaugaagcccgucaccggcgccgucuccuacgcccgcaaguuccagggccgcgucuccuucuacaugacccgcgagcucggcauggccuacauggaccuccgcaaccuccgcuucgacgacaccgccgucuacuucugcgcccgcaagaccgccggcgacgucuccggcgacaaccgcggcuacuucuucgaccucuggggccgcggcucccgcgucaucgucuccucc

SEQ ID NO: 18633 - RNA, 381 nt, Artificial Sequence
  derived and/or modified sequence opt2 from anti-HIV-1_HeavyChain
caggucuucauggagcaguccggcggcggcaugaagaagcccggcgccuccaugaccgucuccugcaagaccgccgacgaggacgucuucgacgccgccuacaugcacuggguccgccaggcccccggccagaccuucgaguggcucggcuggaugaagcccgucaccggcgccgucuccuacgcccgcaaguuccagggccgcgucuccuucuacaugacccgcgagcucggcauggccuacauggaccuccgcaaccuccgcuucgacgacaccgccgucuacuucugcgcccgcaagaccgccggcgacgucuccggcgacaaccgcggcuacuucuucgaccucuggggccgcggcucccgcgucaucgucuccucc

SEQ ID NO: 18634 - RNA, 381 nt, Artificial Sequence
  derived and/or modified sequence opt2 from anti-HIV-1_HeavyChain
caggucuacauggagcaggccggcggcggcaugaagaagcccggcgccuccaugaccgucuccugcaagaccgccgacgaggacaucuucgacgccgccuacaugcacuggguccgccaggcccccggccagaccuucgaguggcucggcuggaugaagcccgucaccggcgccgucaacuacgcccgccgcuuccagggccgcgucuccuucuaccgcacccgcgagcucggcaucgccuacauggaccuccgcgaccucaaguucgacgacaccgccgucuacuucugcgcccgcaagaccaagggcgacgucuccggcgacgaccgcggcuucuucuucgaccucuggggccgcggcacccgcgucaucgucuccucc

SEQ ID NO: 18635 - RNA, 381 nt, Artificial Sequence
  derived and/or modified sequence opt2 from anti-HIV-1_HeavyChain
caggucuacauggagcaggccggcgccggcgucaagaagcccggcgccuccgucacccucuccugcaaggccgccgacgaggacgucuucgacgccgccuacaugcacuggguccgccaggcccccggccagaccuucgaguggcucggcuggaugaagcccgucaccggcgccgucuccuacgcccgcaaguuccagggccgcgucuccuucuacaugacccgcgagcucggcauggccuacauggaccuccgcaaccuccgcuucgacgacaccgccgucuacuucugcgcccgcaagaccgccggcgacgucuccggcgacaaccgcggcuacuucuucgaccucuggggccgcggcucccgcgucaucgucuccucc

SEQ ID NO: 18636 - RNA, 381 nt, Artificial Sequence
  derived and/or modified sequence opt2 from anti-HIV-1_HeavyChain
caggucuucauggagcaggccggcgccggcaugaagaagcccggcgccuccaugaccgucuccugcaagaccgccgacgaggacaucuucgacgccgccuacaugcacuggguccgccaggcccccggccagaccuucgaguggcucggcuggaugaagcccgucaccggcgccgucaacuacgcccgccaguuccagggccgcgucuccuucuaccgcacccgcgagcucggcaucgccuacauggaccuccgcgaccucaaguucgacgacaccgccgucuacuucugcgcccgcaagaccaagggcgacgucuccggcgacgaccgcggcuucuucuucgaccucuggggccgcggcacccgcgucaucgucuccucc

SEQ ID NO: 18637 - RNA, 381 nt, Artificial Sequence
  derived and/or modified sequence opt2 from anti-HIV-1_HeavyChain
caggucuacauggagcagcccggcggcgaggucaagaagcccggcgccuccgucacccucuccugcaagaccgccgacgaggacgucuucgacgccgccuacaugcacuggguccgccaggcccccggccagaccuucgaguggcucggcuggaugaagcccgucaccggcgccgucaacuacgcccgcaaguuccagggccgcgucuccuucuacaugacccgcgagcucggcauggccuacauggaccuccgcaaccuccgcuucgacgacaccgccgucuacuucugcgcccgcaagaccgccggcgacgucuccggcgacaaccgcggcuacuucuucgaccucuggggccgcggcucccgcgucaucgucuccucc

SEQ ID NO: 18638 - RNA, 381 nt, Artificial Sequence
  derived and/or modified sequence opt2 from anti-HIV-1_HeavyChain
cagguccacauggagcaggccggcgccggcgucaagaagcccggcgccuccgucacccucuccugcaagaccgccgacgaggacgucuucgacgccgccuacaugcacuggguccgccaggcccccggccagaccuucgaguggcucggcuggaugaagcccgucaccggcgccgucuccuacgcccgcaaguuccagggccgcgucuccuucuacaugacccgcgagcucggcauggccuacauggaccuccgcaaccuccgcuucgacgacaccgccgucuacuucugcgcccgcaagaccgccggcgacgucuccggcgacaaccgcggcuacuucuucgaccucuggggccgcggcucccgcgucaucgucuccucc

SEQ ID NO: 18639 - RNA, 381 nt, Artificial Sequence
  derived and/or modified sequence opt2 from anti-HIV-1_HeavyChain
caggucuacauggagcaggccggcggcggcgucaagaagcccggcgccuccgucacccucuccugcaagaccgccgacgaggacgucuucgacgccgccuacaugcacuggguccgccaggcccccggccagaccuucgaguggcucggcuggaugaagcccgucaccggcgccgucaacuacgcccgcaaguuccagggccgcgucuccuucuaccgcacccgcgagcucggcaucgccuacauggaccuccgcaaccuccgcuucgacgacaccgccgucuacuucugcgcccgcaagaccgccggcgacgucuccggcgacaagcgcggcuucuucuucgaccucuggggccgcggcccccgcgucaucgucuccucc

SEQ ID NO: 18640 - RNA, 381 nt, Artificial Sequence
  derived and/or modified sequence opt2 from anti-HIV-1_HeavyChain
cagguccagcucguccaguccggcgccgaggucaagaagcccggcgccuccgucaaggucuccugcaaggccuccggccacaccuucaccaacuacgacaucaacuggguccgccaggcccccggccagggccucgaguggaucggcugggucaagaucgucuccggcaccgucaacuucgccucccucgacuuccgcaaccgcaucucccucucccgcgaccgcgaccucuccaccgccuacauggacauccgcggccucacccaggacgacaccgccaccuacuucugcgcccgccagaaguucgccucccgcuacuccggcgaccagggcuccuacuucgaccucuggggccgcggcacccucaucgucgucuccucc

SEQ ID NO: 18641 - RNA, 381 nt, Artificial Sequence
  derived and/or modified sequence opt2 from anti-HIV-1_HeavyChain
caggucuacauggagcaggccggcggcggcaugaagaagcccggcgccuccaugaccgucuccugcaagaccgccgacgaggacaucuucgacgccgccuacaugcacuggguccgccaggcccccggccagaccuucgaguggcucggcuggaugaagcccgucaccggcgccgucaacuacgcccgccaguuccagggccgcgucuccuucuaccgcacccgcgagcucggcaucgccuacaccgaccuccgcgaccucaaguucgacgacaccgccgucuacuucugcgcccgcaagaccaagggcgacgucuccggcgacgaccgcggcuucuucuucgaccucuggggccgcggcacccgcgucaucgucuccucc

SEQ ID NO: 18642 - RNA, 381 nt, Artificial Sequence
  derived and/or modified sequence opt2 from anti-HIV-1_HeavyChain
caggucuacauggagcaggccggcggcggcgucaagaagcccggcgccuccgucacccucuccugcaagaccgccgacgaggacgucuucgacgccgccuacaugcacuggguccgccaggcccccggccagaccuucgaguggcucggcuggaugaagcccgucaccggcgccgucaacuacgcccgccaguuccagggccgcgucuccuucuaccgcacccgcgagcucggcaucgccuacauggaccuccgcgaccucaaguucgacgacaccgccgucuacuucugcgcccgcaagaccaagggcgacgucuccggcgacgaccgcggcuucuucuucgaccucuggggccgcggcacccgcgucaucgucuccucc

SEQ ID NO: 18643 - RNA, 381 nt, Artificial Sequence
  derived and/or modified sequence opt2 from anti-HIV-1_HeavyChain
caggucuacauggagcaggccggcggcggcgucaagaagcccggcgccuccgucacccucuccugcaagaccgccgacgaggacgucuucgacgccgccuacaugcacuggguccgccaggcccccggccagaccuucgaguggcccggcuggaugaagcccgucaccggcgccgucaacuacgcccgcaaguuccagggccgcgucuccuucuaccgcacccgcgagcucggcaucgccuacauggaccuccgcaaccuccgcuucgacgacaccgccgucuacuucugcgcccgcaagaccgccggcgacgucuccggcgacaagcgcggcuucuucuucgaccucuggggccgcggcucccgcgucaucgucuccucc

SEQ ID NO: 18644 - RNA, 381 nt, Artificial Sequence
  derived and/or modified sequence opt2 from anti-HIV-1_HeavyChain
caggucuacauggagcaggccggcggcggcgucaagaagcccggcgccuccgccacccucuccugcaagaccgccgacgaggacgucuucgacgccgccuacaugcacuggguccgccaggcccccggccagaccuucgaguggcucggcuggaugaagcccgucaccggcgccgucuccuacgcccgcaaguuccagggccgcgucuccuucuacaugacccgcgagcucggcauggccuacauggaccuccgcaaccuccgcuucgacgacaccgccgucuacuucugcgcccgcaagaccgccggcgacgucuccggcgacaaccgcggcuacuucuucgaccucuggggccgcggcucccgcgucaucgucuccucc

SEQ ID NO: 18645 - RNA, 381 nt, Artificial Sequence
  derived and/or modified sequence opt2 from anti-HIV-1_HeavyChain
caggucuacauggagcaggccggcggcggcgucaagaagcccggcgccuccgucacccucuccugcaagaccgccgacgaggacgucuucgacgccgccuacaugcgcuggguccgccaggcccccggccagaccuucgaguggcucggcuggaugaagcccgucaccggcgccgucaacuacgcccgcaaguuccagggccgcgucuccuucuaccgcacccgcgagcucggcaucgccuacauggaccuccgcaaccuccgcuucgacgacaccgccgucuacuucugcgcccgcaagaccgccggcgacgucuccggcgacaagcgcggcuucuucuucgaccucuggggccgcggcucccgcgucaucgucuccucc

SEQ ID NO: 18646 - RNA, 381 nt, Artificial Sequence
  derived and/or modified sequence opt2 from anti-HIV-1_HeavyChain
cagguccagcucguccaguccggcgccgaggucaagaagcccggcgccuccgucaaggucuccugccgcgccuccggcuacaccuucggcaaccacgccaucuccuggguccgccaggcccccggccagggccucgaguggaugggcuggauccgccccaagaccggcgcccgcaaccaggcccgccaguuccagccccgcaucucccucacccgcgaccgcgcccucuccaccgccuaccucgaccucaacucccucaccuccgccgacuccggcaccuacuucugcgcccgccagaccuucaagcccgacuucuacuucgccgaccagggcugguccuucaaccucuggggccgcggcgcccacuucaucgucuccucc

SEQ ID NO: 18647 - RNA, 381 nt, Artificial Sequence
  derived and/or modified sequence opt2 from anti-HIV-1_HeavyChain
caggucuacauggagcaggccggcggcggcgucaagaagcccggcgccuccgucacccucuccugcaagaccgccgacgaggacgucuucgacgccgccuacaugcacuggguccgccaggcccccggccagaccuucgaguggcucggcuggaugaagcccgucaccggcgccgucuccuacgcccgcaaguuccagggccgcgucuccuucuacaugacccgcgagcucggcauggccuacauggaccuccgcaaccuccgcuucgacgacaccgccgucuacuucugcgcccgcaagaccgccggcgacgucuccggcgacaaccgcggcuacuucuucgaccucuggggccccggcucccgcgucaucgucuccucc

SEQ ID NO: 18648 - RNA, 381 nt, Artificial Sequence
  derived and/or modified sequence opt2 from anti-HIV-1_HeavyChain
caggucuacauggagcaggccggcgccggcgucaagaagcccggcgccuccgucacccucuccugcaagaccgccgacgaggacgucuucgacgccgccuacaugcacuggguccgccaggcccccggccagaccuucgaguggcucggcuggaugaagcccgucaccggcgccgucaacuacgcccgcaaguuccagggccgcgucuccuucuaccgcacccgcgagcucggcaucgccuacauggaccuccgcaaccuccgcuucgacgacaccgccgucuacuucugcgcccgcaagaccgccggcgacgucuccggcgacaagcgcggcuucuucuucgaccucuggggccgcggcucccgcgucaucgucuccucc

SEQ ID NO: 18649 - RNA, 381 nt, Artificial Sequence
  derived and/or modified sequence opt2 from anti-HIV-1_HeavyChain
cagguccacauggagcaggccggcggcggcgucaagaagcccggcgccuccgucacccucuccugcaagaccgccgacgaggacgucuucgacgccgccuacaugcacuggguccgccaggcccccggccagaccuucgaguggcucggcuggaugaagcccgucaccggcgccgucaacuacgcccgcaaguuccagggccgcgucuccuucuaccgcacccgcgagcucggcaucgccuacauggaccuccgcaaccuccgcuucgacgacaccgccgucuacuucugcgcccgcaagaccgccggcgacgucuccggcgacaagcgcggcuucuucuucgaccucuggggccgcggcucccgcgucaucgucuccucc

SEQ ID NO: 18650 - RNA, 381 nt, Artificial Sequence
  derived and/or modified sequence opt2 from anti-HIV-1_HeavyChain
caggucuacauggagcaggccggcgacggcaugaagaagcccggcgccuccaugaccgucuccugcaagaccgccgacgaggacaucuucgacgccgccuacaugcacuggguccgccaggcccccggccagaccuucgaguggcucggcuggaugaagcccgucaccggcgccgucaacuacgcccgccaguuccagggccgcgucuccuucuaccgcacccgcgagcucggcaucgccuacauggaccuccgcgaccucaaguucgacgacaccgccgucuacuucugcgcccgcaagaccaagggcgacgucuccggcgacgaccgcggcuucuucuucgaccucuggggccgcggcacccgcgucaucgucuccucc

SEQ ID NO: 18651 - RNA, 381 nt, Artificial Sequence
  derived and/or modified sequence opt2 from anti-HIV-1_HeavyChain
cagguccagcucguccaguccggcgccgaggucaagaagcccggcgccuccgucacccucuccugcaagaccgccgacgaggacgucuucgacgccgccuacaugcacuggguccgccaggcccagggccagaccuucgaguggcucggcuggaugaagcccgucaccggcgccgucaacuacgcccgcaaguuccagggccgcgucuccuucuaccgcacccgcgagcucggcaucgccuacauggaccuccgcaaccuccgcuucgacgacaccgccgucuacuucugcgcccgcaagaccgccggcgacgucuccggcgacaagcgcggcuucuucuucgaccucuggggccgcggcucccgcgucaucgucuccucc

SEQ ID NO: 18652 - RNA, 381 nt, Artificial Sequence
  derived and/or modified sequence opt2 from anti-HIV-1_HeavyChain
caggucuacauggagcaggccggcggcggcgucaagaagcccggcgccuccgucacccucuccugcaagaccgccgacgaggacgucuucgacgccgccuacaugcacuggguccgccaggcccccggccagaccuucgaguggcucggcuggaugaagcccgucaccggcgccgucaacuacgcccgcaaguuccagggccgcgucuccuucuaccgcacccgcgagcucggcaucgccuacauggaccuccgcaaccuccgcuucgacgacaccgccgucuacuucugcgcccgcaagaccgccggcgacgucuccggcgacaagcgcggcuucuucuucgaccucuggggccgcggcucccaggucaucgucuccucc

SEQ ID NO: 18653 - RNA, 381 nt, Artificial Sequence
  derived and/or modified sequence opt2 from anti-HIV-1_HeavyChain
cagguccagcucguccaguccggcgccgagguccgcaagcccggcgccuccgucaaggucuccugcaaggccuccggcuacaccuucaccaacuacuacaugcacuggguccgccaggcccccggccagggccucgaguggaucggcugggucaagaucgucuccggcaccgucaacuucgccucccucgacuuccgcaaccgcaucucccucucccgcgaccgcgaccucuccaccgccuacauggacauccgcggccucacccaggacgacaccgccaccuacuucugcgcccgccagaaguucgccucccgcuacuccggcgaccagggcuccuacuucgaccucuggggccgcggcacccucaucgucgucuccucc

SEQ ID NO: 18654 - RNA, 381 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcaccgucaacuacgcccgcaaguuccagggccgcgucuccuucuaccgcacccgcgagcucggcaucgccuacauggaccuccgcaaccuccgcuucgacgacaccgccgucuacuucugcgcccgcaagaccgccggcgacgucuccggcgacaagcgcggcuucuucuucgaccucuggggccgcggcucccgcgucaucgucuccucc

SEQ ID NO: 18655 - RNA, 381 nt, Artificial Sequence
  derived and/or modified sequence opt2 from anti-HIV-1_HeavyChain
cucauccaccucgcccaguccggcgccgaggucaagaagcccggcgccuccgucacccucuccugcaagaccgccgacgaggacgucuucgacgccgccuacaugcacuggguccgccaggcccccggccagaccuucgaguggcucggcuggaugaagcccgucaccggcgccgucuccuacgcccgcaaguuccagggccgcgucuccuucuacaugacccgcgagcucggcauggccuacauggaccuccgcaaccuccgcuucgacgacaccgccgucuacuucugcgcccgcaagaccgccggcgacgucuccggcgacaaccgcggcuacuucuucgaccucuggggccgcggcucccgcgucaucgucuccucc

SEQ ID NO: 18656 - RNA, 381 nt, Artificial Sequence
  derived and/or modified sequence opt2 from anti-HIV-1_HeavyChain
cagguccagcucguccaguccggcgccgaggucaagaagcccggcgccuccaugaccgucuccugcaagaccgccgacgaggacaucuucgacgccgccuacaugcacuggguccgccaggcccccggccagaccuucgaguggcucggcuggaugaagcccgucaccggcgccgucaacuacgcccgccaguuccagggccgcgucuccuucuaccgcacccgcgagcucggcaucgccuacauggaccuccgcgaccucaaguucgacgacaccgccgucuacuucugcgcccgcaagaccaagggcgacgucuccggcgacgaccgcggcuucuucuucgaccucuggggccgcggcacccgcgucaucgucuccucc

SEQ ID NO: 18657 - RNA, 381 nt, Artificial Sequence
  derived and/or modified sequence opt2 from anti-HIV-1_HeavyChain
caggucuacauggagcagggccgcggcggcgucaagaagcccggcgccuccgucacccucuccugcaagaccgccgacgaggacgucuucgacgccgccuacaugcacuggguccgccaggcccccggccagaccuucgaguggcucggcuggaugaagcccgucaccggcgccgucaacuacgcccgcaaguuccagggccgcgucuccuucuaccgcacccgcgagcucggcaucgccuacauggaccuccgcaaccuccgcuucgacgacaccgccgucuacuucugcgcccgcaagaccgccggcgacgucuccggcgacaagcgcggcuucuucuucgaccucuggggccgcggcucccgcgucaucgucuccucc

SEQ ID NO: 18658 - RNA, 381 nt, Artificial Sequence
  derived and/or modified sequence opt2 from anti-HIV-1_HeavyChain
caggucuacauggagcaggccggcggcggcaugaagaagcccggcgccuccaugaccgucuccugcaagaccgccgacgaggacgucuucgacgccgccuacaugcacuggguccgccaggcccccggccagaccuucgaguggcucggcuggaugaagcccgucaccggcgccgucaacuacgcccgccaguuccagggccgcgucuccuucuaccgcacccgcgagcucggcaucgccuacauggaccuccgcgaccucaaguccgacgacaccgccgucuacuucugcgcccgcaagaccgccggcgacgucuccggcgacaagcgcggcuucuucuucgaccucuggggccgcggcucccgcgucaucgucuccucc

SEQ ID NO: 18659 - RNA, 381 nt, Artificial Sequence
  derived and/or modified sequence opt2 from anti-HIV-1_HeavyChain
cagguccagcucguccaguccggcgccgaggucaagaagcccggcuccuccaucaaggucuccugcaaggccuccggcgacaccaucucccgcuacgccaucaacuggguccgccaggcccccggccagggccucgaguggaucggcugggucaagaccgucaccggcgccgucaacuucggcucccucgacuuccgccaccgcaucucccucacccgcgaccgcgaccucuucaccgcccacaugggcauccgcggccucacccagggcgacaccgccaccuacuucugcgcccgccagaaguucgagucccgcuacaccggcggccagggcugguacuucgaccucuggggccgcggcacccacaucgucgucuccucc

SEQ ID NO: 18660 - RNA, 381 nt, Artificial Sequence
  derived and/or modified sequence opt2 from anti-HIV-1_HeavyChain
caggucuacauggagcaggccggcggcggcgucaagaagcccggcgccuccgucacccucuccugcaagaccgccgacgaggacaucuucgacgccgccuacaugcacuggguccgccaggcccccggccagaccuucgaguggcucggcuggaugaagcccgucaccggcgccgucaacuacgcccgcaaguuccagggccgcgucuccuucuaccgcacccgcgagcucggcaucgccuacauggaccuccgcaaccuccgcuucgacgacaccgccgucuacuucugcgcccgcaagaccgccggcgacgucuccggcgacaagcgcggcuucuucuucgaccucuggggccgcggcucccgcgucaucgucuccucc

SEQ ID NO: 18661 - RNA, 381 nt, Artificial Sequence
  derived and/or modified sequence opt2 from anti-HIV-1_HeavyChain
caggucuacauggagcaggccggcggcggcgucaagaagcccggcgccuccgucacccucuccugcaagaccgccgacgaggacgucuucgacgccgccuacaugcacuggguccgccaggcccccggccagaccuucgaguggcucggcuggaugaagcccgucaccggcgccgucaacuacgcccgcaacuuccagggccgcgucuccuucuaccgcacccgcgagcucggcaucgccuacauggaccuccgcaaccuccgcuucgacgacaccgccgucuacuucugcgcccgccagaaguucgagucccgcuacuccggcgaccagggcuccuacuucgaccucuggggccgcggcacccucaucaucgucuccucc

SEQ ID NO: 18662 - RNA, 381 nt, Artificial Sequence
  derived and/or modified sequence opt2 from anti-HIV-1_HeavyChain
caggucuacauggagcaggccggcggcggcgucaagcgccccggcgccuccgucacccucuccugcaagaccgccgacgaggacgucuucgacgccgccuacaugcacuggguccgccaggcccccggccagaccuucgaguggcucggcuggaugaagcccgucaccggcgccgucaacuacgcccgcaaguuccagggccgcgucuccuucuaccgcacccgcgagcucggcaucgccuacauggaccuccgcaaccuccgcuucgacgacaccgccgucuacuucugcgcccgcaagaccgccggcgacgucuccggcgacaagcgcggcuucuucuucgaccucuggggccgcggcucccgcgucaucgucuccucc

SEQ ID NO: 18663 - RNA, 381 nt, Artificial Sequence
  derived and/or modified sequence opt2 from anti-HIV-1_HeavyChain
cagguccagcucguccaguccggcgacgaggucaagaagcccggcgccuccgucacccucuccugcaagaccgccgacgaggacgucuucgacgccgccuacaugcacuggguccgccaggcccccggccagaccuucgaguggcucggcuggaugaagcccgucaccggcgccgucaacuacgcccgcaaguuccagggccgcgucuccuucuaccgcacccgcgagcucggcaucgccuacauggaccuccgcaaccuccgcuucgacgacaccgccgucuacuucugcgcccgcaagaccgccggcgacgucuccggcgacaagcgcggcuucuucuucgaccucuggggccgcggcucccgcgucaucgucuccucc

SEQ ID NO: 18664 - RNA, 381 nt, Artificial Sequence
  derived and/or modified sequence opt2 from anti-HIV-1_HeavyChain
cagguccagcucguccaguccggcgccggcgucaagaagcccggcuccuccgucaaggucuccugcaaggccuccggcggcaccuucuccuccuacgccaucaacuggcuccgccagguccccggccagcgccccgaguggaugggcuggauccgccccaagaccggcgcccgcaaccaggcccgccaguuccagccccgcaucucccucacccgcgaccgcgcccucuccaccgccuaccucgaccucaacucccucaccuccgccgacuccggcaccuacuucugcgcccgccagaccuucaagcccgacuucuacuucgccgaccagggcugguccuucaaccucuggggccgcggcgcccacuucaucgucuccucc

SEQ ID NO: 18665 - RNA, 381 nt, Artificial Sequence
  derived and/or modified sequence opt2 from anti-HIV-1_HeavyChain
caggucuacauggagcgcgccggcggcggcgucaagaagcccggcgccuccgucacccucuccugcgagaccgccgacgaggacgucuucgacgccgccuacaugcacuggguccgccaggcccccggccagaccuucgaguggcucggcuggaugaagcccgucaccggcgccgucaacuacgcccgcaaguuccagggccgcgucuccuucuaccgcacccgcgagcucggcaucgccuacauggaccuccgcaaccuccgcuucgacgacaccgccgucuacuucugcgcccgcaagaccgccggcgacgucuccggcgacaagcgcggcuucuucuucgaccucuggggccgcggcucccgcgucaucgucuccucc

SEQ ID NO: 18666 - RNA, 381 nt, Artificial Sequence
  derived and/or modified sequence opt2 from anti-HIV-1_HeavyChain
caggucuacauggagcaggccggcgccggcaugaagaagcccggcgccuccaugaccgucuccugcaagaccgccgacgaggacaucuucgacgccgccuacaugcacuggguccgccaggcccccggccagaccuucgaguggcucggcuggaugaagcccgucaccggcgccgucaacuacgcccgccaguuccagggccgcgucuccuuccuccaggaccagggcauccgcaucgccuacauggaccuccgcgaccucaaguucgacgacaccgccgucuacuucugcgcccgcaagaccaagggcgacgucuccggcgacgaccgcggcuucuucuucgaccucuggggccgcggcacccgcgucaucgucuccucc

SEQ ID NO: 18667 - RNA, 381 nt, Artificial Sequence
  derived and/or modified sequence opt2 from anti-HIV-1_HeavyChain
caggucuacaugggcgccggccgcggcggcgucaagaagcccggcgccuccgucacccucuccugcaagaccgccgacgaggacgucuucgacgccgccuacaugcacuggguccgccaggcccccggccagaccuucgaguggcucggcuggaugaagcccgucaccggcgccgucaacuacgcccgcaaguuccagggccgcgucuccuucuaccgcacccgcgagcucggcaucgccuacauggaccuccgcaaccuccgcuucgacgacaccgccgucuacuucugcgcccgcaagaccgccggcgacgucuccggcgacaagcgcggcuucuucuucgaccucuggggccgcggcucccgcgucaucgucuccucc

SEQ ID NO: 18668 - RNA, 381 nt, Artificial Sequence
  derived and/or modified sequence opt2 from anti-HIV-1_HeavyChain
caggucuacauggagcaggccggcgccggcgucaagaagcccggcgccuccgucacccucuccugcaagaccgccgacgaggacgucuucgacgccgccuacaugcacuggguccgccaggcccccggccagcccuucgaguggcucggcuggaugaagcccgucaccggcgccgucuccuacgcccgcaaguuccagggccgcgucuccuucuacaugacccgcgagcucggcauggccuacauggaccuccgcaaccuccgcuucgacgacaccgccgucuacuucugcgcccgcaagaccgccggcgacgucuccggcgacaaccgcggcuacuucuucgaccucuggggccgcggcucccgcgucaucgucuccucc

SEQ ID NO: 18669 - RNA, 381 nt, Artificial Sequence
  derived and/or modified sequence opt2 from anti-HIV-1_HeavyChain
cagguccagcucguccaguccggcgccgaggucaagaagcccggcgccuccgucaagaucuccugcaaggccuccggcuacaccuucauccgccacggcauccacuggcuccgccagguccccggccagcgccccgaguggaugggcuggauccgccccaagaccggcgcccgcaaccaggcccgccaguuccagccccgcaucucccucgcccgcgaccgcgcccucuccaccgccuaccucgaccucaacucccucaccuccgccgacuccggcaccuacuucugcgcccgccagaccuucaagcccgacuucuacuucgccgaccagggcugguccuucaaccucuggggccgcggcgcccacuucaucgucuccucc

SEQ ID NO: 18670 - RNA, 381 nt, Artificial Sequence
  derived and/or modified sequence opt2 from anti-HIV-1_HeavyChain
cagguccuccucguccaguccggcgccgaggucaagaagcccggcuccuccgucaaggucuccugcaaggccuccggcgacucccucaccaaguacgccuucuccuggguccgccaggcccccggccagggccccgaguggaugggcuggauccgccccaagaccggcgcccgcaaccgcgcccgccaguuccagccccgcaucucccucacccgcgaccgcgcccucuccaccgccuaccucgaccucaacucccucaccuccgccgacuccggcaccuacuucugcgcccgccagaccuucaagcccgacuucuacuucgccgaccagggcugguccuucaaccucuggggccgcggcgcccacuucaucgucuccucc

SEQ ID NO: 18671 - RNA, 381 nt, Artificial Sequence
  derived and/or modified sequence opt2 from anti-HIV-1_HeavyChain
caggucuacauggagcaggccggcggcggcgucaagaagcccggcgccuccgucacccucuccugcaagaccgccgacgaggacgucuucgacgccgccuacaugcacuggguccgccaggcccgcggccagaccuucgaguggcucggcuggaugaagcccgucaccggcgccgucaacuacgcccgcaaguuccagggccgcgucuccuucuaccgcacccgcgagcucggcaucgccuacauggaccuccgcaaccuccgcuucgacgacaccgccgucuacuucugcgcccgcaagaccgccggcgacgucuccggcgacaagcgcggcuucuucuucgaccucuggggccgcggcucccgcgucaucgucuccucc

SEQ ID NO: 18672 - RNA, 381 nt, Artificial Sequence
  derived and/or modified sequence opt2 from anti-HIV-1_HeavyChain
caggucuacauggagcaggccggcggcggcgucaagaagcccggcgccuccgucacccucuccugcaagaccgccgacgaggacgucuucgacgccgccuacaugcacuggguccgccaggcccccggccagaccuucgaguggcucggcuggaugaagcccgucaccggcgccgucaacuacgcccgcaaguuccagggccgcgucuccuucuaccgcacccgcgagcucggcaucgccuacauggaccuccgcaaccuccgcuucgacgacaccgccgucuacuucugcgcccgcaagaccgccggcgacgucuccggcgacaaccgcggcuacuucuucgaccucuggggccgcggcucccgcgucaucgucuccucc

SEQ ID NO: 18673 - RNA, 381 nt, Artificial Sequence
  derived and/or modified sequence opt2 from anti-HIV-1_HeavyChain
caggucuacauggagcaggccggcggcggcgucaagaagcccggcgccuccgucacccucuccugcaagaccgccgacgaggacgucuucgacgccgccuacaugcacuggguccgccaggcccccggccagaccuucgaguggcucggcuggaugaagcccgucaccggcgccgucaacuacgcccgcaaguuccagggccgcgucuccuucuaccgcacccgcgagcucggcaucgccuacauggaccuccgcaaccuccgcuucgacgacaccgccgucuacuucugcgcccgcaagaccgccggcgacgucuccggcgacaagcgcggcuucuucuucgaccucuggggccccggcucccgcgucaucgucuccucc

SEQ ID NO: 18674 - RNA, 381 nt, Artificial Sequence
  derived and/or modified sequence opt2 from anti-HIV-1_HeavyChain
caggucuacauggagcaggccggcggcggcaugaagaagcccggcgccuccaugaccgucuccugcaagaccgccgacgaggacaucuucgacgccgccuacaugcgcuggguccgccaggcccccggccagaccuucgaguggcucggcuggaugaagcccgucaccggcgccgucaacuacgcccgccaguuccagggccgcgucuccuucuaccgcacccgcgagcucggcaucgccuacauggaccuccgcgaccucaaguucgacgacaccgccgucuacuucugcgcccgcaagaccaagggcgacgucuccggcgacgaccgcggcuucuucuucgaccucuggggccgcggcacccgcgucaucgucuccucc

SEQ ID NO: 18675 - RNA, 381 nt, Artificial Sequence
  derived and/or modified sequence opt2 from anti-HIV-1_HeavyChain
caggucuacauggagcaggccggcggcggcgucaagaagcccggcgccuccgucacccucuccugcaagaccgccgacgaggacgucuucgacgccgccuacaugcacuggguccgccaggcccccggccagaccuucgaguggcucggcuggaugaagcccgucaccggcgccgucuccuacgcccgcaaguuccagggccgcgucuccuucuacaugacccgcgagcucggcauggccuaccucgaccuccgcaaccuccgcuucgacgacaccgccgucuacuucugcgcccgcaagaccgccggcgacgucuccggcgacaaccgcggcuacuucuucgaccucuggggccgcggcucccgcgucaucgucuccucc

SEQ ID NO: 18676 - RNA, 381 nt, Artificial Sequence
  derived and/or modified sequence opt2 from anti-HIV-1_HeavyChain
cagguccagcucguccaguccggcgccgaggucaagaagcccggcgccuccgucaaggucuccugcaaggccuccggcuacaccuucaccggcuacuacaugcacuggguccgccaggcccccggccagggccucgaguggaucggcugggucaagaccgucaccggcgccgucaacuucggcucccucgacuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccucc

SEQ ID NO: 18677 - RNA, 381 nt, Artificial Sequence
  derived and/or modified sequence opt2 from anti-HIV-1_HeavyChain
caggucuacauggagcaggccggcggcggcgucaagaagcccggcgccuccgucacccucuccugcaagaccgccgacgaggacgucuucgacgccgccuacaugcacuggguccgccaggcccccggccagaccuucgaguggcucggcuggaucaagcccgucaccggcgccgucaacuacgcccgcaaguuccagggccgcgucuccuucuaccgcacccgcgagcucggcaucgccuacauggaccuccgcaaccuccgcuucgacgacaccgccgucuacuucugcgcccgcaagaccgccggcgacgucuccggcgacaagcgcggcuucuucuucgaccucuggggccgcggcucccgcgucaucgucuccucc

SEQ ID NO: 18678 - RNA, 381 nt, Artificial Sequence
  derived and/or modified sequence opt2 from anti-HIV-1_HeavyChain
caggucuacauggagcaggccggcggcggcaugaagaagcccggcgccuccgucaccgucuccugcaagaccgccgacgaggacaucuucgacgccgccuacaugcacuggguccgccaggcccccggccagaccuucgaguggcucggcuggaugaagcccgucaccggcgccgucaacuacgcccgccaguuccagggccgcgucuccuucuaccgcacccgcgagcucggcaucgccuacauggaccuccgcgaccucaaguucgacgacaccgccgucuacuucugcgcccgcaagaccaagggcgacgucuccggcgacgaccgcggcuucuucuucgaccucuggggccgcggcacccgcgucaucgucuccucc

SEQ ID NO: 18679 - RNA, 381 nt, Artificial Sequence
  derived and/or modified sequence opt2 from anti-HIV-1_HeavyChain
caggcccaccucgagcaguccggcuccggcgucaagaagcccggcgccuccguccgcgucuccugcugguccuccgaggacaucuccaaggccgagcucauccacuggguccgccaggcccccggccagggccucgaguggaucggcugggucaagaccgucaccggcgccgucaacuucggcucccucgacuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccucc

SEQ ID NO: 18680 - RNA, 381 nt, Artificial Sequence
  derived and/or modified sequence opt2 from anti-HIV-1_HeavyChain
caggucuacauggaggccggccgcggcggcgucaagaagcccggcgccuccgccacccucuccugcaagaccgccgacgaggacgucuucgacgccgccuacaugcacuggguccgccaggcccccggccagaccuucgaguggcucggcuggaugaagcccgucaccggcgccgucuccuacgcccgcaaguuccagggccgcgucuccuucuacaugacccgcgagcucggcauggccuacauggaccuccgcaaccuccgcuucgacgacaccgccgucuacuucugcgcccgcaagaccgccggcgacgucuccggcgacaaccgcggcuacuucuucgaccucuggggccgcggcucccgcgucaucgucuccucc

SEQ ID NO: 18681 - RNA, 381 nt, Artificial Sequence
  derived and/or modified sequence opt2 from anti-HIV-1_HeavyChain
cgcugcaucuggcgccaggccggcggcggcgucaagaagcccggcgccuccgucacccucuccugcaagaccgccgacgaggacgucuucgacgccgccuacaugcacuggguccgccaggcccccggccagaccuucgaguggcucggcuggaugaagcccgucaccggcgccgucuccuacgcccgcaaguuccagggccgcgucuccuucuacaugacccgcgagcucggcauggccuacauggaccuccgcaaccuccgcuucgacgacaccgccgucuacuucugcgcccgcaagaccgccggcgacgucuccggcgacaaccgcggcuacuucuucgaccucuggggccgcggcucccgcgucaucgucuccucc

SEQ ID NO: 18682 - RNA, 381 nt, Artificial Sequence
  derived and/or modified sequence opt2 from anti-HIV-1_HeavyChain
caggucuacauggagcaggccggcggcggcgucaagaagcccggcgccuccgucacccucuccugcaagaccgccgacgaggacgucuucgacgccgccuacaugcacuggguccgccaggcccccggccagaccuucgaguggcucggcuggaucaagcccgucaccggcgccgucuccuacgcccgcaaguuccagggccgcgucuccuucuacaugacccgcgagcucggcauggccuacauggaccuccgcaaccuccgcuucgacgacaccgccgucuacuucugcgcccgcaagaccgccggcgacgucuccggcgacaaccgcggcuacuucuucgaccucuggggccgcggcucccgcgucaucgucuccucc

SEQ ID NO: 18683 - RNA, 384 nt, Artificial Sequence
  derived and/or modified sequence opt2 from anti-HIV-1_HeavyChain
cagucccaccucgagcaguccggcuccgccaugaagaagcccggcgccuccgucaaguccuccugcuggaccuccgaggacaucuucgacaccaccgagcucaucuacuggguccgccaggcccccggccagggccucgaguggaucggcugggucaagaucgucuccggcaccgucaacuucgccucccucgacuuccgcaaccgcaucucccucucccgcgaccgcgaccucuccaccgccuacauggacauccgcggccucacccaggacgacaccgccaccuacuucugcgcccgccagaaguucgccucccgcuacuccggcgaccagggcuccuacuucgaccucuggggccgcggcacccucaucgucgucuccucc

SEQ ID NO: 18684 - RNA, 381 nt, Artificial Sequence
  derived and/or modified sequence opt2 from anti-HIV-1_HeavyChain
cgcugccucuggcgccaggccggcggcggcaugaagaagcccggcgccuccaugaccgucuccugcaagaccgccgacgaggacgucuucgacgccgccuacaugcacuggguccgccaggcccccggccagaccuucgaguggcucggcuggaugaagcccgucaccggcgccgucaacuacgcccgcaaguuccagggccgcgucuccuucuaccgcacccgcgagcucggcaucgccuacauggaccuccgcaaccuccgcuucgacgacaccgccgucuacuucugcgcccgcaagaccgccggcgacgucuccggcgacaagcgcggcuucuucuucgaccucuggggccgcggcucccgcgucaucgucuccucc

SEQ ID NO: 18685 - RNA, 381 nt, Artificial Sequence
  derived and/or modified sequence opt2 from anti-HIV-1_HeavyChain
cgcugcaucugggagcgcgccggcggcggcaugaagaagcccggcgccuccaugaccgucuccugcaagaccgccgacgaggacaucuucgacgccgccuacaugcacuggguccgccaggcccccggccagaccuucgaguggcucggcuggaugaagcccgucaccggcgccgucaacuacgcccgccaguuccagggccgcgucuccuucuaccgcacccgcgagcucggcaucgccuacauggaccuccgcgaccucaaguucgacgacaccgccgucuacuucugcgcccgcaagaccaagggcgacgucuccggcgacgaccgcggcuucuucuucgaccucuggggccgcggcacccgcgucaucgucuccucc

SEQ ID NO: 18686 - RNA, 381 nt, Artificial Sequence
  derived and/or modified sequence opt2 from anti-HIV-1_HeavyChain
cagguccagcucgagcaggccggcggcggcgucaagaagcccggcgccuccgucacccucuccugcaagaccgccgacgaggacgucuucgacgccgccuacaugcacuggguccgccaggcccccggccagaccuucgaguggcucggcuggaugaagcccgucaccggcgccgucaacuacgcccgcaaguuccagggccgcgucuccuucuaccgcacccgcgagcucggcaucgccuacauggaccuccgcaaccuccgcuucgacgacaccgccgucuacuucugcgcccgcaagaccgccggcgacgucuccggcgacaagcgcggcuucuucuucgaccucuggggccgcggcucccgcgucaucgucuccucc

SEQ ID NO: 18687 - RNA, 381 nt, Artificial Sequence
  derived and/or modified sequence opt2 from anti-HIV-1_HeavyChain
caggucuacauggagcaggccggcggcggcaugaagaagcccggcgccuccaugaccgucuccugcaagaccgccgacgaggacgucuucgacgccgccuacaugcacuggguccgccaggcccccggccagaccuucgaguggcucggcuggaugaagcccgucaccggcgccgucaacuacgcccgcaaguuccagggccgcgucuccuucuaccgcacccgcgagcucggcaucgccuacauggaccuccgcaaccuccgcuucgacgacaccgccgucuacuucugcgcccgcaagaccgccggcgacgucuccggcgacaagcgcggcuucuucuucgaccucuggggccgcggcucccgcgucaucgucuccucc

SEQ ID NO: 18688 - RNA, 381 nt, Artificial Sequence
  derived and/or modified sequence opt2 from anti-HIV-1_HeavyChain
caggucuacauggagcaggccggcggcggcgucaagaagcccggcgccuccgucacccucuccugcaagaccgccgacgaggacgucuucgacgccgccuacaugcgcuggguccgccaggcccccggccagaccuucgaguggcucggcuggaugaagcccgucaccggcgccgucuccuacgcccgcaaguuccagggccgcgucuccuucuacaugacccgcgagcucggcauggccuacauggaccuccgcaaccuccgcuucgacgacaccgccgucuacuucugcgcccgcaagaccgccggcgacgucuccggcgacaaccgcggcuacuucuucgaccucuggggccgcggcucccgcgucaucgucuccucc

SEQ ID NO: 18689 - RNA, 381 nt, Artificial Sequence
  derived and/or modified sequence opt2 from anti-HIV-1_HeavyChain
caggucuacauggagcagcccggcggcggcgucaagaagcccggcgccuccgucacccucuccugcaagaccgccgacgaggacgucuucgacgccgccuacaugcacuggguccgccaggcccccggccagaccuucgaguggcucggcuggaugaagcccgucaccggcgccgucuccuacgcccgcaaguuccagggccgcgucuccuucuacaugacccgcgagcucggcauggccuacauggaccuccgcaaccuccgcuucgacgacaccgccgucuacuucugcgcccgcaagaccgccggcgacgucuccggcgacaaccgcggcuacuucuucgaccucuggggccgcggcucccgcgucaucgucuccucc

SEQ ID NO: 18690 - RNA, 381 nt, Artificial Sequence
  derived and/or modified sequence opt2 from anti-HIV-1_HeavyChain
caggucuacauggagcaggccggcggcgaggucaagaagcccggcgccuccgucacccucuccugcaagaccgccgacgaggacgucuucgacgccgccuacaugcacuggguccgccaggcccccggccagaccuucgaguggcucggcuggaugaagcccgucaccggcgccgucuccuacgcccgcaaguuccagggccgcgucuccuucuacaugacccgcgagcucggcauggccuacauggaccuccgcaaccuccgcuucgacgacaccgccgucuacuucugcgcccgcaagaccgccggcgacgucuccggcgacaaccgcggcuacuucuucgaccucuggggccgcggcucccgcgucaucgucuccucc

SEQ ID NO: 18691 - RNA, 381 nt, Artificial Sequence
  derived and/or modified sequence opt2 from anti-HIV-1_HeavyChain
cagguccagcucguccaguccggcgccgaggucaagaagcccggcgccuccguccgcgucuccugccaggccuccggcuacaucuucaccggcuacuucgucaacuggcuccgccagcuccccggccagcgccccgaguggaugggcuggauccgccccaaguccggcgcccgcaaccaggcccgccaguuccagccccgcaucucccucacccgcgaccgcgcccucuccaccgccuaccucgacuccaacucccucaccuccgccgacuccggcaccuacuucugcgcccgccagaccuucaagcccgacuucuacuucgccgaccagggcugguccuucaaccucuggggccgcggcgcccacuucaucgucuccucc

SEQ ID NO: 18692 - RNA, 381 nt, Artificial Sequence
  derived and/or modified sequence opt2 from anti-HIV-1_HeavyChain
ggcugcaucuggacccaggccggcggcggcgucaagaagcccggcgccuccgucacccucuccugcaagaccgccgacgaggacgucuucgacgccgccuacaugcacuggguccgccaggcccccggccagaccuucgaguggcucggcuggaugaagcccgucaccggcgccgucuccuacgcccgcaaguuccagggccgcgucuccuucuacaugacccgcgagcucggcauggccuacauggaccuccgcaaccuccgcuucgacgacaccgccgucuacuucugcgcccgcaagaccgccggcgacgucuccggcgacaaccgcggcuacuucuucgaccucuggggccgcggcucccgcgucaucgucuccucc

SEQ ID NO: 18693 - RNA, 381 nt, Artificial Sequence
  derived and/or modified sequence opt2 from anti-HIV-1_HeavyChain
cgcugcaucuggcgccaggccggcggcggcaugaagaagcccggcgccuccaugaccgucuccugcaagaccgccgacgaggacaucuucgacgccgccuacaugcacuggguccgccaggcccccggccagaccuucgaguggcucggcuggaugaagcccgucaccggcgccgucaacuacgcccgccaguuccagggccgcgucuccuucuaccgcacccgcgagcucggcaucgccuacauggaccuccgcgaccucaaguucgacgacaccgccgucuacuucugcgcccgcaagaccaagggcgacgucuccggcgacgaccgcggcuucuucuucgaccucuggggccgcggcacccgcgucaucgucuccucc

SEQ ID NO: 18694 - RNA, 381 nt, Artificial Sequence
  derived and/or modified sequence opt2 from anti-HIV-1_HeavyChain
caggucuacauggagcaggccggcggcggcgucaagaagcccggcgccuccgucacccucuccugcaagaccgccgacgaggacgucuucgacgccgccuacaugcacuggguccgccaggcccccggccagaccuucgagugggucggcuggaugaagcccgucaccggcgccgucuccuacgcccgcaaguuccagggccgcgucuccuucuacaugacccgcgagcucggcauggccuacauggaccuccgcaaccuccgcuucgacgacaccgccgucuacuucugcgcccgcaagaccgccggcgacgucuccggcgacaaccgcggcuacuucuucgaccucuggggccgcggcucccgcgucaucgucuccucc

SEQ ID NO: 18695 - RNA, 381 nt, Artificial Sequence
  derived and/or modified sequence opt2 from anti-HIV-1_HeavyChain
caggucuacauggagcaggccggcggcggcgucaaggagcccggcgccuccgucacccucuccugcaagaccgccgacgaggacgucuucgacgccgccuacaugcacuggguccgccaggcccccggccagaccuucgaguggcucggcuggaugaagcccgucaccggcgccgucaacuacgcccgcaaguuccagggccgcgucuccuucuaccgcacccgcgagcucggcaucgccuacauggaccuccgcaaccuccgcuucgacgacaccgccgucuacuucugcgcccgcaagaccgccggcgacgucuccggcgacaagcgcggcuucuucuucgaccucuggggccgcggcucccgcgucaucgucuccucc

SEQ ID NO: 18696 - RNA, 381 nt, Artificial Sequence
  derived and/or modified sequence opt2 from anti-HIV-1_HeavyChain
caggcccaccucgagcaguccggcuccggcgucaagaagcccggcgccuccguccgcgucuccugcugguccuccgaggacaucuucaagaccgagcucauccacuggguccgccaggcccccggccagggccucgaguggaucggcugggucaagaccgucaccggcgccgucaacuucggcucccucgacuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccucc

SEQ ID NO: 18697 - RNA, 384 nt, Artificial Sequence
  derived and/or modified sequence opt2 from anti-HIV-1_HeavyChain
caggcccaccucgagcaguccggcuccggcgucaagaagcccggcgccuccguccgcgucuccugcugguccuccgaggacaucuucgagcgcaccgagcucauccacuggguccgccaggcccccggccagggccucgaguggaucggcuggaugaagaccgucaccggcgccgucaacuucggcucccucgacuuccgccaccgcaucucccucacccgcgaccgcgaccucuucaccgcccacauggacauccgcggccucgcccagggcgacaccgccaccuacuucugcgcccgccagaaguucgagucccgcuacaccggcggccagggcugguacuucgaccucuggggccgcggcacccacaucgucgucuccucc

SEQ ID NO: 18698 - RNA, 384 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccucgacuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccucc

SEQ ID NO: 18699 - RNA, 384 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgccucccucgacuuccgcaaccgcaucucccucucccgcgaccgcgaccucuccaccgccuacauggacauccgcggccucacccaggacgacaccgccaccuacuucugcgcccgccagaaguucgccucccgcuacuccggcgaccagggcuccuacuucgaccucuggggccgcggcacccucaucgucgucuccucc

SEQ ID NO: 18700 - RNA, 384 nt, Artificial Sequence
  derived and/or modified sequence opt2 from anti-HIV-1_HeavyChain
ucccacaccuggaacaaccgcggcuccgccaugaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgccucccucgacuuccgcaaccgcaucucccucucccgcgaccgcgaccucuccaccgccuacauggacauccgcggccucacccaggacgacaccgccaccuacuucugcgcccgccagaaguucgccucccgcuacuccggcgaccagggcuccuacuucgaccucuggggccgcggcacccucaucgucgucuccucc

SEQ ID NO: 18701 - RNA, 381 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuuccacaacgagcucaucuacuggguccgccaggcccccggccagggccucgaguggaucggcugggucaagaucgucuccggcaccgucaacuucgccucccucgacuuccgcaaccgcaucucccucucccgcgaccgcgaccucuccaccgccuacauggacauccgcggccucacccaggacgacaccgccaccuacuucugcgcccgccagaaguucgccucccgcuacuccggcgaccagggcuccuacuucgaccucuggggccgcggcacccucaucgucgucuccucc

SEQ ID NO: 18702 - RNA, 384 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcuggaugaagaccgucaccggcgccgucaacuucggcucccucgacuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccucc

SEQ ID NO: 18703 - RNA, 381 nt, Artificial Sequence
  derived and/or modified sequence opt2 from anti-HIV-1_HeavyChain
caggucuucauggagcaggccggcggcgaggucaagaagcccggcgccuccaugaccgucuccugcaagaccgccgacgaggacgucuucgacgccgccuacaugcacuggguccgccaggcccccggccagaccuucgaguggcucggcuggaugaagcccgucaccggcgccgucaacuacgcccgccaguuccagggccgcgucuccuucuaccgcacccgcgagcucggcaucgccuacauggaccuccgcgaccucaaguucgacgacaccgccgucuacuucugcgcccgcaagaccaagggcgacgucuccggcgacgaccgcggcuucuucuucgaccucuggggccgcggcacccgcgucaucgucuccucc

SEQ ID NO: 18704 - RNA, 381 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgaggacgagcucauccacuggguccgccaggcccccggccagggccucgaguggaucggcugggucaagaucgucuccggcaccgucaacuucgccucccucgacuuccgcaaccgcaucucccucucccgcgaccgcgaccucuccaccgccuacauggacauccgcggccucacccaggacgacaccgccaccuacuucugcgcccgccagaaguucgccucccgcuacuccggcgaccagggcuccuacuucgaccucuggggccgcggcacccucaucgucgucuccucc

SEQ ID NO: 18705 - RNA, 381 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacauccucaaggccgagcucaucuacuggguccgccaggcccccggccgcggccucgaguggaucggcugggucaagaccgucuccggcaccgucaacuucggcuccuccgacuuccgcaaccgcaucucccucacccgcgaccgcgaccucuccaccgcccacauggacauccgcggccucacccaggacgacaccgccaccuacuucugcgcccgccagaaguucgagucccucuacuccgacgaccagggcuccuacuucgaccucuggggccgcggcacccucaucaucgucuccucc

SEQ ID NO: 18706 - RNA, 381 nt, Artificial Sequence
  derived and/or modified sequence opt2 from anti-HIV-1_HeavyChain
cagguccagcucguccaguccggcgccgaggucaagaagcccggcgccuccgucaaggucuccugcaaggccuccggcuacuccuucaccgacuacuacauccacuggcuccgccagguccagggccagcgccccgaguggaugggcuggauccgcccccgcaccggcgcccgcaaccaggcccgccaguuccagccccgcaucucccucacccgcgaccgcgcccucuccaccgccuaccucgaccucaacucccucaccuccgccgacuccggcaccuacuucugcgcccgccagaccuucaagcccgacuucuacuucgccgaccagggcugguccuucaaccucuggggccgcggcgcccacuucaucgucuccucc

SEQ ID NO: 18707 - RNA, 381 nt, Artificial Sequence
  derived and/or modified sequence opt2 from anti-HIV-1_HeavyChain
caggucuucauggagcaggccggcggcgaggucaagaagcccggcgccuccaugaccgucuccugcaagaccgccgacgaggacgucuucgacgccgccuacaugcacuggguccgccaggcccccggccagaccuucgaguggcucggcuggaugaagcccgucaccggcgccgucaacuacgcccgcaaguuccagggccgcgucuccuucuaccgcacccgcgagcucggcaucgccuacauggaccuccgcgaccucaaguucgacgacaccgccgucuacuucugcgcccgcaagaccaagggcgacgucuccggcgacgaccgcggcuucuucuucgaccucuggggccgcggcacccgcgucaucgucuccucc

SEQ ID NO: 18708 - RNA, 384 nt, Artificial Sequence
  derived and/or modified sequence opt2 from anti-HIV-1_HeavyChain
caggcccaccucgagcaguccggcgccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccucgacuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccucc

SEQ ID NO: 18709 - RNA, 384 nt, Artificial Sequence
  derived and/or modified sequence opt2 from anti-HIV-1_HeavyChain
caggcccaccucgagcaguccggcgccggcgucaagaagcccggcgccuccguccgcgucuccugcugguccuccgaggacaucuucgagcgcaccgagcucauccacuggguccgccaggcccccggccagggccucgaguggaucggcugggucaagaccgucaccggcgccgucaacuucggcucccucgacuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccucc

SEQ ID NO: 18710 - RNA, 384 nt, Artificial Sequence
  derived and/or modified sequence opt2 from anti-HIV-1_HeavyChain
cagucccaccucgagcaguccggcuccgccaugaagaagcccggcgccuccguccgcgucuccugcugggccuccgaggacaucuucgacaccaccgagcucaucuacuggguccgccaggcccccggccagggccucgaguggaucggcugggucaagaucgucuccggcaccgucaacuucgccucccucgacuuccgcaaccgcaucucccucucccgcgaccgcgaccucuccaccgccuacauggacauccgcggccucacccaggacgacaccgccaccuacuucugcgcccgccagaaguucgccucccgcuacuccggcgaccagggcuccuacuucgaccucuggggccgcggcacccucaucgucgucuccucc

SEQ ID NO: 18711 - RNA, 381 nt, Artificial Sequence
  derived and/or modified sequence opt2 from anti-HIV-1_HeavyChain
cgcugccgccucguccaguccggcgccgaggucaagaagcccggcgccuccguccgcgucuccugccaggccuccggcuacaccuucuccgccuacggcgucaacuggguccgccaggcccccggccaggagcucgaguggaucggcugggucaagaccgucaccggcgccgucaacuucggcucccccaacuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccucc

SEQ ID NO: 18712 - RNA, 384 nt, Artificial Sequence
  derived and/or modified sequence opt2 from anti-HIV-1_HeavyChain
caggcccaccucgagcaguccggcuccggcgucaagaagcccggcgccuccguccgcgucuccugcugguccuccgaggacaucuucgagcgcaccgagcucauccacugggucugccaggcccccggccagggccucgaguggaucggcugggucaagaccgucaccggcgccgucaacuucggcucccucgacuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccucc

SEQ ID NO: 18713 - RNA, 384 nt, Artificial Sequence
  derived and/or modified sequence opt2 from anti-HIV-1_HeavyChain
caggcccaccucgagcaguccggcuccggcgucaagaagcccggcgccuccguccgcgucuccugcugguccuccgaggacaucuucgagcgcaccgagcucauccacuggguccgccaggcccccggccagggccucgaguggaucggcugggucaagaucgucaccggcgccgucaacuucggcucccucgacuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccucc

SEQ ID NO: 18714 - RNA, 384 nt, Artificial Sequence
  derived and/or modified sequence opt2 from anti-HIV-1_HeavyChain
cagguccagcucguccaguccggccucgaggucaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgccucccucgacuuccgcaaccgcaucucccucucccgcgaccgcgaccucuccaccgcccacauggacauccgcggccucacccaggacgacaccgccaccuacuucugcgcccgccagaaguucgccucccgcuacuccggcgaccagggcuccuacuucgaccucuggggccgcggcacccucaucaucgucuccucc

SEQ ID NO: 18715 - RNA, 384 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgccucccucgacuuccgcaaccgcaucucccucucccgcgaccgcgaccucuccaccgcccacauggacauccgcggccuccgccaggacgacaccgccaccuacuucugcgcccgccagaaguucgagucccgcuacuccggcgaccagggcuccuacuucgaccucuggggccgcggcacccucaucaucgucuccucc

SEQ ID NO: 18716 - RNA, 384 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucgccucccgcuacuccggcgaccagggcuccuacuucgaccucuggggccgcggcacccucaucgucgucuccucc

SEQ ID NO: 18717 - RNA, 384 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccucc

SEQ ID NO: 18718 - RNA, 384 nt, Artificial Sequence
  derived and/or modified sequence opt2 from anti-HIV-1_HeavyChain
cgccacaccugggagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuccaccgccuacauggacauccgcggccucacccaggacgacaccgccaccuacuucugcgcccgccagaaguucgccucccgcuacuccggcgaccagggcuccuacuucgaccucuggggccgcggcacccucaucgucgucuccucc

SEQ ID NO: 18719 - RNA, 384 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgccucccucgacuuccgcaaccgcaucucccucucccgcgaccgcgaccucuccaccgccuacauggacauccgcggccucacccaggacgacaccgccaccuacuucugcgcccgccagaaguucgagucccgcuacaccggcggccagggcugguacuucgaccucuggggccgcggcacccacaucgucgucuccucc

SEQ ID NO: 18720 - RNA, 384 nt, Artificial Sequence
  derived and/or modified sequence opt2 from anti-HIV-1_HeavyChain
cagguccagcucguccaguccggcgccgaggucaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgccucccucgacuuccgcaaccgcaucucccucucccgcgaccgcgaccucuccaccgcccacauggacauccgcggccucacccaggacgacaccgccaccuacuucugcgcccgccagaaguucgagucccgcuacaccggcggccagggcugguacuucgaccucuggggccgcggcacccacaucgucgucuccucc

SEQ ID NO: 18721 - RNA, 384 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgccucccucgacuuccgcaaccgcaucucccucucccgcgaccgcgaccucuccaccgccuacauggacauccgcggccucacccagggcgacaccgccaccuacuucugcgcccgccagaaguucgagucccgcuacaccggcggccagggcugguacuucgaccucuggggccgcggcacccacaucgucgucuccucc

SEQ ID NO: 18722 - RNA, 384 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucuccggcgccgucaacuucggcucccccgacuuccgccaccgcaucucccucucccgcgaccgcgaccucuccaccgcccacauggacauccgcggccucacccaggacgacaccgccaccuacuucugcgcccgccagaaguucgccucccgcuacuccggcgaccagggcuccuacuucgaccucuggggccgcggcacccucaucaucgucuccucc

SEQ ID NO: 18723 - RNA, 384 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccgcggccucgaguggaucggcugggucaagaccgucuccggcaccgucaacuucggcuccuccgacuuccgcaaccgcgucucccucacccgcgaccgcgaccucuccaccgcccacauggacauccgcggccucacccaggacgacaccgccaccuacuucugcgcccgccagaaguucgagucccucuacuccgacgaccagggcuccuacuucgaccucuggggccgcggcacccucaucaucgucuccucc

SEQ ID NO: 18724 - RNA, 384 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgcaaccgcaucucccucacccgcgaccgcgaccucuccaccgcccacauggacauccgcggccucacccaggacgacaccgccaccuacuucugcgcccgccagaaguucgagucccucuacuccgacgaccagggcuccuacuucgaccucuggggccgcggcacccucaucaucgucuccucc

SEQ ID NO: 18725 - RNA, 384 nt, Artificial Sequence
  derived and/or modified sequence opt2 from anti-HIV-1_HeavyChain
cagucccaccucgagcaguccggcuccgccaugaagcgccccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgccucccucgacuuccgcaaccgcaucucccucucccgcgaccgcgaccucuccaccgccuacauggacauccgcggccucacccaggacgacaccgccaccuacuucugcgcccgccagaaguucgccucccgcuacuccggcgaccagggcuccuacuucgaccucuggggccgcggcacccucaucgucgucuccucc

SEQ ID NO: 18726 - RNA, 384 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgcaaccgcaucucccucucccgcgaccgcgaccucuccaccgccuacauggacauccgcggccucacccaggacgacaccgccaccuacuucugcgcccgccagaaguucgccucccgcuacuccggcgaccagggcuccuacuucgaccucuggggccgcggcacccucaucgucgucuccucc

SEQ ID NO: 18727 - RNA, 384 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccucgacuuccgccaccgcaucucccucacccgcgaccgcgacuucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccucc

SEQ ID NO: 18728 - RNA, 381 nt, Artificial Sequence
  derived and/or modified sequence opt2 from anti-HIV-1_HeavyChain
caggcccaccucgagcaguccggcuccggcgucaagaagcccggcgccuccguccgcgucuccugcugguccuccgaggacaucuuccgcaccgagcucauccacuggguccgccaggcccccggccagggccucgaguggaucggcugggucaagaccgucaccggcgccgucaacuucggcucccucgacuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccucc

SEQ ID NO: 18729 - RNA, 384 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagucccucuacuccgacgaccagggcuccuacuucgaccucuggggccgcggcacccucaucaucgucuccucc

SEQ ID NO: 18730 - RNA, 384 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgccucccucgacuuccgcaaccgcaucucccucucccgcgaccgcgaccucuccaccgcccacauggacauccgcggccucacccaggacgacaccgccaccuacuucugcgcccgccagaaguucgccucccgcuacuccggcgaccagggcuccuacuucgaccucuggggccgcggcacccucaucaucgucuccucc

SEQ ID NO: 18731 - RNA, 384 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgccuccuccgacuuccgcaaccgcaucucccucucccgcgaccgcgaccucuccaccgcccacauggacauccgcggccucacccaggacgacaccgccaccuacuucugcgcccgccagaaguucgccucccgcuacuccggcgaccagggcuccuacuucgaccucuggggccgcggcacccucaucgucgucuccucc

SEQ ID NO: 18732 - RNA, 384 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucaucuacuggguccgccaggcccccggccgcggccucgaguggaucggcugggucaagaccgucuccggcaccgucaacuucggcuccuccgacuuccgcaaccgcaucucccucacccgcgaccgcgaccucuccaccgcccacauggacauccgcggccucacccaggacgacaccgccaccuacuucugcgcccgccagaaguucgagucccucuacuccgacgaccagggcuccuacuucgaccucuggggccgcggcacccucaucaucgucuccucc

SEQ ID NO: 18733 - RNA, 384 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgacaccaccgagcucauccacuggguccgccaggcccccggccagggccucgaguggaucggcugggucaagaccgucaccggcgccgucaacuucggcucccucgacuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccucc

SEQ ID NO: 18734 - RNA, 384 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucggcaccaccgagcucaucuacuggguccgccaggcccccggccagggccucgaguggaucggcugggucaagaucgucuccggcaccgucaacuucgccucccucgacuuccgcaaccgcaucucccucucccgcgaccgcgaccucuccaccgccuacauggacauccgcggccucacccaggacgacaccgccaccuacuucugcgcccgccagaaguucgccucccgcuacuccggcgaccagggcuccuacuucgaccucuggggccgcggcacccucaucgucgucuccucc

SEQ ID NO: 18735 - RNA, 384 nt, Artificial Sequence
  derived and/or modified sequence opt2 from anti-HIV-1_HeavyChain
cagguccagcucguccaguccggcuccgccaugaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgccucccucgacuuccgcaaccgcaucucccucucccgcgaccgcgaccucuccaccgccuacauggacauccgcggccucacccaggacgacaccgccaccuacuucugcgcccgccagaaguucgccucccgcuacuccggcgaccagggcuccuacuucgaccucuggggccgcggcacccucaucgucgucuccucc

SEQ ID NO: 18736 - RNA, 384 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgagggcaucuucgagcgcaccgagcucauccacuggguccgccaggcccccggccagggccucgaguggaucggcugggucaagaccgucaccggcgccgucaacuucggcucccucgacuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccucc

SEQ ID NO: 18737 - RNA, 384 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacugggcccgccaggcccccggccagggccucgaguggaucggcugggucaagaccgucaccggcgccgucaacuucggcucccccaacuuccgccaccgcgccucccucacccgcgaccgcgaccucuucaccgcccacauggacauccgcggccucaccgagggcgacaccgccaccuacuucugcgcccgccagaaguucgccucccgcuacuccggcgaccagggcuccuacuucgaccucuggggccgcggcacccucaucaucgucuccucc

SEQ ID NO: 18738 - RNA, 384 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgacaccgccgagcucaucuacuggguccgccaggcccccggccagggccucgaguggaucggcugggucaagaucgucuccggcaccgucaacuucgccucccucgacuuccgcaaccgcaucucccucucccgcgaccgcgaccucuccaccgcccacauggacauccgcggccuccgccaggacgacaccgccaccuacuucugcgcccgccagaaguucgagucccgcuacuccggcgaccagggcuccuacuucgaccucuggggccgcggcacccucaucaucgucuccucc

SEQ ID NO: 18739 - RNA, 384 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgagcgcaccgagcucauccacuggguccgccaggcccccggccagggccucgaguggaucgagugggucaaggccgucuccggcgccgucaacuacggcucccucgacuuccgccaccgcgucucccucacccgcgaccgcgaccucuucaccgcccacauggacauccgcggccucacccaggacgacaccgccaccuacuucugcgcccgccagaaguucgagucccgcuacaccggcggccagggcugguacuucgaccucuggggccgcggcacccacaucgucgucuccucc

SEQ ID NO: 18740 - RNA, 384 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgccucccucgacuuccgcaaccgcaucucccucucccgcgaccgcgaccucuccaccgccuacauggacauccgcggccucacccaggacgacaccgccaccuacuucugcgcccgccagaaguucgccucccgcuacuccggcgaccagggcuccuacuucgaccucuggggccgcggcacccucgacugcgucuccucc

SEQ ID NO: 18741 - RNA, 384 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgacaccaccgagcucaucuacuggguccgccaggcccccggccagggccucgaguggaucggcugggucaagaucgucuccggcgccgucaacuucgccucccucgacuuccgcaaccgcaucucccucucccgcgaccgcgaccucuccaccgcccacauggacauccgcggccucacccaggacgacaccgccaccuacuucugcgcccgccagaaguucgccucccgcuacuccggcgaccagggcuccuacuucgaccucuggggccgcggcacccucaucaucgucuccucc

SEQ ID NO: 18742 - RNA, 384 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuccaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccucc

SEQ ID NO: 18743 - RNA, 384 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuccaccgcccacauggacauccgcggccucacccaggacgacaccgccaccuacuucugcgcccgccagaaguucgagucccucuacuccgacgaccagggcuccuacuucgaccucuggggccgcggcacccucaucaucgucuccucc

SEQ ID NO: 18744 - RNA, 384 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcaccgucaacuucggcucccucaacuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccucc

SEQ ID NO: 18745 - RNA, 384 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgagcgcaccgagcucaucuacuggguccgccaggcccccggccgcggccucgaguggaucggcugggucaagaucgucuccggcaccgucaacuucgccucccucgacuuccgcaaccgcaucucccucucccgcgaccgcgaccucuccaccgcccacauggacauccgcggccucacccaggacgacaccgccaccuacuucugcgcccgccagaaguucgccucccgcuacuccggcgaccagggcuccuacuucgaccucuggggccgcggcacccucaucaucgucuccucc

SEQ ID NO: 18746 - RNA, 384 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgccucccucgacuuccgcaaccgcaucucccucucccgcgaccgcgaccucuccaccgccuacauggacauccgcggccucacccaggacgacaccgccaccuacuucugcgcccgccagaaguucgccucccgcuacuccggcgaccagggcuccuacuucgaccucuggggccgcggcacccucaucaucgucuccucc

SEQ ID NO: 18747 - RNA, 384 nt, Artificial Sequence
  derived and/or modified sequence opt2 from anti-HIV-1_HeavyChain
caggcccgccucgagcaguccggcuccggcgucaagaagcucggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgcaaccgcaucucccucucccgcgaccgcgaccucuccaccgccuacauggacauccgcggccucacccaggacgacaccgccaccuacuucugcgcccgccagaaguucgccucccgcuacuccggcgaccagggcuccuacuucgaccucuggggccgcggcacccucaucgucgucuccucc

SEQ ID NO: 18748 - RNA, 384 nt, Artificial Sequence
  derived and/or modified sequence opt2 from anti-HIV-1_HeavyChain
caggcccaccucgagcaguccggcuccgccaugaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgccucccucgacuuccgcaaccgcaucucccucucccgcgaccgcgaccucuccaccgcccacauggacauccgcggccucacccaggacgacaccgccaccuacuucugcgcccgccagaaguucgccucccgcuacuccggcgaccagggcuccuacuucgaccucuggggccgcggcacccucaucaucgucuccucc

SEQ ID NO: 18749 - RNA, 384 nt, Artificial Sequence
  derived and/or modified sequence opt2 from anti-HIV-1_HeavyChain
caggcccaccucgagcaguccggcuccggcgucaagaagcccggcgccuccguccgcgucuccugcugguccuccgaggacaucuucgagcgcaccgagcucauccacuggguccgccaggcccccggccagggccucgaguggaucggcugggucaagaccgucaccggcgccgucaacuucggcucccucgacuuccgccaccgcaucucccucacccgcgaccgcgaccucuccaccgccuacauggacauccgcggccucacccaggacgacaccgccaccuacuucugcgcccgccagaaguucgccucccgcuacuccggcgaccagggcuccuacuucgaccucuggggccgcggcacccucaucgucgucuccucc

SEQ ID NO: 18750 - RNA, 384 nt, Artificial Sequence
  derived and/or modified sequence opt2 from anti-HIV-1_HeavyChain
caggcccaccucgagcaguccggcuccggcgucaagaagcccggcgccuccguccgcgucuccugcugguccuccgaggacaucuucgagcgcaccgagcucauccacuggguccgccaggcccccggccagggccucgaguggaucggcugggucaagaccgucaccggcgccgccaacuucggcucccucgacuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccucc

SEQ ID NO: 18751 - RNA, 384 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcuccgagcucauccacuggguccgccaggcccccggccagggccucgaguggaucggcugggucaagaccgucaccggcgccgucaacuucggcucccucgacuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccucc

SEQ ID NO: 18752 - RNA, 381 nt, Artificial Sequence
  derived and/or modified sequence opt2 from anti-HIV-1_HeavyChain
cgcugcaucuggcgccaggccggcggcggcgucaagaagcccggcgccuccgucacccucuccugcaagaccgccgacgaggacgucuucgacgccgccuacaugcacuggguccgccaggcccccggccagaccuucgaguggcucggcuggaugaagcccgucaccggcgccgucuccuacgcccgcaaguuccagggccgcgucuccuucuacaugacccgcggcauccgcauggccuacauggaccuccgcaaccuccgcuucgacgacaccgccgucuacuucugcgcccgcaagaccgccggcgacgucuccggcgacaaccgcggcuacuucuucgaccucuggggccgcggcucccgcgucaucgucuccucc

SEQ ID NO: 18753 - RNA, 384 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgagcgcaccgagcucaucuacuggguccgccaggcccccggccgcggccucgaguggaucggcugggucaagaucgucuccggcaccgucaacuucgccucccucgacuuccgcaaccgcaucucccucucccgcgaccgcgaccucuccaccgccuacauggacauccgcggccucacccaggacgacaccgccaccuacuucugcgcccgccagaaguucgccucccgcuacuccggcgaccagggcuccuacuucgaccucuggggccgcggcacccucaucgucgucuccucc

SEQ ID NO: 18754 - RNA, 384 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccucgacuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccucc

SEQ ID NO: 18755 - RNA, 384 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgccucccucgacuuccgcaaccgcaucucccucucccgcgaccgcgaccucuccgccgcccacauggacauccgcggccucacccaggacgacaccgccaccuacuucugcgcccgccagaaguucgccucccgcuacuccggcgaccagggcuccuacuucgaccucuggggccgcggcacccucaucaucgucuccucc

SEQ ID NO: 18756 - RNA, 384 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaucgucuccggcgccgucaacuucggcucccccaacuuccgccagcgcgucucccucacccgcgaccgcgaccucuucaccgcccacauggacauccgcggccucacccagggcgacaccgccaccuacuucugcgcccgccagaaguucgccucccgcuacuccggcgaccagggcuccuacuucgaccucuggggccgcggcacccucaucgucgucuccucc

SEQ ID NO: 18757 - RNA, 384 nt, Artificial Sequence
  derived and/or modified sequence opt2 from anti-HIV-1_HeavyChain
caggcccaccucgagcaguccggcuccggcgucaagaagcccggcgccuccguccgcgucuccugcugguccuccgaggacaucuucgagcgcaccgagcucauccacuggguccgccaggcccccggccagggccucgaguggaucggcugggucaagaccgucaccggcgccgucaacuucggcucccucgacuuccgccaccgcaucucccucacccgcgaccgcgaccucuucaccgcccacauggacauccgcggccucacccagggcgacaccgccaccuacuucugcacccgccagaaguucgagucccgcuacaccggcggccagggcugguacuucgaccucuggggccgcggcacccacaucgucgucuccucc

SEQ ID NO: 18758 - RNA, 384 nt, Artificial Sequence
  derived and/or modified sequence opt2 from anti-HIV-1_HeavyChain
caggcccaccucgagcaguccggcuccggcgucaagaagcccggcgccuccguccgcgucuccugcugguccuccgaggacaucuucgagcgcaccgagcucauccacuggguccgccaggcccccggccagggccccgaguggaucggcugggucaagaccgucaccggcgccgucaacuucggcucccucgacuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccucc

SEQ ID NO: 18759 - RNA, 384 nt, Artificial Sequence
  derived and/or modified sequence opt2 from anti-HIV-1_HeavyChain
caggcccaccucgagcaguccggcuccggcgucaagaagcccggcgccuccguccgcgucuccugcugguccuccgaggacaucuucgagcgcaccgagcucauccacuggguccgccaggcccccggccagggccucgaguggaucggcugggucaagaccgucaccggcgccgucaacuucggcccccucgacuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccucc

SEQ ID NO: 18760 - RNA, 384 nt, Artificial Sequence
  derived and/or modified sequence opt2 from anti-HIV-1_HeavyChain
cagucccaccucgagcaguccggccccgccaugaagaagcccggcgccuccguccgcgucuccugcuggaccuccgaggacaucuucgagcgcaccgagcucaucuacuggguccgccaggcccccggccgcggccucgaguggaucggcugggucaagaccgucuccggcaccgucaacuucggcuccuccgacuuccgcaaccgcaucucccucacccgcgaccgcgaccucuccaccgcccacauggacauccgcggccucacccaggacgacaccgccaccuacuucugcgcccgccagaaguucgagucccucuacuccgacgaccagggcuccuacuucgaccucuggggccgcggcacccucaucaucgucuccucc

SEQ ID NO: 18761 - RNA, 384 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgccucccucgacuuccgcaaccgcaucucccucucccgcgaccgcggccucuccaccgcccacauggacauccgcggccucacccaggacgacaccgccaccuacuucugcgcccgccagaaguucgccucccgcuacuccggcgaccagggcuccuacuucgaccucuggggccgcggcacccucaucaucgucuccucc

SEQ ID NO: 18762 - RNA, 384 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucuccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgccucccgcuacuccggcgaccagggcuccuacuucgaccucuggggccgcggcacccucaucaucgucuccucc

SEQ ID NO: 18763 - RNA, 384 nt, Artificial Sequence
  derived and/or modified sequence opt2 from anti-HIV-1_HeavyChain
cagucccaccucgagcacuccggcuccgccaugaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgccucccucgacuuccgcaaccgcaucucccucucccgcgaccgcgaccucuccaccgccuacauggacauccgcggccucacccaggacgacaccgccaccuacuucugcgcccgccagaaguucgccucccgcuacuccggcgaccagggcuccuacuucgaccucuggggccgcggcacccucaucgucgucuccucc

SEQ ID NO: 18764 - RNA, 384 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaucgucuccggcgccgucaacuucggcucccccaacuuccgccagcgcgucucccucacccgcgaccgcgaccucuucaccgcccacauggacauccgcggccucacccagggcgacaccgccaccuacuucugcgcccgccagaaguucgagucccucuacuccgacgaccagggcuccuacuucgaccucuggggccgcggcacccucaucaucgucuccucc

SEQ ID NO: 18765 - RNA, 384 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucuccggcgccgucaacuucggcucccccaacuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccucc

SEQ ID NO: 18766 - RNA, 384 nt, Artificial Sequence
  derived and/or modified sequence opt2 from anti-HIV-1_HeavyChain
caggcccaccucgagcaguccgccuccggcguccgccgccccggcgccuccguccgcgucuccugcuggaccuccgaggacaucuucgagcgcuccgagcucaucuacuggguccgccaggcccccggccgcggccucgaguggaucggcuggaucaagcucgucuccggcgccgucaacuucggcuccgucgacuuccgcaaccgcaucucccucucccgcgaccgcgaccucuccaccgcccacauggacauccgcggccuccgccaggacgacaccgccaccuacuucugcgcccgccagaaguucgagucccgcuacuccggcgaccagggcuccuacuucgaccucuggggccgcggcacccucaucaucgucuccucc

SEQ ID NO: 18767 - RNA, 384 nt, Artificial Sequence
  derived and/or modified sequence opt2 from anti-HIV-1_HeavyChain
caggcccaccucgagcaguccgccuccggcgucaagcgccccggcgccuccguccgcgucuccugcuggaccuccgaggacaucuucgagcgcaccgagcucaucuacuggguccgccaggcccccggccagggccucgaguggaucggcugggucaagaccgucuccggcgccgucaacuucggcucccaggacuuccgcgaccgcuucucccucacccgcgaccgcgaccucuccaccgcccacauggacauccgcggccucacccaggacgacaccgccaccuacuucugcgcccgccagaaguucgccucccgcuacuccggcgaccagggcuccuacuucgaccucuggggccgcggcacccucaucaucgucuccucc

SEQ ID NO: 18768 - RNA, 384 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcucccucgacuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccucc

SEQ ID NO: 18769 - RNA, 384 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucuccggcgccgucaacuucggcucccccaacuuccgccaccgcgucucccucacccgcgaccgcgaccucuucaccgcccacauggacauccgcggccucacccaggacgacaccgccaccuacuucugcgcccgccagaaguucgagucccucuacuccgacgaccagggcuccuacuucgaccucuggggccgcggcacccucaucaucgucuccucc

SEQ ID NO: 18770 - RNA, 384 nt, Artificial Sequence
  derived and/or modified sequence opt2 from anti-HIV-1_HeavyChain
cagucccaccucaagcaguccggcuccgccaugaagaagcccggcgccuccguccgcgucuccugcuggaccuccgaggacaucuucgagcgcaccgagcucaucuacuggguccgccaggcccccggccgcggccucgaguggaucggcugggucaagaccgucuccggcaccgucaacuucggcuccuccgacuuccgcaaccgcaucucccucacccgcgaccgcgaccucuccaccgcccacauggacauccgcggccucacccaggacgacaccgccaccuacuucugcgcccgccagaaguucgagucccucuacuccgacgaccagggcuccuacuucgaccucuggggccgcggcacccucaucaucgucuccucc

SEQ ID NO: 18771 - RNA, 384 nt, Artificial Sequence
  derived and/or modified sequence opt2 from anti-HIV-1_HeavyChain
caggcccaccucgagcaguccggcuccggcgucaagaagcccggcgccuccguccgcgucuccugcugguccuccgaggacaucuucgagcgcaccgagcucauccacuggguccgccaggcccccggccagggccucgaguggaucggcugggucaagaccgucaccggcgccgucaacuucggcucccucgacuuccgccaccgcaucucccucacccgcgaccgcgaccucuccaccgcccacauggacauccgcggccucacccaggacgacaccgccaccuacuucugcgcccgccagaaguucgccucccgcuacuccggcgaccagggcuccuacuucgaccucuggggccgcggcacccucaucaucgucuccucc

SEQ ID NO: 18772 - RNA, 384 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuucaccgcccacauggacauccgcggccucacccaggacgacaccgccaccuacuucugcgcccgccagaaguucgagucccgcuacaccggcggccagggcugguacuucgaccucuggggccgcggcacccacaucgucgucuccucc

SEQ ID NO: 18773 - RNA, 384 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccaggacgacaccgccaccuacuucugcgcccgccagaaguucgagucccucuacuccgacgaccagggcuccuacuucgaccucuggggccgcggcacccucaucaucgucuccucc

SEQ ID NO: 18774 - RNA, 384 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacauccucgagcgcaccgagcucaucuacuggguccgccaggcccccggccgcggccucgaguggaucggcugggucaagaccgucuccggcaccgucaacuucggcuccuccgacuuccgcaaccgcaucucccucacccgcgaccgcgaccucuccaccgcccacauggacauccgcggccucacccaggacgacaccgccaccuacuucugcgcccgccagaaguucgagucccucuacuccgacgaccagggcuccuacuucgaccucuggggccgcggcacccucaucaucgucuccucc

SEQ ID NO: 18775 - RNA, 384 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgccagcgcgucucccucacccgcgaccgcgaccucuucaccgcccacauggacauccgcggccucacccagggcgacaccgccaccuacuucugcgcccgccagaaguucgccucccgcuacuccggcgaccagggcuccuacuucgaccucuggggccgcggcacccucaucgucgucuccucc

SEQ ID NO: 18776 - RNA, 384 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccucc

SEQ ID NO: 18777 - RNA, 384 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgacgacaucuucgagcgcaccgagcucauccacuggguccgccaggcccccggccagggccucgaguggaucggcugggucaagaccgucaccggcgccgucaacuucggcucccccaacuuccgccagcgcgucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccucc

SEQ ID NO: 18778 - RNA, 384 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgccucccucgacuuccgcaaccgcaucucccucucccgcgaccgcgaccucuccaccgcccacauggacauccgcggccucacccaggacgacaccgccaccuacuucugcgcccgccagaaguucgccucccgcuacuccggcgaccagggcuccuacuucgaccucuggggccgcggcacccucaucgucgucuccucc

SEQ ID NO: 18779 - RNA, 384 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgcaaccgcaucucccucucccgcgaccgcgaccucuccaccgcccacauggacauccgcggccucacccaggacgacaccgccaccuacuucugcgcccgccagaaguucgccucccgcuacuccggcgaccagggcuccuacuucgaccucuggggccgcggcacccucaucaucgucuccucc

SEQ ID NO: 18780 - RNA, 384 nt, Artificial Sequence
  derived and/or modified sequence opt2 from anti-HIV-1_HeavyChain
caggcccaccucgagcaguccgccuccggcgucaagcgccccggcgccuccguccgcgucuccugcuggaccuccgaggacaucuucgagcgcaccgagcucaucuacuggguccgccaggcccccggccagggccucgaguggaucggcugggucaagaccgucaccggcgccgucaacuucggcucccucgacuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccucc

SEQ ID NO: 18781 - RNA, 384 nt, Artificial Sequence
  derived and/or modified sequence opt2 from anti-HIV-1_HeavyChain
caggcccaccucgagcaguccgccuccggcguccgccgccccggcgccuccguccgcgucuccugcuggaccuccgaggacaucuucgagcgcuccgagcucaucuacuggguccgccaggcccccggccgcggccucgaguggaucggcuggaucaagcucgucuccggcgccgucaacuucggcuccgucgacuuccgcgaccgcgucucccucacccgcgaccgcgaccucuucaccgcccacauggacauccgcggccucacccaggacgacaccgccaccuacuucugcgcccgccagaaguucgccucccgcuacuccggcgaccagggcuccuacuucgaccucuggggccgcggcacccucaucaucgucuccucc

SEQ ID NO: 18782 - RNA, 384 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucuccggcaccgucaacuucgccucccucgacuuccgcaaccgcaucucccucucccgcgaccgcgaccucuccaccgccuacauggacauccgcggccucacccaggacgacaccgccaccuacuucugcgcccgccagaaguucgccucccgcuacuccggcgaccagggcuccuacuucgaccucuggggccgcggcacccucaucgucgucuccucc

SEQ ID NO: 18783 - RNA, 384 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucuccggcgccgucaacuucggcucccccaacuuccgccaccgcaucucccucucccgcgaccgcgaccucuccaccgccuacauggacauccgcggccucacccaggacgacaccgccaccuacuucugcgcccgccagaaguucgccucccgcuacuccggcgaccagggcuccuacuucgaccucuggggccgcggcacccucaucgucgucuccucc

SEQ ID NO: 18784 - RNA, 384 nt, Artificial Sequence
  derived and/or modified sequence opt2 from anti-HIV-1_HeavyChain
caggcccaccucgagcaguccggcuccggcgucaagaagcccggcgccuccguccgcgucuccugcugguccuccgaggacaucuucgagcgcaccgagcucauccacuggguccgccaggcccccggccagggccucgaguggaucggcugggucaagaccgucaccggcgccgucaacuucggcucccucgacuuccgccaccgcaucucccccacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccucaucgucgucuccucc

SEQ ID NO: 18785 - RNA, 384 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgccucccucgacuuccgcaaccgcaucucccucucccgcgaccgcgaccuccccaccgccuacauggacauccgcggccucacccaggacgacaccgccaccuacuucugcgcccgccagaaguucgccucccgcuacuccggcgaccagggcuccuacuucgaccucuggggccgcggcacccucaucgucgucuccucc

SEQ ID NO: 18786 - RNA, 384 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgacaccaccgagcucaucuacuggguccgccaggcccccggccagggccucgaguggaucggcugggucaagaucgccuccggcaccgucaacuucgccucccucgacuuccgcaaccgcaucucccucucccgcgaccgcgaccucuccaccgcccacauggacauccgcggccucacccaggacgacaccgccaccuacuucugcgcccgccagaaguucgccucccgcuacuccggcgaccagggcuccuacuucgaccucuggggccgcggcacccucaucgucgucuccucc

SEQ ID NO: 18787 - RNA, 384 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgacaccaccgagcucaucuacuggguccgccaggcccccggccagggccucgaguggaucggcugggucaagaccgucaccggcgccgucaacuucggcucccucgacuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccucc

SEQ ID NO: 18788 - RNA, 384 nt, Artificial Sequence
  derived and/or modified sequence opt2 from anti-HIV-1_HeavyChain
cagguccagcucguccaguccggcgccgaggucaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgccucccucgacuuccgcaaccgcaucucccucucccgcgaccgcgaccucuccaccgcccacauggacauccgcggccuccgccaggacgacaccgccaccuacuucugcgcccgccagaaguucgagucccgcuacuccggcgaccagggcuccuacuucgaccucuggggccgcggcacccucaucaucgucuccucc

SEQ ID NO: 18789 - RNA, 384 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgccucccucgacuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccucc

SEQ ID NO: 18790 - RNA, 384 nt, Artificial Sequence
  derived and/or modified sequence opt2 from anti-HIV-1_HeavyChain
caggcccaccucgagcaguccgccuccggcgucaagcgccccggcgccuccguccgcgucuccugcuggaccuccgaggacaucuucgagcgcuccgagcucaucuacuggguccgccaggcccccggccagggccucgaguggaucggcugggucaagaccgucaccggcgccgucaacuucggcucccucgacuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccucc

SEQ ID NO: 18791 - RNA, 384 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucgagucccucuacuccgacgaccagggcuccuacuucgaccucuggggccgcggcacccucaucaucgucuccucc

SEQ ID NO: 18792 - RNA, 384 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgagcgcaccgagcucaucuacuggguccgccaggcccccggccgcggccucgaguggaucggcugggucaagaccgucuccggcaccgucaacuucggcuccuccgacuuccgcaaccgcaucucccucacccgcgaccgcgaccucuccaccgcccacauggacauccgcggccucacccaggacgacaccgccaccuacuucugcgcccgccagaaguucgagucccucuacuccgacgaccagggcuccuacuucgaccucuggggccgcggcacccucaucgucgucuccucc

SEQ ID NO: 18793 - RNA, 384 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccucc

SEQ ID NO: 18794 - RNA, 381 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacauccuccgcaaguccgagcucauccacuggguccgccaggcccccggccagggccucgaguggaucggcugggucaagaccgucaccggcgccgucaacuucggccaccagaucuccgaccgcgucucccucacccgcgaccgcgaccucuccaccgcccacauggacauccgcggccucacccaggacgacaccgccaccuacuucugcgcccgccagaaguucgagucccucuacuccgacgaccagggcuccuacuucgaccucuggggccgcggcacccucaucaucgucuccucc

SEQ ID NO: 18795 - RNA, 384 nt, Artificial Sequence
  derived and/or modified sequence opt2 from anti-HIV-1_HeavyChain
cccgcccaccucgagcaguccggcuccggcgucaagaagcccggcgccuccguccgcgucuccugcugggccuccgaggacaucuucgagcgcaccgagcucauccacuggguccgccaggcccccggccagggccucgaguggaucggcugggucaagaccgucaccggcgccgucaacuucggcucccucgacuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccucc

SEQ ID NO: 18796 - RNA, 384 nt, Artificial Sequence
  derived and/or modified sequence opt2 from anti-HIV-1_HeavyChain
caggcccaccucgagcaguccgccuccggcgucaagcgccccggcgccuccguccgcgucuccugcuggaccuccgaggacaucuucgagcgcuccgagcucaucuacuggguccgccaggcccccggccagggccucgaguggaucggcugggucaagaccgucuccggcgccgucaacuucggcuccaccgacuuccgcgagcgcaucucccucucccgcgaccgcgaccucuccaccgccuacauggacauccgcggccucacccaggacgacgccgccaccuacuucugcgcccgccagaaguucgccucccgcuacuccggcgaccagggcuccuacuucgaccucuggggccgcggcacccucaucgucgucuccucc

SEQ ID NO: 18797 - RNA, 384 nt, Artificial Sequence
  derived and/or modified sequence opt2 from anti-HIV-1_HeavyChain
caggcccaccucgagcaguccggcuccggcgucaagaagcccggcgccuccguccgcgucuccugcugguccuccgaggacaucuucgagcgcaccgagcucauccacuggguccgccaggcccccggccagggccucgaguggaucggcugggucaagaccgucaccggcgccgucaacuucggcucccucgaccuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccucc

SEQ ID NO: 18798 - RNA, 384 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccucgacuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccucaucgucgucuccucc

SEQ ID NO: 18799 - RNA, 384 nt, Artificial Sequence
  derived and/or modified sequence opt2 from anti-HIV-1_HeavyChain
ucccacgaccucgagcaguccggcuccgccaugaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgccucccucgacuuccgcaaccgcaucucccucucccgcgaccgcgaccucuccaccgccuacauggacauccgcggccucacccaggacgacaccgccaccuacuucugcgcccgccagaaguucgccucccgcuacuccggcgaccagggcuccuacuucgaccucuggggccgcggcacccucaucgucgucuccucc

SEQ ID NO: 18800 - RNA, 384 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgagcgcaccgagcucauccacuggguccgccaggcccccggccagggccucgaguggaucggcugggucaaggccgucaccggcgccgucaacuucggcucccucgacuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccucc

SEQ ID NO: 18801 - RNA, 384 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgccucccgcuacuccggcgaccagggcuccuacuucgaccucuggggccgcggcacccucaucgucgucuccucc

SEQ ID NO: 18802 - RNA, 384 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgccuccuccgacuuccgcaaccgcaucucccucucccgcgaccgcgaccucuccaccgcccacaugggcauccgcggccuccgccaggacgacaccgccaccuacuucugcgcccgccagaaguucgagucccgcuacuccggcgaccagggcuccuacuucgaccucuggggccgcggcacccucaucaucgucuccucc

SEQ ID NO: 18803 - RNA, 384 nt, Artificial Sequence
  derived and/or modified sequence opt2 from anti-HIV-1_HeavyChain
gagguccagcucguccaguccggcgccgacgucaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgccucccucgacuuccgcaaccgcaucucccucucccgcgaccgcgaccucuccaccgccuacauggacauccgcggccucacccaggacgacaccgccaccuacuucugcgcccgccagaaguucgccucccgcuacuccggcgaccagggcuccuacuucgaccucuggggccgcggcacccucaucgucgucuccucc

SEQ ID NO: 18804 - RNA, 384 nt, Artificial Sequence
  derived and/or modified sequence opt2 from anti-HIV-1_HeavyChain
caggcccaccucgagcaguccggcuccggcgucaagaagcccggcgccuccguccgcgucuccugcugguccuccgaggacaucuucgagcgcaccgagcucauccacuggguccaccaggcccccggccagggccucgaguggaucggcugggucaagaccgucaccggcgccgucaacuucggcucccucgacuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccucc

SEQ ID NO: 18805 - RNA, 384 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgccucccucgacuuccgcaaccgcaucucccucucccgcgaccgcgcccucuccaccgcccacauggacauccgcggccucacccaggacgacaccgccaccuacuucugcgcccgccagaaguucgccucccgcuacuccggcgaccagggcuccuacuucgaccucuggggccgcggcacccucaucaucgucuccucc

SEQ ID NO: 18806 - RNA, 384 nt, Artificial Sequence
  derived and/or modified sequence opt2 from anti-HIV-1_HeavyChain
caggcccaccucgagcaguccggcuccggcgucaagaagcccggcgccuccguccgcgucuccugcugguccuccgaggacaucuucgagcgcaccgagcucauccacuggguccgccaggcccccggccagggccucgaguggaucggcugggucaagaccgucaccggcgccgucaacuucgccucccucgacuuccgcaaccgcaucucccucucccgcgaccgcgaccucuccaccgccuacauggacauccgcggccucacccaggacgacaccgccaccuacuucugcgcccgccagaaguucgccucccgcuacuccggcgaccagggcuccuacuucgaccucuggggccgcggcacccucaucgucgucuccucc

SEQ ID NO: 18807 - RNA, 384 nt, Artificial Sequence
  derived and/or modified sequence opt2 from anti-HIV-1_HeavyChain
caggcccaccucgagcaguccgccuccggcguccgccgccccggcgccuccguccgcgucuccugcuggaccuccgaggacaucuucgagcgcuccgagcucaucuacuggguccgccaggcccccggccgcggccucgaguggaucggcuggaucaagcucgucuccggcgccgucaacuucgccucccucgacuuccgcaaccgcaucucccucucccgcgaccgcgaccucuccaccgccuacauggacauccgcggccucacccaggacgacaccgccaccuacuucugcgcccgccagaaguucgccucccgcuacuccggcgaccagggcuccuacuucgaccucuggggccgcggcacccucaucgucgucuccucc

SEQ ID NO: 18808 - RNA, 384 nt, Artificial Sequence
  derived and/or modified sequence opt2 from anti-HIV-1_HeavyChain
caggcccaccucgagcaguccggcuccggcgucaagaagcccggcgccuccguccgcgucuccugcugguccuccgaggacaucuucgagcgcaccgagcucauccacuggguccgccaggcccccggccagggccucgaguggaucggcugggucaagaccgucaccggcgccgucaacuucggcucccucgacuuccgccaccgcaucucccucacccgcgaccgcgaccucuucaccgcccacauggacauccgcggccucacccaggacgacaccgccaccuacuucugcgcccgccagaaguucgccucccgcuacuccggcgaccagggcuccuacuucgaccucuggggccgcggcacccucaucaucgucuccucc

SEQ ID NO: 18809 - RNA, 384 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgacaccaccgagcucaucuacuggguccgccaggcccccggccagggccucggcuggaucggcugggucaagaucgucuccggcaccgucaacuucgccucccucgacuuccgcucccgcaucucccucucccgcgaccgcgaccucuccaccgccuacauggacauccgcggccucacccaggacgacaccgccaccuacuucugcgcccgccagaaguucgccucccgcuacuccggcgaccagggcuccuacuucgaccucuggggccgcggcacccucaucgucgucuccucc

SEQ ID NO: 18810 - RNA, 384 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggccaagaccgucaccggcgccgucaacuucggcucccucgacuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccucc

SEQ ID NO: 18811 - RNA, 384 nt, Artificial Sequence
  derived and/or modified sequence opt2 from anti-HIV-1_HeavyChain
caggcccaccucgagcaguccggcuccgccaugaagaagcccggcgccuccguccgcgucuccugcuggaccuccgaggacaucuucgagcgcaccgagcucaucuacuggguccgccaggcccccggccgcggccucgaguggaucggcugggucaagaccgucuccggcaccgucaacuucggcuccuccgacuuccgcaaccgcaucucccucacccgcgaccgcgaccucuccaccgcccacauggacauccgcggccucacccaggacgacaccgccaccuacuucugcgcccgccagaaguucgagucccucuacuccgacgaccagggcuccuacuucgaccucuggggccgcggcacccucaucaucgucuccucc

SEQ ID NO: 18812 - RNA, 384 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucggcucccucgacuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccucc

SEQ ID NO: 18813 - RNA, 384 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgccucccucgacuuccgcaaccgcaucucccucucccgcgaccgcgaccucuccaccgccuacauggacauccgcggccucacccaggacgacaccgccaccuacuucugcgcccgccagaaguucgccucccgcuacuccggcgaccagggcuccuacuucgaccucuggggccgcggcacccucaucgucgucuccucc

SEQ ID NO: 18814 - RNA, 384 nt, Artificial Sequence
  derived and/or modified sequence opt2 from anti-HIV-1_HeavyChain
ucccacaaccucgagcaguccggcuccgccaugaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgccucccucgacuuccgcaaccgcaucucccucucccgcgaccgcgaccucuccaccgccuacauggacauccgcggccucacccaggacgacaccgccaccuacuucugcgcccgccagaaguucgccucccgcuacuccggcgaccagggcuccuacuucgaccucuggggccgcggcacccucaucgucgucuccucc

SEQ ID NO: 18815 - RNA, 384 nt, Artificial Sequence
  derived and/or modified sequence opt2 from anti-HIV-1_HeavyChain
ucccacaccuggaacaaccgcggcuccgccaugaagaagcccggcgccuccguccgcgucuccugcuggaccuccgaggacaucuucgagcgcaccgagcucaucuacuggguccgccaggcccccggccgcggccucgaguggaucggcugggucaagaccgucuccggcaccgucaacuucggcuccuccgacuuccgcaaccgcaucucccucucccgcgaccgcgaccucuccaccgcccacauggacauccgcggccucacccaggacgacaccgccaccuacuucugcgcccgccagaaguucgccucccgcuacuccggcgaccagggcuccuacuucgaccucuggggccgcggcacccucaucaucgucuccucc

SEQ ID NO: 18816 - RNA, 384 nt, Artificial Sequence
  derived and/or modified sequence opt2 from anti-HIV-1_HeavyChain
ucccacaccuggaacgaguccggcuccgccaugaagaagcccggcgccuccguccgcgucuccugcuggaccuccgaggacaucuucgagcgcaccgagcucaucuacuggguccgccaggcccccggccgcggccucgaguggaucggcugggucaagaucgucuccggcaccgucaacuucgccucccucgacuuccgcaaccgcaucucccucucccgcgaccgcgaccucuccaccgccuacauggacauccgcggccucacccaggacgacaccgccaccuacuucugcgcccgccagaaguucgccucccgcuacuccggcgaccagggcuccuacuucgaccucuggggccgcggcacccucaucgucgucuccucc

SEQ ID NO: 18817 - RNA, 384 nt, Artificial Sequence
  derived and/or modified sequence opt2 from anti-HIV-1_HeavyChain
cgccacaccugggagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuacggcucccucaacuuccgcucccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccucc

SEQ ID NO: 18818 - RNA, 384 nt, Artificial Sequence
  derived and/or modified sequence opt2 from anti-HIV-1_HeavyChain
caggcccaccucgagcaguccggcuccggcgucaagaagcccggcgccuccgucaaggucuccugcuggaccuccgaggacaucuucgagcgcaccgagcucauccacuggguccgccaggcccccggccagggccucgaguggaucggcugggucaagaccgucaccggcgccgucaacuucggcucccucgacuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccucc

SEQ ID NO: 18819 - RNA, 384 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagggcuccgagcucauccacuggguccgccaggcccccggccagggccucgaguggaucggcugggucaagaccgucaccggcgccgucaacuucggcuccgccuacuuccgccaccgcgucucccucacccgcgaccgcgaccucuccaccgccuacauggacauccgcggccucacccaggacgacaccgccaccuacuucugcgcccgccagaaguucgccucccgcuacuccggcgaccagggcuccuacuucgaccucuggggccgcggcacccucaucgucgucuccucc

SEQ ID NO: 18820 - RNA, 384 nt, Artificial Sequence
  derived and/or modified sequence opt2 from anti-HIV-1_HeavyChain
ggccacgaccucgagcaguccggcuccggcgucaagaagcccggcgccuccguccgcgucuccugcuggaccuccgaggacaucuucgagggcuccgagcucauccacuggguccgccaggcccccggccagggccucgaguggaucggcugggucaagaccgucaccggcgccgucaacuucggcuccgccuacuuccgccaccgcaucucccucucccgcgaccgcgaccucuccaccgccuacauggacauccgcggccucacccaggacgacaccgccaccuacuucugcgcccgccagaaguucgccucccgcuacuccggcgaccagggcuccuacuucgaccucuggggccgcggcacccucaucgucgucuccucc

SEQ ID NO: 18821 - RNA, 384 nt, Artificial Sequence
  derived and/or modified sequence opt2 from anti-HIV-1_HeavyChain
ucccacaccuggaacaaccgcggcuccgccaugaagaagcccggcgccuccguccgcgucuccugcuggaccuccgaggacaucuucgacaccaccgagcucaucuacuggguccgccaggcccccggccagggccucgaguggaucggcugggucaagaccgucuccggcaccgucaacuucggcuccuccgacuuccgcaaccgcaucucccucacccgcgaccgcgaccucuccaccgcccacauggacauccgcggccucacccaggacgacaccgccaccuacuucugcgcccgccagaaguucgagucccucuacuccgacgaccagggcuccuacuucgaccucuggggccgcggcacccucaucaucgucuccucc

SEQ ID NO: 18822 - RNA, 384 nt, Artificial Sequence
  derived and/or modified sequence opt2 from anti-HIV-1_HeavyChain
cgccacaccugggagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucuccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccucc

SEQ ID NO: 18823 - RNA, 384 nt, Artificial Sequence
  derived and/or modified sequence opt2 from anti-HIV-1_HeavyChain
ucccacaccuggaacaaccgcggcuccgccaugaagaagcccggcgccuccguccgcgucuccugcuggaccuccgaggacaucuucgagcgcaccgagcucaucuacuggguccgccaggcccccggccgcggccucgaguggaucggcugggucaagaccgucuccggcaccgucaacuucggcuccuccgacuuccgcaaccgcaucucccucacccgcgaccgcgaccucuccaccgcccacauggacauccgcggccucacccaggacgacaccgccaccuacuucugcgcccgccagaaguucgagucccucuacuccgacgaccagggcuccuacuucgaccucuggggccgcggcacccucaucaucgucuccucc

SEQ ID NO: 18824 - RNA, 384 nt, Artificial Sequence
  derived and/or modified sequence opt2 from anti-HIV-1_HeavyChain
cagucccaccucgagcaguccggcuccgccaugaagaagcccggcgccuccguccgcgucuccugccucgccuccgaggacaucuucgacaccaccgagcucaucuacuggguccgccaggcccccggccagggccucgaguggaucggcugggucaagaucgucuccggcaccgucaacuucgccucccucgacuuccgcaaccgcaucucccucucccgcgaccgcgaccucuccaccgccuacauggacauccgcggccucacccaggacgacaccgccaccuacuucugcgcccgccagaaguucgccucccgcuacuccggcgaccagggcuccuacuucgaccucuggggccgcggcacccucaucgucgucuccucc

SEQ ID NO: 18825 - RNA, 384 nt, Artificial Sequence
  derived and/or modified sequence opt2 from anti-HIV-1_HeavyChain
cagucccaccucgagcaguccggcgccgccaugaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgccucccucgacuuccgcaaccgcaucucccucucccgcgaccgcgaccucuccaccgcccacauggacauccgcggccuccgccaggacgacaccgccaccuacuucugcgcccgccagaaguucgagucccgcuacuccggcgaccagggcuccuacuucgaccucuggggccgcggcacccucaucaucgucuccucc

SEQ ID NO: 18826 - RNA, 384 nt, Artificial Sequence
  derived and/or modified sequence opt2 from anti-HIV-1_HeavyChain
cgccacaccugggagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccucc

SEQ ID NO: 18827 - RNA, 384 nt, Artificial Sequence
  derived and/or modified sequence opt2 from anti-HIV-1_HeavyChain
ucccacaccuggaacgaguccggcuccgccaugaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgccucccucgacuuccgcaaccgcaucucccucucccgcgaccgcgaccucuccaccgccuacauggacauccgcggccucacccaggacgacaccgccaccuacuucugcgcccgccagaaguucgccucccgcuacuccggcgaccagggcuccuacuucgaccucuggggccgcggcacccucaucgucgucuccucc

SEQ ID NO: 18828 - RNA, 384 nt, Artificial Sequence
  derived and/or modified sequence opt2 from anti-HIV-1_HeavyChain
cgccacaccuggaacgaguccggcuccggcgucaagaagcccggcgccuccguccgcgucuccugcugguccuccgaggacaucuucgagcgcaccgagcucauccacuggguccgccaggcccccggccgcggccucgaguggaucggcugggucaagaccgucuccggcaccgucaacuucggcuccuccgacuuccgcaaccgcaucucccucacccgcgaccgcgaccucuccaccgcccacauggacauccgcggccucacccaggacgacaccgccaccuacuucugcgcccgccagaaguucgagucccucuacuccgacgaccagggcuccuacuucgaccucuggggccgcggcacccucaucaucgucuccucc

SEQ ID NO: 18829 - RNA, 384 nt, Artificial Sequence
  derived and/or modified sequence opt2 from anti-HIV-1_HeavyChain
cagucccaccucgagcaguccggcuccgagaugaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgccucccucgacuuccgcaaccgcaucucccucucccgcgaccgcgaccucuccaccgccuacauggacauccgcggccucacccaggacgacaccgccaccuacuucugcgcccgccagaaguucgccucccgcuacuccggcgaccagggcuccuacuucgaccucuggggccgcggcacccucaucgucgucuccucc

SEQ ID NO: 18830 - RNA, 384 nt, Artificial Sequence
  derived and/or modified sequence opt2 from anti-HIV-1_HeavyChain
cgccacaccugggagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcaccgucaacuucggcucccucaacuuccgccagcgcgucucccucacccgcgaccgcgaccucuucaccgcccacauggacauccgcggccucacccagggcgacaccgccaccuacuucugcgcccgccagaaguucgagucccucuacuccgacgaccagggcuccuacuucgaccucuggggccgcggcacccucaucaucgucuccucc

SEQ ID NO: 18831 - RNA, 384 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcuccgagcucauccacuggguccgccaggcccccggccagggccucgaguggaucggcugggucaagaccgucaccggcgccgucaacuucggcucccagaucuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccucc

SEQ ID NO: 18832 - RNA, 384 nt, Artificial Sequence
  derived and/or modified sequence opt2 from anti-HIV-1_HeavyChain
ucccacaccuggaacaaguccggcuccgccaugaagaagcccggcgccuccguccgcgucuccugcuggaccuccgaggacaucuucgagcgcaccgagcucaucuacuggguccgccaggcccccggccgcggccucgaguggaucggcugggucaagaccgucuccggcaccgucaacuucggcuccuccgacuuccgcaaccgcaucucccucacccgcgaccgcgaccucuccaccgcccacauggacauccgcggccucacccaggacgacaccgccaccuacuucugcgcccgccagaaguucgagucccucuacuccgacgaccagggcuccuacuucgaccucuggggccgcggcacccucaucaucgucuccucc

SEQ ID NO: 18833 - RNA, 384 nt, Artificial Sequence
  derived and/or modified sequence opt2 from anti-HIV-1_HeavyChain
caggcccaccucgagcaguccggcuccggcgucaagaagcccggcgccuccguccgcgucuccugcugguccuccgaggacaucuucgagcgcaccgagcucauccacuggguccgccaggcccccggccagggccucgaguggaucggcugggucaagaccgucaccggcgccgucaacuucggcucccagaucuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggccccacccucuucgucuccucc

SEQ ID NO: 18834 - RNA, 384 nt, Artificial Sequence
  derived and/or modified sequence opt2 from anti-HIV-1_HeavyChain
caggcccaccucgagcaguccgccuccggcguccgccgccccggcgccuccguccgcgucuccugcuggaccuccgaggacaucuucgagcgcuccgagcucaucuacuggguccgccaggcccccggccgcggccucgaguggaucggcuggaucaagaccugcuccggcgccgucaacuucggcuccgucgacuuccgcgaccgcgucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccucc

SEQ ID NO: 18835 - RNA, 384 nt, Artificial Sequence
  derived and/or modified sequence opt2 from anti-HIV-1_HeavyChain
ucccacaccgucgagcaguccggcuccgccaugaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgccucccucgacuuccgcaaccgcaucucccucucccgcgaccgcgaccucuccaccgccuacauggacauccgcggccucacccaggacgacaccgccaccuacuucugcgcccgccagaaguucgccucccgcuacuccggcgaccagggcuccuacuucgaccucuggggccgcggcacccucaucgucgucuccucc

SEQ ID NO: 18836 - RNA, 384 nt, Artificial Sequence
  derived and/or modified sequence opt2 from anti-HIV-1_HeavyChain
cgccacaccuggaacaaguccggcuccggcgucaagaagcccggcgccuccguccgcgucuccugcugguccuccgaggacaucuucgagcgcaccgagcucauccacuggguccgccaggcccccggccagggccucgaguggaucggcugggucaagaccgucaccggcgccgucaacuucggcucccucgacuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccucc

SEQ ID NO: 18837 - RNA, 384 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagcgccucgaguggaucggcugggucaagaccgucaccggcgccgucaacuucggcucccccaacuuccgccaccgcgucucccucacccgcgaccgcgaccucuccaccgccuacauggacauccgcggccucacccaggacgacaccgccaccuacuucugcgcccgccagaaguucgccucccgcuacuccggcgaccagggcuccuacuucgaccucuggggccgcggcacccucaucgucgucuccucc

SEQ ID NO: 18838 - RNA, 384 nt, Artificial Sequence
  derived and/or modified sequence opt2 from anti-HIV-1_HeavyChain
ucccacgaccucgagcaguccggcuccgccaugaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgccucccucgacuuccgcaaccgcaucucccucucccgcgaccgcgaccucuccaccgcccacauggacauccgcggccuccgccaggacgacaccgccaccuacuucugcgcccgccagaaguucgagucccgcuacuccggcgaccagggcuccuacuucgaccucuggggccgcggcacccucaucaucgucuccucc

SEQ ID NO: 18839 - RNA, 384 nt, Artificial Sequence
  derived and/or modified sequence opt2 from anti-HIV-1_HeavyChain
cgccacaccuggaacgaguccggcuccggcgucaagaagcccggcgccuccguccgcgucuccugcugguccuccgaggacaucuucgagcgcaccgagcucauccacuggguccgccaggcccccggccagggccucgaguggaucggcugggucaagaccgucaccggcgccgucaacuucggcucccucgacuuccgccaccgcaucucccucacccgcgaccgcgaccucuucaccgcccacauggacauccgcggccucacccagggcgacaccaccaccuacuucugcgcccgccagaaguucgagucccgcuacaccggcggccagggcugguacuucgaccucuggggccgcggcacccacaucgucgucuccucc

SEQ ID NO: 18840 - RNA, 384 nt, Artificial Sequence
  derived and/or modified sequence opt2 from anti-HIV-1_HeavyChain
cgccacaccugggagcaggucugguccggcgucaagaagcccggcgccuccguccgcgucuccugcugguccuccgaggacaucuucgagcgcaccgagcucauccacuggguccgccaggcccccggccagggccucgaguggaucggcugggucaagaccgucaccggcgccgucaacuucggcucccucgacuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccucc

SEQ ID NO: 18841 - RNA, 384 nt, Artificial Sequence
  derived and/or modified sequence opt2 from anti-HIV-1_HeavyChain
cagucccaccucgagcaguccggcuccgccaugaagaagcccggcgccuccgucaccgucuccugcuggaccuccgaggacaucuucgacaccaccgagcucaucuacuggguccgccaggcccccggccagggccucgaguggaucggcugggucaagaucgucuccggcaccgucaacuucgccucccucgacuuccgcaaccgcaucucccucucccgcgaccgcgaccucuccaccgccuacauggacauccgcggccucacccaggacgacaccgccaccuacuucugcgcccgccagaaguucgccucccgcuacuccggcgaccagggcuccuacuucgaccucuggggccgcggcacccucaucgucgucuccucc

SEQ ID NO: 18842 - RNA, 384 nt, Artificial Sequence
  derived and/or modified sequence opt2 from anti-HIV-1_HeavyChain
cgccacgaccucgagcaguccggcuccggcgucaagaagcccggcgccuccguccgcgucuccugcugguccuccgaggacaucuucgagcgcaccgagcucauccacuggguccgccaggcccccggccagggccucgaguggaucggcugggucaagaccgucaccggcgccgucaacuucggcucccucgacuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccucc

SEQ ID NO: 18843 - RNA, 384 nt, Artificial Sequence
  derived and/or modified sequence opt2 from anti-HIV-1_HeavyChain
gucaccaccuggaacaaguccggcuccgccaugaagaagcccggcgccuccguccgcgucuccugcuggaccuccgaggacaucuucgacaccaccgagcucaucuacuggguccgccaggcccccggccgcggccucgaguggaucggcugggucaagaccgucuccggcaccgucaacuucggcuccuccgacuuccgcaaccgcaucucccucacccgcgaccgcgaccucuccaccgcccacauggacauccgcggccucacccaggacgacaccgccaccuacuucugcgcccgccagaaguucgagucccucuacuccgacgaccagggcuccuacuucgaccucuggggccgcggcacccucaucaucgucuccucc

SEQ ID NO: 18844 - RNA, 384 nt, Artificial Sequence
  derived and/or modified sequence opt2 from anti-HIV-1_HeavyChain
cgccacaccuggaacaacaccggcuccggcgucaagaagcccggcgccuccguccgcgucuccugccucgccuccgaggacaucuucgagcgcaccgagcucauccacuggguccgccaggcccccggccagggccucgaguggaucggcugggucaagaccgucaccggcgccgucaacuucggcucccucgacuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccucc

SEQ ID NO: 18845 - RNA, 384 nt, Artificial Sequence
  derived and/or modified sequence opt2 from anti-HIV-1_HeavyChain
cagucccaccucgagcaguccggcuccgccaugaagaagcccggcgccuccguccgcgucuccugccucgccuccgaggacaucuucgagcgcaccgagcucaucuacuggguccgccaggcccccggccgcggccccgaguggaucggcugggucaagaccgucuccggcaccgucaacuucggcuccuccgacuuccgcaaccgcaucucccucacccgcgaccgcgaccucuccaccgcccacauggacauccgcggccucacccaggacgacaccgccaccuacuucugcgcccgccagaaguucgagucccucuacuccgacgaccagggcuccuacuucgaccucuggggccgcggcacccucaucaucgucuccucc

SEQ ID NO: 18846 - RNA, 384 nt, Artificial Sequence
  derived and/or modified sequence opt2 from anti-HIV-1_HeavyChain
cgccacaccuggaacaacaccggcuccggcgucaagaagcccggcgccuccguccgcgucuccugcuggaccuccgacgacaucuucgagcgcaccgagcucauccacuggguccgccaggcccccggccagggccucgaguggaucggcugggucaagaccgucuccggcaccgucaacuucgccucccucgacuuccgcaaccgcaucucccucucccgcgaccgcgaccucuccaccgccuacauggacauccgcggccucacccaggacgacaccgccaccuacuucugcgcccgccagaaguucgccucccgcuacuccggcgaccagggcuccuacuucgaccucuggggccgcggcacccucaucgucgucuccucc

SEQ ID NO: 18847 - RNA, 384 nt, Artificial Sequence
  derived and/or modified sequence opt2 from anti-HIV-1_HeavyChain
ggcacccccggcaacaaguccggcuccggcgucaagaagcccggcgccuccguccgcgucuccugcugguccuccgaggacaucuucgagcgcaccgagcucauccacuggguccgccaggcccccggccagggccucgaguggaucggcugggucaagaccgucaccggcgccgucaacuucggcucccucgacuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccucc

SEQ ID NO: 18848 - RNA, 384 nt, Artificial Sequence
  derived and/or modified sequence opt2 from anti-HIV-1_HeavyChain
ggcacccccggcuccgaguccggcuccggcgucaagcgccccggcgccuccguccgcgucuccugcuggaccuccgaggacaucuucgagaccaccgagcucauccacuggguccgccaggcccccggccagggccucgaguggaucggcugggucaagaccgucuccggcgccgucaacuucggcucccucaacuuccgccaccgcgucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccucc

SEQ ID NO: 18849 - RNA, 384 nt, Artificial Sequence
  derived and/or modified sequence opt2 from anti-HIV-1_HeavyChain
gucacccccggcaccaaccucggccuccgcaugaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgccucccucgacuuccgcaaccgcaucucccucucccgcgaccgcgaccucuccaccgccuacauggacauccgcggccucacccaggacgacaccgccaccuacuucugcgcccgccagaaguucgccucccgcuacuccggcgaccagggcuccuacuucgaccucuggggccgcggcacccucaucgucgucuccucc

SEQ ID NO: 18850 - RNA, 384 nt, Artificial Sequence
  derived and/or modified sequence opt2 from anti-HIV-1_HeavyChain
cgccacgaccucgagcaguccggcgccggcgucaagaagcccggcgccuccguccgcgucuccugcugguccuccgaggacaucuucgagcgcaccgagcucauccacuggguccgccaggcccccggccagggccucgaguggaucggcugggucaagaccgucaccggcgccgucaacuucggcucccucgacuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccucc

SEQ ID NO: 18851 - RNA, 384 nt, Artificial Sequence
  derived and/or modified sequence opt2 from anti-HIV-1_HeavyChain
cagguccaccucgagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcuccuccgacuuccgccagcgcgucucccucacccccgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccucc

SEQ ID NO: 18852 - RNA, 384 nt, Artificial Sequence
  derived and/or modified sequence opt2 from anti-HIV-1_HeavyChain
ggcaccaccugggagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcucccucgacuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccucc

SEQ ID NO: 18853 - RNA, 384 nt, Artificial Sequence
  derived and/or modified sequence opt2 from anti-HIV-1_HeavyChain
ucccacgaccucgagcaguccggcuccgaguggaagaagcccggcgccuccguccgcgucuccugcuggaccuccgaggacaucuucgacaccaccgagcucauccacuggguccgccaggcccccggccagggccucgaguggaucggcugggucaagaccgucaccggcgccgucaacuucggcucccucgacuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccucc

SEQ ID NO: 18854 - RNA, 384 nt, Artificial Sequence
  derived and/or modified sequence opt2 from anti-HIV-1_HeavyChain
cagucccgccccggcaacaaguccggcuccgccaugaagaagcccggcgccuccguccgcgucuccugcuggaccuccgaggacaucuucgagcgcaccgagcuccucuggguccgccaggcccccggccgcggccucgaguggaucggcugggucaagaccgucuccggcaccgucaacuucggcuccuccgacuuccgcaaccgcaucucccucacccgcgaccgcgaccucuccaccgcccacauggacauccgcggccucacccaggacgacaccgccaccuacuucugcgcccgccagaaguucgagucccucuacuccgacgaccagggcuccuacuucgaccucuggggccgcggcacccucaucaucgucuccucc

SEQ ID NO: 18855 - RNA, 384 nt, Artificial Sequence
  derived and/or modified sequence opt2 from anti-HIV-1_HeavyChain
ggcaccaccugguccaaguccggcuccggcgucaagaagcccggcgccuccguccgcgucuccugcuggaccuccgaggacaucuucgagcgcaccgagcucaucuacuggguccgccaggcccccggccagggccucgaguggaucggcugggucaagaucgucuccggcaccgucaacuucgccucccucgacuuccgcaaccgcaucucccucucccgcgaccgcgaccucuccaccgcccacauggacauccgcggccucacccaggacgacaccgccaccuacuucugcgcccgccagaaguucgccucccgcuacuccggcgaccagggcuccuacuucgaccucuggggccgcggcacccucaucaucgucuccucc

SEQ ID NO: 18856 - RNA, 387 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacauccuccgcaagaagcgcgucgacuccgucggcugcgacaccgcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccaggacgacaccgccaccuacuucugcgcccgccagaaguucgccucccgcuacuccggcgaccagggcuccuacuucgaccucuggggccgcggcacccucaucgucgucuccucc

SEQ ID NO: 18857 - RNA, 387 nt, Artificial Sequence
  derived and/or modified sequence opt2 from anti-HIV-1_HeavyChain
aaggcccaccucggcaacaaguccggcuccggcgucaagaagcccggcgccuccguccgcgucuccugcugguccuccgaggacaucuucgagcgcaccgagcucauccacuggguccgccaggcccccggccagggccucgaguggaucggcugggucaagaccgucaccggcgccgucaacuucggcucccucgacuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccucc

SEQ ID NO: 18858 - RNA, 384 nt, Artificial Sequence
  derived and/or modified sequence opt2 from anti-HIV-1_HeavyChain
accaccgucggcaccauccucggccgcgccaugaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgccucccucgacuuccgcaaccgcaucucccucucccgcgaccgcgaccucuccaccgccuacauggacauccgcggccucacccaggacgacaccgccaccuacuucugcgcccgccagaaguucgccucccgcuacuccggcgaccagggcuccuacuucgaccucuggggccgcggcacccucaucgucgucuccucc

SEQ ID NO: 18859 - RNA, 384 nt, Artificial Sequence
  derived and/or modified sequence opt2 from anti-HIV-1_HeavyChain
cagucccaccucgagcaguccggcuccgccaugaagaagcccggcgccuccgucaaggucuccugcuggaccuccgaggacaucuucgacaccaccgagcucaucuacuggguccgccaggcccccggccagggccucgaguggaucggcugggucaagaucgucuccggcaccgucaacuucgccucccucgacuuccgcaaccgcaucucccucucccgcgaccgcgaccucuccaccgccuacauggacauccgcggccucacccaggacgacaccgccaccuacuucugcgcccgccagaaguucgccucccgcuacuccggcgaccagggcuccuacuucgaccucuggggccgcggcacccucaucgucgucuccucc

SEQ ID NO: 18860 - RNA, 387 nt, Artificial Sequence
  derived and/or modified sequence opt2 from anti-HIV-1_HeavyChain
cagucccaccucgagcaggucugggucugccaguccaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgccucccucgacuuccgcaaccgcaucucccucucccgcgaccgcgaccucuccaccgcccacauggacauccgcggccucacccaggacgacaccgccaccuacuucugcgcccgccagaaguucgccucccgcuacuccggcgaccagggcuccuacuucgaccucuggggccgcggcacccucaucaucgucuccucc

SEQ ID NO: 18861 - RNA, 384 nt, Artificial Sequence
  derived and/or modified sequence opt2 from anti-HIV-1_HeavyChain
cgccacaccgucgagcaguccggcuccggcgucaagaagcccggcgccuccguccgcgucuccugcugguccuccgaggacaucuucgagcgcaccgagcucauccacuggguccgccaggcccccggccagggccucgaguggaugggcugggucaagaccgucaccggcgccgucaacuucggcucccucgacuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccucc

SEQ ID NO: 18862 - RNA, 384 nt, Artificial Sequence
  derived and/or modified sequence opt2 from anti-HIV-1_HeavyChain
cagucccaccucgagcaguccggcuccgccaugaagaagcccggcgccuccguccgcgucuccugcuccgcccgcgaggacaucuucgacaccaccgagcucaucuacuggguccgccaggcccccggccagggccucgaguggaucggcugggucaagaucgucugcggcaccgucaacuucgccucccucgacuuccgcaaccgcaucucccucucccgcgaccgcgaccucuccaccgcccacauggacauccgcggccucacccaggacgacaccgccaccuacuucugcgcccgccagaaguucgccucccgcuacuccggcgaccagggcuccuacuucgaccucuggggccgcggcacccucaucaucgucuccucc

SEQ ID NO: 18863 - RNA, 387 nt, Artificial Sequence
  derived and/or modified sequence opt2 from anti-HIV-1_HeavyChain
gagguccagcgcggcggccgcgucgucggccgcgacgucaagaagcccggcgccuccguccgcgucuccugcuggaccuccgaggacaucuuccacaccgagcucaucuacuggguccgccaggcccccggccagggccucgaguggaucggcugggucaagaucgucuccggcaccgucaacuucgccucccucgacuuccgcaaccgcaucucccucucccgcgaccgcgaccucuccaccgccuacauggacauccgcggccucacccaggacgacaccgccaccuacuucugcgcccgccagaaguucgccucccgcuacuccggcgaccagggcuccuacuucgaccucuggggccgcggcacccucaucgucgucuccucc

SEQ ID NO: 18864 - RNA, 384 nt, Artificial Sequence
  derived and/or modified sequence opt2 from anti-HIV-1_HeavyChain
ggcaccaccuggaacgaguccggcuccggcgucaagaagcccggcgccuccguccgcguccccugcugguccuccgaggacaucuucgagcgcaccgagcucauccaccgcguccgccaggcccccggccagggccucgaguggaucggcugggucaagaccgucaccggcgccgucaacuucggcucccccaacuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccucc

SEQ ID NO: 18865 - RNA, 384 nt, Artificial Sequence
  derived and/or modified sequence opt2 from anti-HIV-1_HeavyChain
cgcuccaacuggguccaguccggcgccgacgucaagaagcccggcgccuccgucaaguccuccugcuggaccuccgaggacaucuucgacaccaccgagcucaucuacuggguccgccaggcccccggccagggccucgaguggaucggcugggucaagaucgucuccggcaccgucaacuucgccucccucgacuuccgcaaccgcaucucccucucccgcgaccgcgaccucuccaccgccuacauggacauccgcggccucacccaggacgacaccgccaccuacuucugcgcccgccagaaguucgccucccgcuacuccggcgaccagggcuccuacuucgaccucuggggccgcggcacccucaucgucgucuccucc

SEQ ID NO: 18866 - RNA, 384 nt, Artificial Sequence
  derived and/or modified sequence opt2 from anti-HIV-1_HeavyChain
cccguccagcucguccaguccggcgccgaggucaagaagcccggcgccuccgucaaggucuccugcuggaccuccgaggacaucuucgagcgcaccgagcucauccacuggguccgccaggcccccggccagggccucgaguggaucggcugggucaagaccgucaccggcgccgucaacuucggcucccucgacuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccucc

SEQ ID NO: 18867 - RNA, 399 nt, Artificial Sequence
  derived and/or modified sequence opt2 from anti-HIV-1_HeavyChain
cgcgaguaccucgagcaguccggcggcggcgucaagaagcucggcgccuccguccgcgucuccugccgcgccuccgaggaccucuucggcgacgaggccaucuacgacgacgagcucauccacuggcuccgccagguccccggccagcgccccgaguggaugggcuggauccgccccaagaccggcgcccgcaaccaggcccgccaguuccagccccgcaucaaccucucccgcgaccgcgcccucaacaccgccuaccucgaccucuccucccucaccuccgccgacuccgccaccuacuucugcgcccgccagaccuucaagcccgacuucuacuucgccgaccagggcugguccuucaaccucuggggccgcggcgcccgcgucaucgucuccucc

SEQ ID NO: 18868 - RNA, 399 nt, Artificial Sequence
  derived and/or modified sequence opt2 from anti-HIV-1_HeavyChain
cagguccagcucguccaguccggcaccgaggucaagaagcccggcgccucccuccgcgucuccugccgcgccuccgaggaccucuucggcgacaagaucaucuacgacgacgaggucauccacuggcuccgccagcuccccggccagcgccccgaguggaugggcuggauccgccccaaguccggcgcccgcaaccaggcccgccaguuccagccccgcaucucccucacccgcgaccgcgcccucuccaccgccuaccucgaccucaacucccucaccuccgccgacuccggcaccuacuucugcgcccgccagaccuucaagcccgacuucuacuucgccgaccagggcugguccuucaaccucuggggccgcggcgcccacuucaucgucuccucc

SEQ ID NO: 18869 - RNA, 399 nt, Artificial Sequence
  derived and/or modified sequence opt2 from anti-HIV-1_HeavyChain
caggcccaccucgagcaguccggcuccggcgucaagaagcccggcgccuccguccgcgucuccugccgcgccuccgaggaccucuucggcgacgagaucaucuacgacgacgaggucauccacuggcuccgccagguccccggccagcgccccgaguggaugggcuggauccgccccaagaccggcgcccgcaaccaggcccgccaguuccagccccgcaucucccucacccgcgaccgcgcccucuccaccgccuaccucgaccucaacucccucaccuccgccgacuccggcaccuacuucugcgcccgccagaccuucaagcccgacuucuacuucgccgaccagggcugguccuucaaccucuggggccgcggcgcccacuucaucgucuccucc

SEQ ID NO: 18870 - RNA, 399 nt, Artificial Sequence
  derived and/or modified sequence opt2 from anti-HIV-1_HeavyChain
ggcaacaucugguccgaguccggcggcggcgucaagaagcccggcgccuccguccgcgucuccugccgcgccuccgaggaccucuucggcgacgagaucaucuacgacgacgaggucauccacuggcuccgccagguccccggccagcgccccgaguggaugggcuggauccgccccaagaacggcggccgcaaccaggcccgccaguuccagccccgcaucucccucacccgcgaccgcgcccucaacaccgccuaccucgaccucaacucccucaccuccgccgacuccggcaccuacuucugcgcccgccagaccuucaagcccgacuucuacuucgccgaccagggcugguccuucaaccucuggggccgcggcgcccgcgucaucgucuccucc

SEQ ID NO: 18871 - RNA, 399 nt, Artificial Sequence
  derived and/or modified sequence opt2 from anti-HIV-1_HeavyChain
cagguccagcucguccaguccggcgccgaggucaagaagcccggcgccucccuccgcguccccugccgcgccuccgaggaccucuucggcgacgagaucaucuacgacgacgaggucauccacuggcuccgccagguccccggccagcgccccgaguggaugggcuggauccgccccaagaccggcgcccgcaaccaggcccgccaguuccagccccgcaucucccucacccgcgaccgcgcccucuccaccgccuaccucgaccucaacucccucaccuccgccgacuccggcaccuacuucugcgcccgccagaccuucaagcccgacuucuacuucgccgaccagggcugguccuucaaccucuggggccgcggcgcccacuucaucgucuccucc

SEQ ID NO: 18872 - RNA, 390 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaucgucuccggcgccgucaacuucggcucccccaacuuccgccagcgcgucucccucacccgcgaccgcgaccucuucaccgcccacauggacauccgcggccucacccagggcgacaccgccaccuacuucugcgcccgccagaaguucgagcgcggcggccagggcuggaucuucgaccucuggggccgcggcacccucaucgccgucuccuccgccucccgcuccgcc

SEQ ID NO: 18873 - RNA, 393 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuccaccgcccacauggacauccgcggccucacccaggacgacaccgccaccuacuucugcgcccgccagaaguucgcccgcggcgaccagggcugguucuucgaccucuggggccgcggcacccucaucgucgucuccuccgccuccacccgcuccacc

SEQ ID NO: 18874 - RNA, 414 nt, Artificial Sequence
  derived and/or modified sequence opt2 from anti-HIV-1_HeavyChain
cagguccagcucguccaguccggcgccgaggucaagaagcccggcgccuccgucaccgucuccugcaaggccucccgcuacaccuucaucaacuacuacauccacuggguccgccaggcccccggccagggccucgaguggaucggcugggucaagcccgucuccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgcccgcggcgaccagggcugguucuucgaccucuggggccgcggcacccucaucgucgucuccuccgccuccaccaagggccccuccgucuucccccacgaccuccgc

SEQ ID NO: 18875 - RNA, 414 nt, Artificial Sequence
  derived and/or modified sequence opt2 from anti-HIV-1_HeavyChain
cagguccagcucguccaguccggcgccgaggucaagaagcccggcgccuccgucaaggucuccugcaaggccuccggcuacaccaucacccgccacuacaugcacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccuccgccuccaccaagggccccuccgucuucccccacgaccuccgc

SEQ ID NO: 18876 - RNA, 408 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguacuacgccggcggccagggcugguacuucgaccucuggggccgcggcacccucaucgucgucuccuccgccuccaccaagggccccuccgacgaccuccgc

SEQ ID NO: 18877 - RNA, 411 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaucgucuccggcgccgucaacuucggcucccccaacuuccgccagcgcgucucccucacccgcgaccgcgaccucuucaccgcccacauggacauccgcggccucacccagggcgacaccgccaccuacuucugcgcccgccagaaguucgagcgcggcggccagggcuggaucuucgaccucuggggccgcggcacccucaucgccgucuccuccgccuccaccaagggccccuccgucuacgaccuccgc

SEQ ID NO: 18878 - RNA, 417 nt, Artificial Sequence
  derived and/or modified sequence opt2 from anti-HIV-1_HeavyChain
cagguccagcucguccaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucuccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccuccgccuccaccaagggccccuccgucuucccccacgaccuccgc

SEQ ID NO: 18879 - RNA, 417 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccuccgccuccaccaagggccccuccgucuuccccaccaucuacguc

SEQ ID NO: 18880 - RNA, 417 nt, Artificial Sequence
  derived and/or modified sequence opt2 from anti-HIV-1_HeavyChain
cagguccagcucgagcaguccggcuccggcgucaagaagcucggcgccuccguccgcgucuccugcuggaccuccgaggacaucuucgaggacgagcucauccacuggguccgccaggcccccggccagggccucgaguggaucggcugggucaaggccgucuccggcgccgucaacuacggcucccucgacuuccgccaccgcgucucccucacccgcgaccgcgaccucuucaccgcccacauggacauccgcggccucacccaggacgacaccgccaccuacuucugcgcccgccagaaguucgcccgcggcgaccagggcugguucuucgaccucuggggccgcggcacccucaucgucgucuccuccggccuccaccagggccccaucggccuccccccccgccucucccgc

SEQ ID NO: 18881 - RNA, 417 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaucgucuccggcgccgucaacuucggcucccccaacuuccgccagcgcgucucccucacccgcgaccgcgaccucuucaccgcccacauggacauccgcggccucacccagggcgacaccgccaccuacuucugcgcccgccagaaguucgagcgcggcggccagggcuggaucuucgaccucuggggccgcggcacccucaucgccgucuccuccgccuccccccgcgcccaccgcuccucccccaccaucugcguc

SEQ ID NO: 18882 - RNA, 417 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccuccgccuccaccaagggccccuccgucuucccccacgaccuccgc

SEQ ID NO: 18883 - RNA, 414 nt, Artificial Sequence
  derived and/or modified sequence opt2 from anti-HIV-1_HeavyChain
cagguccaccucguccaguccggcgccgaggucaagcgccccggcgccuccgucaaggucuccugcaaggccuccggcuacaccuucaccgacuacuucauccacuggguccgccaggcccccggccagggccucgaguggaucggcugggucaagaccgucuccggcgccgucaacuucggcucccucaacuuccgccaccgcgucucccucacccgcgaccgcgaccucuucaccgcccacauggacauccgcggccucacccagggcgacaccgccaccuacuucugcgcccgccagaaguucgcccgcggcgaccagggcugguucuucgaccucuggggccgcggcacccucaucgucgucuccuccgccuccaccaagggccccuccgucuucccccacgaccuccgc

SEQ ID NO: 18884 - RNA, 420 nt, Artificial Sequence
  derived and/or modified sequence opt2 from anti-HIV-1_HeavyChain
cagguccagcucguccaguccggcgccgaggucaagaagcccggcgccuccgucaaggucuccugcaaggccuccggcuacaucuucaccggcuccuacaugcacuggguccgccaggcccccggccagaccuucgaguggcucggcuggaugaagcccgucaccggcgccgucaacuacgcccgccaguuccagggccgcgucuccuucuaccgcacccgcgagcucggcaucgccuacauggaccuccgcgaccucaaguucgacgacaccgccgucuacuucugcgcccgcaagaccaagggcgacgucuccggcgacgaccgcggcuucuucuucgaccucuggggccgcggcacccgcgucaucgucuccuccgccuccaccaagggccccuccgucuucccccacgaccuccgc

SEQ ID NO: 18885 - RNA, 417 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccuccgccuccaccaagggccccuccgucuucccccacgaccuccgc

SEQ ID NO: 18886 - RNA, 417 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagggcuccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccuccgccuccaccaagggccccuccgucuucccccacgaccuccgc

SEQ ID NO: 18887 - RNA, 420 nt, Artificial Sequence
  derived and/or modified sequence opt2 from anti-HIV-1_HeavyChain
cagguccagcucguccaguccggcgccgaggucaagaagcccggcgccuccgucaaggucuccugcaaggccuccggcuacaccuucaccggcuacuacauccacuggguccgccaggcccccggccagggccucgaguggaugggcuggaucaaccccaacuccggcgccaccaacuacgcccagaaguuccagggccgccucaccaucgcccgcgacaccuccaucuccaccgccuacauggaccuccgcaaccuccgcuucgacgacaccgccgucuacuucugcgcccgcaagaccgccggcgacgucuccggcgacaaccgcggcuacuucuucgaccucuggggccgcggcucccgcgucaucgucuccuccgccuccaccaagggccccuccgucuucccccacgaccuccgc

SEQ ID NO: 18888 - RNA, 414 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccuccgccuccaccaagggccccuccgucuuccacgaccuccgc

SEQ ID NO: 18889 - RNA, 414 nt, Artificial Sequence
  derived and/or modified sequence opt2 from anti-HIV-1_HeavyChain
caggccacccucgagcaguccggcuccggcgucaagaagcccggcgccuccguccgcgucuccugcugguccuccgaggacaucuucaagaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuccaccgcccacauggacauccgcggccucacccaggacgacaccgccacccacuucugcgcccgccagaaguucgcccgcggcgaccagggcugguucuucgaccucuggggccgcggcacccucaucgucgucuccuccgccuccaccaagggccccuccgucuuccccaccaucuacguc

SEQ ID NO: 18890 - RNA, 417 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccuccgccuccaccaagggccccuccgucuuccccaccaucugcguc

SEQ ID NO: 18891 - RNA, 414 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucuccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcuggaucuucgaccucuggggccgcggcacccucaucgccgucuccuccgccuccccccgcgcccaccgcuccuccccccgcuccgcc

SEQ ID NO: 18892 - RNA, 414 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucgagcgcggcggccagggcuggaucuucgaccucuggggccgcggcacccucaucgccgucuccuccgccuccaccaagggccccuccgucuuccccaccaucugcguc

SEQ ID NO: 18893 - RNA, 414 nt, Artificial Sequence
  derived and/or modified sequence opt2 from anti-HIV-1_HeavyChain
caggcccaccucgagcaguccggccccggcgucaagaagcucggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuucaccgcccacauggacauccgcggccucacccaggacgacaccgccaucuacuucugcgcccgccagaaguucgcccgcggcgaccagggcugguucuucgaccucuggggccgcggcacccucaucgucgucuccuccgccuccaccaaggcccaccgcuccuccccccgcuccacc

SEQ ID NO: 18894 - RNA, 420 nt, Artificial Sequence
  derived and/or modified sequence opt2 from anti-HIV-1_HeavyChain
cagguccagcucguccaguccggcgccgagaugaagaagcccggcgccuccgucaagcucuccugcaugaccuccggcuacgucuucaccgacuucuacauccacuggguccgccaggcccccggccagggccucgaguggaugggcuggaucaaccccggcaccggcggcaccaucuccgccccccgcuuccucggccgcgucacccucacccgcgacaccuccaucuccgccgccuacaucgagaucaaccgcgucaccaucgacgacaccgccaccuacuucugcgcccgccagaaguucgccucccgcuacuccggcgaccagggcuccuacuucgaccucuggggccgcggcacccucaucgucgucuccuccgccuccaccaagggcccccucggccuccccccccgcuccgcc

SEQ ID NO: 18895 - RNA, 414 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggacccccgaggacaucuucgagcgcaccgagcucauccacuggguccgccaggcccccggccagggccucgaguggaucggcugggucaagaucgucuccggcgccgucaacuucggcucccccaacuuccgccagcgcgucucccucacccgcgaccgcgaccucuucaccgcccacauggacauccgcggccucacccagggcgacaccgccaccuacuucugcgcccgccagaaguucgagcgcggcggccagggcuggaucuucgaccucuggggccgcggcacccucaucgccgucuccuccgccuccccccgcgcccaccgcuccuccccccgcuccgcc

SEQ ID NO: 18896 - RNA, 414 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagcccgucaccggcgccgucaaccucgcccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccuccgccuccaccaagggccccuccgucuucccccacgaccuccgc

SEQ ID NO: 18897 - RNA, 417 nt, Artificial Sequence
  derived and/or modified sequence opt2 from anti-HIV-1_HeavyChain
caggcccaccucgagcaguccggcuccggcgucaagaagcccggcgccuccguccgcgucuccugcugguccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuccaccgcccacauggacauccgcggccucacccaggacgacaccgccaccuacuucugcgcccgccagaaguucgcccgcggcgaccagggcugguucuucgaccucuggggccgcggcacccucaucgucgucuccuccgccuccaccaagggccccuccgucuucccccacgaccuccgc

SEQ ID NO: 18898 - RNA, 414 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcuccgagcucauccacuggguccgccaggcccccggccagggccucgaguggaucggcugggucaagaccgucaccggcgccgucaacuucggcucccccaacuuccgccagcgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccuccgccuccaccaaggcccaccgcuccuccccccgcuccacc

SEQ ID NO: 18899 - RNA, 414 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccuccgccuccaccaagggccccuccgucuuccccaccaucugcguc

SEQ ID NO: 18900 - RNA, 414 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucaagaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuccaccgcccacauggacauccgcggccucacccaggacgacaccgccaccuacuucugcgcccgccagaaguucgcccgcggcgaccagggcugguucuucgaccucuggggccgcggcacccucaucgucgucuccuccgccuccaccaagggccccuccgucuucccccacgaccuccgc

SEQ ID NO: 18901 - RNA, 417 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccuccgccuccaccaagggccccuccgucuuccccaccaucuacguc

SEQ ID NO: 18902 - RNA, 417 nt, Artificial Sequence
  derived and/or modified sequence opt2 from anti-HIV-1_HeavyChain
caggcccaccucgagcaguccggcuccggcgucaagaagcccggcaccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgcccgcggcgaccagggcugguucuucgaccucuggggccgcggcacccucaucgucgucuccuccgccuccaccaagggccccuccgucuuccccaccaucugcguc

SEQ ID NO: 18903 - RNA, 417 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccuccgccuccaccaagggccccuccgucuucccccagaucuacguc

SEQ ID NO: 18904 - RNA, 417 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaaguccgagcucauccacuggguccgccagacccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccuccgccuccaccaagggccccuccgucuuccccaccaucuacguc

SEQ ID NO: 18905 - RNA, 417 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaucgucuccggcgccgucaacuucggcucccccaacuuccgccagcgcgucucccucacccgcgaccgcgaccucuucaccgcccacaugggcauccgcggccucacccagggcgacaccgccaccuacuucugcgcccgccagaaguucgagcgcggcggccagggcuggaucuucgaccucuggggccgcggcacccucaucgccgucuccuccgccuccaccaagggccccuccgucuuccccaccaucuacguc

SEQ ID NO: 18906 - RNA, 417 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuucaccgcccacauggacauccgcggccucacccaggacgacaccgccaccuacuucugcgcccgccagaaguucgcccgcggcgaccagggcugguucuucgaccucuggggccgcggcacccucaucgucgucuccuccgccuccaccaagggccccuccgucuucccccacgaccuccgc

SEQ ID NO: 18907 - RNA, 417 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcuggaucuucgaccucuggggccgcggcacccucaucgccgucuccuccgccuccaccaagggccccuccgucuucccccgcuccgccguc

SEQ ID NO: 18908 - RNA, 417 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcuggaugaagaucgucuccggcgccgucaacuucggcucccccaacuuccgccagcgcgucucccucacccgcgaccgcgaccucuucaccgcccacauggacauccgcggccucacccagggcgacaccgccaccuacuucugcgcccgccagaaguucgagcgcggcggccagggcuggaucuucgaccucuggggccgcggcacccucaucgccgucuccuccgccuccaccaagggccccuccgucuucccccacgaccuccgc

SEQ ID NO: 18909 - RNA, 417 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuccgagggcuccgagcucauccacuggguccgccaggcccccggccagggccucgaguggaucggcugggucaagaccgucaccggcgccgucaacuucggcuccgccuacuuccgccaccgcgucucccucacccgcgaccgcgaccucuucaccgcccacauggacauccgcggccucacccagggcgacaccgccaccuacuucugcgcccgccagaaguucuacaagggcggccagggcugguacuucgaccucuggggccgcggcacccucaucgucgucuccuccgccuccaccaagggccccuccgucuuccccaccaucugcguc

SEQ ID NO: 18910 - RNA, 417 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuacggcucccucgacuuccgccaccgcgucucccucacccgcgaccgcgaccucuccaccgcccacauggacauccgcggccucacccaggacgacaccgccaccuacuucugcgcccgccagaaguucgcccgcggcgaccagggcugguucuucgaccucuggggccgcggcacccucaucgucgucuccuccgccuccaccaagggccccuccgucuucccccacgaccuccgc

SEQ ID NO: 18911 - RNA, 417 nt, Artificial Sequence
  derived and/or modified sequence opt2 from anti-HIV-1_HeavyChain
caggcccaccucgagcaguccggcuccggcgucaagaagcccggcgccuccguccgcgucuccugcugguccuccgaggacaucuucgagcgcaccgagcucauccacuggguccgccaggcccccggccagggccucgaguggaucggcugggucaagaucgucuccggcgccgucaacuucggcucccccaacuuccgccagcgcgucucccucacccgcgaccgcgaccucuucaccgcccacauggacauccgcggccucacccagggcgacaccgccaccuacuucugcgcccgccagaaguucgagcgcggcggccagggcuggaucuucgaccucuggggccgcggcacccucaucgccgucuccuccgccuccaccaagggccccuccgucuuccccaccaucuacguc

SEQ ID NO: 18912 - RNA, 417 nt, Artificial Sequence
  derived and/or modified sequence opt2 from anti-HIV-1_HeavyChain
caggcccaccucgagcaguccggcuccggcgucaagcgccccggcgccuccguccgcgucuccugcuggaccuccgaggacaucuucgagaccaccgagcucauccacuggguccgccaggcccccggccagggccucgaguggaucggcugggucaagaccgucuccggcgccgucaacuucggcucccucaacuuccgccaccgcgucucccucacccgcgaccgcgaccucuucaccgcccacauggacauccgcggccucacccagggcgacaccgccaccuacuucugcgcccgccagaaguucgcccgcggcgaccagggcugguucuucgaccucuggggccgcggcacccucaucgucgucuccuccgccuccaccaagggccccuccgucuuccccaccaucugcguc

SEQ ID NO: 18913 - RNA, 417 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaaccucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccuccgccuccaccaagggccccuccgucuucccccacgaccuccgc

SEQ ID NO: 18914 - RNA, 417 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuccaccgcccacauggacauccgcggccucacccaggacgacaccgccaccuacuucugcgcccgccagaaguucgagcgcggcggccagggcuggaucuucgaccucuggggccgcggcacccucaucgccgucuccuccgccuccaccaagggccccuccgucuuccccaccaucugcguc

SEQ ID NO: 18915 - RNA, 417 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccuccgccuccaccaagggccccuccgucuucccccacgaccucguc

SEQ ID NO: 18916 - RNA, 417 nt, Artificial Sequence
  derived and/or modified sequence opt2 from anti-HIV-1_HeavyChain
caggcccaccucgagcaguccggcuccggcgucaagaagcccggcgccuccguccgcgucuccugcugguccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuucaccgcccacauggacauccgcggccucacccaggacgacaccgccaccuacuucugcgcccgccagaaguucgcccgcggcgaccagggcugguucuucgaccucuggggccgcggcacccucaucgucgucuccuccgccuccaccaagggccccuccgucuuccccaccaucuacguc

SEQ ID NO: 18917 - RNA, 420 nt, Artificial Sequence
  derived and/or modified sequence opt2 from anti-HIV-1_HeavyChain
cagguccaccucgagcaguccggcuccggcgucaagaagcccggcgcccccguccgcgucuccugcugguccuccgaggacaucuucgagcgcaccgagcucauccacuggguccgccaggcccccggccagggccucgaguggaucggcugggucaagaccgucaccggcgccgucaacuucggcucccucgacuuccgccaccgcaucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccuccgccuccaccaaggcccacuccguccuccccccccgcucccgcguc

SEQ ID NO: 18918 - RNA, 417 nt, Artificial Sequence
  derived and/or modified sequence opt2 from anti-HIV-1_HeavyChain
caggcccaccucgagcaguccggcuccggcgucaagaagcccggcgcccucguccgcgucuccugcuggaccuccgaggacaucuucgagaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccuccgccuccaccaagggccccuccgucuucccccacgaccuccgc

SEQ ID NO: 18919 - RNA, 414 nt, Artificial Sequence
  derived and/or modified sequence opt2 from anti-HIV-1_HeavyChain
cagguccagcucguccaguccggcgccgaggucaagaagcccggcgccuccgucaaggucuccugccaggucuccggcuacacccucaccgagcucuccaugcacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccuccgccuccaccaagggccccuccgucuucccccacgaccuccgc

SEQ ID NO: 18920 - RNA, 414 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucaagaccgagcucauccacuggguccgccaggcccccggccagggccucgaguggaucggcugggucaagaucgucuccggcgccgucaacuucggcucccccaacuuccgccagcgcgucucccucacccgcgaccgcgaccucuucaccgcccacauggacauccgcggccucacccagggcgacaccgccaccuacuucugcgcccgccagaaguucgagcgcggcggccagggcuggaucuucgaccucuggggccgcggcacccucaucgccgucuccuccgccuccaccaagggccccuccgucuucccccacgaccuccgc

SEQ ID NO: 18921 - RNA, 417 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuucaccgcccacauggacauccgcggccucacccaggacgacaccgccaccuacuucugcgcccgccagaaguucgcccgcggcgaccagggcugguucuucgaccucuggggccgcggcacccucaucgucgucuccuccgccuccaccaagggccccuccgucuuccccaccaucugcguc

SEQ ID NO: 18922 - RNA, 417 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaaguccgagcucauccacuggguccgccaggcccccggccagggccucgagugggucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccuccgccuccaccaagggccccuccgucuucccccacgaccuccgc

SEQ ID NO: 18923 - RNA, 417 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccuccgccuccaccaagggccccuccgucuuccccaccaucugcguc

SEQ ID NO: 18924 - RNA, 417 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuccaccgcccacauggacauccgcggccucacccaggacgacaccgccaccuacuucugcgcccgccagaaguucgcccgcggcgaccagggcugguucuucgaccucuggggccgcggcacccucaucgucgucuccuccgccuccaccaagggccccuccgucuucccccagaucugcguc

SEQ ID NO: 18925 - RNA, 414 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggccaccagaucuccgaccgcgucucccucacccccgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccuccgccuccaccaagggccccuccgucuuccccaccaucugcguc

SEQ ID NO: 18926 - RNA, 417 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaaguccgagcucauccacuggguccgccgcgcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccuccgccuccaccaaggcccaccgcuccucccccaccaucugcguc

SEQ ID NO: 18927 - RNA, 417 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuucaccgcccacauggacauccgcggccucacccaggacgacaccgccaccuacuucugcgcccgccagaaguucgcccgcggcgaccagggcugguucuucgaccucuggggccgcggcacccucaucgucgucuccuccgcccccaccaagggccccuccgucuuccccaccaucugcguc

SEQ ID NO: 18928 - RNA, 417 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccuccgccuccaccaagggccccuccgucuucccccagaucuacguc

SEQ ID NO: 18929 - RNA, 417 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcuccuccgacuuccgccagcgcgucucccucacccgcggccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccuccgccuccaccaagggccccuccgucuuccccaccaucugcguc

SEQ ID NO: 18930 - RNA, 417 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgccaccgcgucucccucacccgcgaccgcgaccucuccaccgcccacauggacauccgcggccucacccaggacgacaccgccaccuacuucugcgcccgccagaaguucgcccgcggcgaccagggcugguucuucgaccucuggggccgcggcacccucaucgucgucuccuccgccuccaccaagggccccuccgucuucccccacgaccacguc

SEQ ID NO: 18931 - RNA, 417 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccuccgccuccaccaagggccccuccgucuucccccagaucugcguc

SEQ ID NO: 18932 - RNA, 417 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaucgucuccggcgccgucaacuucggcucccccaacuuccgccagcgcgucucccucacccgcgaccgcgaccucuucaccgcccacauggacauccgcggccucacccagggcgacaccgccaccuacuucugcgcccgccagaaguucgagcgcggcggccagggcuggaucuucgaccucuggggccgcggcacccucaucgucgucuccuccgccuccaccaagggccccuccgucuuccccaccaucugcguc

SEQ ID NO: 18933 - RNA, 417 nt, Artificial Sequence
  derived and/or modified sequence opt2 from anti-HIV-1_HeavyChain
caggcccaccucgagcaguccggcuccggcgucaagaagcccggcgccuccguccgcgucuccugcugggccuccgaggacaucuucgagcgcaccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccuccgccuccaccaagggccccuccgucuucccccacgaccuccuc

SEQ ID NO: 18934 - RNA, 417 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucgagcgcggcggccagggcuggaucuucgaccucuggggccgcggcacccucaucgccgucuccuccgccuccaccaagggccccuccgucuucccccacgaccuccgc

SEQ ID NO: 18935 - RNA, 417 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuccaccgcccacauggacauccgcggccucacccaggacgacaccgccaccuacuucugcgcccgccagaaguucgcccgcggcgaccagggcugguucuucgaccucuggggccgcggcacccucaucgucgucuccuccgccuccaccaagggccccuccgucuucccccacgaccuccgc

SEQ ID NO: 18936 - RNA, 417 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcuccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguacuacgccggcggccagggcugguacuucgaccucuggggccgcggcacccucaucgucgucuccuccgccuccaccaagggccccuccgucuuccccaccaucugccgc

SEQ ID NO: 18937 - RNA, 417 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccuccgccuccaccaagggccccuccgucuucccccacgaccuccgc

SEQ ID NO: 18938 - RNA, 417 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuucaccgcccacauggacauccgcggccucacccaggacgacaccgccaccuacuucugcgcccgccagaaguucgcccgcggcgaccagggcugguucuucgaccucuggggccgcggcacccucaucgucgucuccuccgccuccaccaagggccccuccgucuuccccaccaucuacguc

SEQ ID NO: 18939 - RNA, 417 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucuacaagggcggccagggcugguacuucgaccucuggggccgcggcacccucaucgucgucuccuccgccuccaccaagggccccuccgucuucccccacgaccuccgc

SEQ ID NO: 18940 - RNA, 417 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcaccgucaacuucggcucccucaacuuccgccagcgcgucucccucacccgcgaccgcgaccucuucaccgcccacauggacauccgcggccucacccaggacgacaccgccaccuacuucugcgcccgccagaaguucgcccgcggcgaccagggcugguucuucgaccucuggggccgcggcacccucaucgucgucuccuccgccuccaccaagggccccuccgucuucccccacgaccuccgc

SEQ ID NO: 18941 - RNA, 417 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggcccuccgaggacaucuucgagaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucgagcgcggcggccagggcuggaucuucgaccucuggggccgcggcacccucaucgccgucuccuccgccuccaccaagggccccuccgucuucccccacgaccuccgc

SEQ ID NO: 18942 - RNA, 417 nt, Artificial Sequence
  derived and/or modified sequence opt2 from anti-HIV-1_HeavyChain
caggcccaccucgagcaguccggcuccggcgucaagcgccccggcgccuccguccgcgucuccugcuggaccuccgaggacaucuucgagaccaccgagcucauccacuggguccgccaggcccccggccagggccucgaguggaucggcugggucaagaccgucuccggcgccgucaacuucggcucccucaacuuccgccaccgcgucucccucacccgcgaccgcgaccucuucaccgcccacauggacauccgcggccucacccagggcgacaccgccaccuacuucugcgcccgccagaaguucgcccgcggcgaccagggcugguucuucgaccucuggggccgcggcacccucaucgucgucuccuccgccuccaccaagggccccuccgucuucccccacgaccuccgc

SEQ ID NO: 18943 - RNA, 417 nt, Artificial Sequence
  derived and/or modified sequence opt2 from anti-HIV-1_HeavyChain
caggcccaccucgagcaguccggcuccggcgucgagaagcccggcgccuccguccgcgucuccugcuggaccuccgaggacaucuucgagcgcuccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguacuacgccggcggccagggcugguacuucgaccucuggggccgcggcacccucaucgucgucuccuccgccuccaccaagggccccuccgucuucccccacgaccuccgc

SEQ ID NO: 18944 - RNA, 417 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaucgucuccggcgccgucaacuucggcucccccaacuuccgccagcgcgucucccucacccgcgaccgcgaccucuucaccgcccacauggacauccgcggccucacccagggcgacaccgccaccuacuucugcgcccgccagaaguucgagcgcggcggccagggcuggaucuucgaccucuggggccgcggcacccucaucgccgucuccuccgccuccaccaagggccccuccgucuucccccacgaccuccgc

SEQ ID NO: 18945 - RNA, 417 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgccaccgcgucucccucacccgcgaccgcaaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccuccgccuccaccaagggccccuccgucuucccccacgaccuccgc

SEQ ID NO: 18946 - RNA, 417 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaucgucuccggcgccgucaacuucggcucccccaacuuccgccagcgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccuccgccuccaccaagggccccuccgucuucccccacgaccuccgc

SEQ ID NO: 18947 - RNA, 417 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuacggcucccucaacuuccgcucccgcaucucccucacccgcgaccgcgaccucuucaccgcccacauggacauccgcggccucacccagggcgacaccgccaccuacuucugcgcccgccagaaguucgagcgcggcggccagggcuggaucuucgaccucuggggccgcggcacccucaucgccgucuccuccgccuccaccaagggccccuccgucuucccccacgaccuccgc

SEQ ID NO: 18948 - RNA, 417 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgccucccucgacuuccgcaaccgcaucucccucucccgcgaccgcgaccucuccaccgcccacauggacauccgcggccucacccagggcgacaccgccaccuacuucugcgcccgccagaaguucuacgccggcggccagggcugguacuucgaccucuggggccgcggcacccucaucgucgucuccuccgccuccaccaagggccccuccgucuucccccacgaccuccgc

SEQ ID NO: 18949 - RNA, 417 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaucgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccuccgccuccaccaagggccccuccgucuucccccacgaccuccgc

SEQ ID NO: 18950 - RNA, 417 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccagcgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccuccgccuccaccaagggccccuccgucuucccccacgaccuccgc

SEQ ID NO: 18951 - RNA, 417 nt, Artificial Sequence
  derived and/or modified sequence opt2 from anti-HIV-1_HeavyChain
caggcccaccucgagcaguccggcuccggcgucaagaagcccggcgccuccguccgcgucuccugcugguccuccgaggacaucuucgagcgcgccgagcucauccacuggguccgccaggcccccggccagggccucgaguggaucggcugggucaagaccgucaccggcgccgucaacuucggcucccccaacuuccgccagcgcgucucccucacccgcgaccgcgaccucuucaccgcccacauggacauccgcggccucacccagggcgacaccgccaccuacuucugcgcccgccagaaguucgagcgcggcggccagggcuggaucuucgaccucuggggccgcggcacccucaucgccgucuccuccgccuccaccaagggccccuccgucuucccccacgaccuccgc

SEQ ID NO: 18952 - RNA, 417 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuucaccgcccacauggacauccgcggccucacccaggacgacaccgccaccuacuucugcgcccgccagaaguucgcccgcggcgaccagggcugguucuucgaccucuggggccgcggcacccucaucgucgucuccuccgccuccaccaagggccccuccgucuucccccacgaccuccgc

SEQ ID NO: 18953 - RNA, 417 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgccucccucgacuuccgcaaccgcaucucccucucccgcgaccgcgaccucuccaccgcccacauggacauccgcggccucacccaggacgacaccgccaccuacuucugcgcccgccagaaguucgagcgcggcggccagggcugguacuucgaccucuggggccgcggcacccucaucgucgucuccuccgccuccaccaagggccccuccgucuucccccacgaccuccgc

SEQ ID NO: 18954 - RNA, 417 nt, Artificial Sequence
  derived and/or modified sequence opt2 from anti-HIV-1_HeavyChain
caggcccaccucgagcaguccggcuccggcgucaagaagcccggcgccuccguccgcgucuccugcugguccuccgaggacaucuucgagcgcaccgagcucauccacuggguccgccaggcccccggccagggccucgaguggaucggcugggucaagaccgucaccggcgccgucaacuucggcucccucgacuuccgccaccgcaucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccuccgccuccaccaagggccccuccgucuucccccacgaccuccgc

SEQ ID NO: 18955 - RNA, 417 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccaggacgacaccgccaucuacuucugcgcccgccagaaguucgcccgcggcgaccagggcugguucuucgaccucuggggccgcggcacccucaucgucgucuccuccgccuccaccaagggccccuccgucuucccccacgaccuccgc

SEQ ID NO: 18956 - RNA, 417 nt, Artificial Sequence
  derived and/or modified sequence opt2 from anti-HIV-1_HeavyChain
caggcccaccucgagcaguccggcuccggcgucaagggccccggcgccuccguccgcgucuccugcuggaccuccgaggacaucuucgagaccaccgagcucauccacuggguccgccaggcccccggccagggccucgaguggaucggcugggucaagaccgucuccggcgccgucaacuucggcucccucaacuuccgccaccgcgucucccucacccgcgaccgcgaccucuucaccgcccacauggacauccgcggccucacccagggcgacaccgccaccuacuucugcgcccgccagaaguucgcccgcggcgaccagggcugguucuucgaccucuggggccgcggcacccucaucgucgucuccuccgccuccaccaagggccccuccgucuucccccacgaccuccgc

SEQ ID NO: 18957 - RNA, 417 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagggcuccgagcucauccacuggguccgccaggcccccggccagggccucgaguggaucggcugggucaagaccgucaccggcgccgucaacuucggcuccgccuacuuccgccaccgcgucccccucacccgcgaccgcgaccucuucaccgcccacauggacauccgcggccucacccagggcgacaccgccaccuacuucugcgcccgccagaaguucuacaagggcggccagggcugguacuucgaccucuggggccgcggcacccucaucgucgucuccuccgccuccaccaagggccccuccgucuucccccacgaccuccgc

SEQ ID NO: 18958 - RNA, 417 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccuccgccuccaccaagggccccuccgucuucccccacgaccuccgc

SEQ ID NO: 18959 - RNA, 417 nt, Artificial Sequence
  derived and/or modified sequence opt2 from anti-HIV-1_HeavyChain
caggcccaccucgagcaguccggcuccggcgucaagaaggucggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccuccgccuccaccaagggccccuccgucuucccccacgaccuccgc

SEQ ID NO: 18960 - RNA, 417 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccaggacgacaccgccaccuacuucugcgcccgccagaaguucgcccgcggcgaccagggcugguucuucgaccucuggggccgcggcacccucaucgucgucuccuccgccuccaccaagggccccuccgucuucccccacgaccuccgc

SEQ ID NO: 18961 - RNA, 417 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgagcgcaccgagcucaucuacuggguccgccaggcccccggccgcggccucgaguggaucggcugggucaagaccgucuccggcaccgucaacuucggcuccuccgacuuccgcaaccgcaucucccucacccgcgaccgcgaccucuccaccgcccacauggacauccgcggccucacccaggacgacaccgccaccuacuucugcgcccgccagaaguucgcccgcggcgaccagggcugguucuucgaccucuggggccgcggcacccucaucgucgucuccuccgccuccaccaagggccccuccgucuucccccacgaccuccgc

SEQ ID NO: 18962 - RNA, 417 nt, Artificial Sequence
  derived and/or modified sequence opt2 from anti-HIV-1_HeavyChain
caggcccaccucgagcaguccgaguccggcgucaagaagcucggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuucaccgcccacauggacauccgcggccucacccaggacgacaccgccaccuacuucugcgcccgccagaaguucgcccgcggcgaccagggcugguucuucgaccucuggggccgcggcacccucaucgucgucuccuccgccuccaccaagggccccuccgucuucccccacgaccuccgc

SEQ ID NO: 18963 - RNA, 417 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccuccgccuccaccaagggccccuccgucuuccccaccacccuccgc

SEQ ID NO: 18964 - RNA, 417 nt, Artificial Sequence
  derived and/or modified sequence opt2 from anti-HIV-1_HeavyChain
caggcccaccucgagcaguccggcuccggcgucaagaaggucggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccuccgccuccaccaagggccccuccgucuucccccacgaccuccgc

SEQ ID NO: 18965 - RNA, 420 nt, Artificial Sequence
  derived and/or modified sequence opt2 from anti-HIV-1_HeavyChain
caggcccgccccggcgccaaccgcggcuccggcgucaagaagcccggcgccuccguccgcgucuccugcuggaccuccgaggacaucuucgagcgcaccgagcucauccacuggguccgccaggcccccggccagggccucgaguggaucggcugggucaagaucgucuccggcgccgucaacuucggcucccccaacuuccgccagcgcgucucccucacccgcgaccgcgaccucuucaccgcccacauggacauccgcggccucacccagggcgacaccgccaccuacuucugcgcccgccagaaguucgagcgcggcggccagggcuggaucuucgaccucuggggccgcggcacccucaucgccgucuccuccgccuccaccaagggccccuccgucuucccccacgaccuccgc

SEQ ID NO: 18966 - RNA, 417 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcuccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguacuacgccggcggccagggcugguacuucgaccucuggggccgcggcacccucaucgucgucuccuccgccuccaccaagggccccuccgucuucccccacgaccuccgc

SEQ ID NO: 18967 - RNA, 417 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagggcuccgagcucauccacuggguccgccaggcccccggccagggccucgaguggaucggcugggucaagaccgucaccggcgccgucaacuucggcuccgccuacuuccgccaccgcgucucccucacccgcgaccgcgaccucuucaccgcccacauggacauccgcggccucacccagggcgacaccgccaccuacuucugcgcccgccagaaguucuacaagggcggccagggcugguacuucgaccucuggggccgcggcacccucaucgucgucuccuccgccuccaccaagggccccuccgucuucccccacgaccuccgc

SEQ ID NO: 18968 - RNA, 417 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuccaccgcccacauggacauccgcggccucacccaggacgacaccgccaccuacuucugcgcccgccagaaguucgcccgcggcgaccagggcugguucuucgaccucuggggccgcggcacccucaucgucgucuccuccgccuccaccaagggccccuccguccuccccccccgcuccgcc

SEQ ID NO: 18969 - RNA, 417 nt, Artificial Sequence
  derived and/or modified sequence opt2 from anti-HIV-1_HeavyChain
caggcccaccucgagcaguccggcuccggcaugaagaagcccggcgccuccguccgcgucuccugcugguccuccgaggacaucuucgagcgcaccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccuccgccuccaccaagggccccuccgucuucccccacgaccuccgc

SEQ ID NO: 18970 - RNA, 417 nt, Artificial Sequence
  derived and/or modified sequence opt2 from anti-HIV-1_HeavyChain
caggcccaccucgagcaguccggcuccggcgucaaggagcccggcaccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcuggaucuucgaccucuggggccgcggcacccucaucgccgucuccuccgccuccaccaagggccccuccgucuucccccagacccuccgc

SEQ ID NO: 18971 - RNA, 417 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgccucccucgacuuccgccaccgcgucucccucacccgcgaccgcgaccucuccaccgcccacauggacauccgcggccucacccaggacgacaccgccaccuacuucugcgcccgccagaaguucgcccgcggcgaccagggcugguucuucgaccucuggggccgcggcacccucaucgucgucuccuccgccuccaccaagggccccuccgucuucccccacgaccuccgc

SEQ ID NO: 18972 - RNA, 417 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaccaccgagcucauccacuggguccgccaggcccccggccagggccucgaguggaucggcugggucaagaccgucuccggcgccgucaacuucggcucccucaacuuccgccaccgcgucucccucacccgcgaccgcgaccucuucaccgcccacauggacauccgcggccucacccagggcgacaccgccaccuacuucugcgcccgccagaaguucgcccgcggcgaccagggcugguucuucgaccucuggggccgcggcacccucaucgucgucuccuccgccuccaccaagggccccuccgucuucccccacgaccuccgc

SEQ ID NO: 18973 - RNA, 417 nt, Artificial Sequence
  derived and/or modified sequence opt2 from anti-HIV-1_HeavyChain
caggcccaccucgagcaguccggcuccggcgucaagaaggucggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccuccgccuccaccaagggccccuccgucuucccccacgaccuccgc

SEQ ID NO: 18974 - RNA, 417 nt, Artificial Sequence
  derived and/or modified sequence opt2 from anti-HIV-1_HeavyChain
caggcccaccucgagcaguccggcgccggcgucaagaagcccggcgccuccguccgcgucuccugcuggaccuccgaggacaucuucgagcgcaccgagcucauccacuggguccgccaggcccccggccagggccucgaguggaucggcugggucaagaccgucuccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccuccgccuccaccaagggccccuccgucuucccccacgaccuccgc

SEQ ID NO: 18975 - RNA, 417 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuacggcucccucaacuuccgcucccgcaucucccucacccgcgaccgcgaccucuucaccgcccacauggacauccgcggccucaccgagggcgacaccgccaccuacuucugcgcccgccagaaguucuacgccggcggccagggcugguacuucgaccucuggggccgcggcacccucaucgucgucuccuccgccuccaccaagggccccuccgucuucccccacgaccuccgc

SEQ ID NO: 18976 - RNA, 417 nt, Artificial Sequence
  derived and/or modified sequence opt2 from anti-HIV-1_HeavyChain
caggcccaccucgagcaguccggcuccggcgucaagaagcccggcgccuccguccgcgucuccugccucgccuccgaggacaucuucgagcgcaccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccuccgccuccaccaagggccccuccgucuucccccacgaccuccgc

SEQ ID NO: 18977 - RNA, 417 nt, Artificial Sequence
  derived and/or modified sequence opt2 from anti-HIV-1_HeavyChain
caggcccaccucgagcaguccggcuccggcgucaagaagcccggcgccuccguccgcgucuccugcugguccuccgaggacaucuucgagcgcaccgagcucauccacuggguccgccaggcccccggccagggccucgaguggaucggcugggucaagaccgucaccggcgccgucaacuucggcucccucgacuuccgccaccgcaucucccucacccgcgaccgcgaccucuucaccgcccacauggacauccgcggccucacccagggcgacaccgccaccuacuucugcgcccgccagaaguucgagcgcggcggccagggcuggaucuucgaccucuggggccgcggcacccucaucgccgucuccuccgccuccaccaagggccccuccgucuucccccacgaccuccgc

SEQ ID NO: 18978 - RNA, 417 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgccagcgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccuccgccuccaccaagggccccuccgucuucccccacgaccuccgc

SEQ ID NO: 18979 - RNA, 417 nt, Artificial Sequence
  derived and/or modified sequence opt2 from anti-HIV-1_HeavyChain
cagguccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccuccgccuccaccaagggccccuccgucuucccccacgaccuccgc

SEQ ID NO: 18980 - RNA, 417 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucuccggcgccgucaacuucggcucccccaacuuccgccagcgcgucucccucacccgcgaccgcgaccucuucaccgcccacauggacauccgcggccucacccagggcgacaccgccaccuaccucugcgcccgccagaaguucgagcgcggcggccagggcuggaucuucgaccucuggggccgcggcacccucaucgccgucuccuccgccuccaccaagggccccuccgucuucccccacgaccuccgc

SEQ ID NO: 18981 - RNA, 417 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgagcgcaccgagcucaucuacuggguccgccaggcccccggccgcggccucgaguggaucggcugggucaagaccgucuccggcaccgucaacuucggcuccuccgacuuccgccaccgcgucucccucacccgcgaccgcgaccucuucaccgcccacauggacauccgcggccucacccagggcgacaccgccaccuacuucugcgcccgccagaaguucuacaagggcggccagggcugguacuucgaccucuggggccgcggcacccucaucgucgucuccuccgccuccaccaagggccccuccgucuucccccacgaccuccgc

SEQ ID NO: 18982 - RNA, 417 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcuccuccgacuuccgccagcgcgucucccucacccccgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccuccgccuccaccaagggcuccuccgucuucccccacgaccuccgc

SEQ ID NO: 18983 - RNA, 417 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcuccuccgacuuccgccagcgcgucucccucacccccgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccuccgccuccaccaagggccccuccgucuucccccacgaccuccgc

SEQ ID NO: 18984 - RNA, 417 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuccaccgcccacauggacauccgcggccucacccaggacgacaccgccaccuacuucugcgcccgccagaaguucgcccgcggcgaccagggcugguucuucgaccucuggggccgcggcacccucaucgucgucuccuccgccuccaccaagggccccuccgucuucccccacgaccuccgc

SEQ ID NO: 18985 - RNA, 417 nt, Artificial Sequence
  derived and/or modified sequence opt2 from anti-HIV-1_HeavyChain
cagguccaccucgagcaguccggcuccggcgucaagaagcucggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuucaccgcccacauggacauccgcggccucacccaggacgacaccgccaccuacuucugcgcccgccagaaguucgcccgcggcgaccagggcugguucuucgaccucuggggccgcggcacccucaucgucgucuccuccgccuccaccaagggccccuccgucuucccccaccgcuccacc

SEQ ID NO: 18986 - RNA, 420 nt, Artificial Sequence
  derived and/or modified sequence opt2 from anti-HIV-1_HeavyChain
caggucuacauggagcaggccggcgccggcgucaagaagcccggcgccuccgucacccucuccugcaagaccgccgacgaggacgucuucgacgccgccuacaugcacuggguccgccaggcccccggccagaccuucgaguggcucggcuggaugaagcccgucaccggcgccgucuccuacgcccgcaaguuccagggccgcgucuccuucuacaugacccgcgagcucggcauggccuacauggaccuccgcaaccuccgcuucgacgacaccgccgucuacuucugcgcccgcaagaccgccggcgacgucuccggcgacaaccgcggcuacuucuucgaccucuggggccgcggcucccgcgucaucgucuccuccgccuccaccaagggccccuccgucuucaccaucuacguc

SEQ ID NO: 18987 - RNA, 417 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuucaccgcccacauggacauccgcggccucacccaggacgacaccgccaccuacuucugcgcccgccagaaguucgcccgcggcgaccagggcugguucuucgaccucuggggccgcggcacccucaucgucgucuccuccgccuccaccaagggccccuccgucuucccccacgaccccgcc

SEQ ID NO: 18988 - RNA, 417 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuccaccgcccacauggacauccgcggccucacccaggacgacaccgccaccuacuucugcgcccgccagaaguucgcccgcggcgaccagggcugguucuucgaccucuggggccgcggcacccucaucgucgucuccuccgccuccaccaagggccccuccguccuccccccccgcuccacc

SEQ ID NO: 18989 - RNA, 417 nt, Artificial Sequence
  derived and/or modified sequence opt2 from anti-HIV-1_HeavyChain
caggcccaccucgagcaguccggcuccggcgucaagaagcccggcgccuccguccgcgucuccugcugguccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuucaccgcccacauggacauccgcggccucacccaggacgacaccgccaccuacuucugcgcccgccagaaguucgcccgcggcgaccagggcugguucuucgaccucuggggccgcggcacccucaucgucgucuccuccgccuccaccaagggccccuccgucuucccccacgaccuccgc

SEQ ID NO: 18990 - RNA, 417 nt, Artificial Sequence
  derived and/or modified sequence opt2 from anti-HIV-1_HeavyChain
caggcccaccucgagcaguccggcuccgaguggaagaagcucggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuccaccgcccacauggacauccgcggccucacccaggacgacaccgccaccuacuucugcgcccgccagaaguucgcccgcggcgaccagggcugguucuucgaccucuggggccgcggcacccucaucgucgucuccuccgccuccaccaagggccccuccgucuucccccacgaccuccgc

SEQ ID NO: 18991 - RNA, 417 nt, Artificial Sequence
  derived and/or modified sequence opt2 from anti-HIV-1_HeavyChain
caggcccaccucgagcaguccggcuccgaggucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccuccgccuccaccaagggccccuccgucuucccccacgaccuccgc

SEQ ID NO: 18992 - RNA, 417 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccuccgccuccaccaagggccccuccgucuucccccacgaccuccgc

SEQ ID NO: 18993 - RNA, 417 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacauccuccgcaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccuccgccuccaccaagggccccuccgucuucccccacgaccuccgc

SEQ ID NO: 18994 - RNA, 417 nt, Artificial Sequence
  derived and/or modified sequence opt2 from anti-HIV-1_HeavyChain
caggcccaccucgagcaguccgccuccggcgucaagcgccccggcgccuccguccgcgucuccugccucgccuccgaggacaucuucgagcgcuccgagcucaucuacuggguccgccaggcccccggccagggccucgaguggaucggcugggucaagaucgucuccggcgccgucaacuucggcucccccaacuuccgccagcgcgucucccucacccgcgaccgcgaccucuucaccgcccacauggacauccgcggccucacccagggcgacaccgccaccuacuucugcgcccgccagaaguucgagcgcggcggccagggcuggaucuucgaccucuggggccgcggcacccucaucgccgucuccuccgccuccaccaagggccccuccgucuucccccacgaccuccgc

SEQ ID NO: 18995 - RNA, 417 nt, Artificial Sequence
  derived and/or modified sequence opt2 from anti-HIV-1_HeavyChain
caggcccaccucgagcaguccggcuccggcgucaagcgccccggcgccuccguccgcgucuccugcuggaccuccgaggacaucuucgagaccaccgagcucauccacuggguccgccaggcccccggccagggccucgaguggaucggcugggucaagaccgucaccggcgccgucaacuucggcuccgccuacuuccgccaccgcgucucccucacccgcgaccgcgaccucuucaccgcccacauggacauccgcggccucacccagggcgacaccgccaccuacuucugcgcccgccagaaguucuacaagggcggccagggcugguacuucgaccucuggggccgcggcacccucaucgucgucuccuccgccuccaccaagggccccuccgucuucccccacgaccuccgc

SEQ ID NO: 18996 - RNA, 417 nt, Artificial Sequence
  derived and/or modified sequence opt2 from anti-HIV-1_HeavyChain
caggcccaccucgagcaguccgccuccggcgucaagcgccccggcgccuccguccgcgucuccugcuggaccuccgaggacaucuucgagcgcuccgagcucaucuacuggguccgccaggcccccggccagggccucgaguggaucggcugggucaagaccgucuccggcgccgucaacuucggcuccaccgacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccuccgccuccaccaagggccccuccgucuucccccacgaccuccgc

SEQ ID NO: 18997 - RNA, 417 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuccaccgcccacauggacauccgcggccucacccaggacgacaccgccaccuacuucugcgcccgccagaaguucgcccgcggcgaccagggcugguucuucgaccucuggggccgcggcacccucaucgucgucuccuccgccuccaccaagggccccuccggccuccccccccgcuccgcc

SEQ ID NO: 18998 - RNA, 417 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgccucccucgacuuccgcaaccgcaucucccucucccgcgaccgcgaccucuccaccgcccacauggacauccgcggccucacccagggcgacaccgccaccuacuucugcgcccgccagaaguucgagcgcggcggccagggcuggaucuucgaccucuggggccgcggcacccucaucgccgucuccuccgccuccaccaagggccccuccgucuucccccuccgcuccgcc

SEQ ID NO: 18999 - RNA, 423 nt, Artificial Sequence
  derived and/or modified sequence opt2 from anti-HIV-1_HeavyChain
cagguccagauggagcaggccggcgccggcaugaagaagcccggcgccuccaugaccgucuccugcaagaccgccgacgaggacaucuucgacgccgccuacaugcacuggguccgccaggcccccggccagaccuucgaguggcucggcuggaugaagcccgucaccggcgccgucaacuacgcccgccaguuccagggccgcgccuccuucuaccgcacccgcgagcucggcaucgccuacauggaccuccgcgaccucaaguucgacgacaccgccgucuacuucugcgcccgcaagaccaagggcgacgucuccggcgacgaccgcggcuucuucuucgaccucuggggccgcggcacccgcgucaucgucuccuccgccuccaccaagggccccuccgucuucccccacgaccuccgc

SEQ ID NO: 19000 - RNA, 417 nt, Artificial Sequence
  derived and/or modified sequence opt2 from anti-HIV-1_HeavyChain
caggcccaccucgagcaguccggcuccggcgucaagaagcccggcgccuccguccgcgucuccugcugguccuccgaggacaucuucgagcgcaccgagcucauccacuggguccgccaggcccccggccagggccucgaguggaucggcugggucaagaccgucaccggcgccgucaacuucggcucccucgacuuccgccaccgcaucucccucacccgcgaccgcgaccucuucaccgcccacauggacauccgcggccucacccagggcgacaccgccaccuacuucugcgcccgccagaaguucuacaagggcggccagggcugguacuucgaccucuggggccgcggcacccucaucgucgucuccuccgccuccaccaagggccccuccgucuucccccagaucugccgc

SEQ ID NO: 19001 - RNA, 414 nt, Artificial Sequence
  derived and/or modified sequence opt2 from anti-HIV-1_HeavyChain
caggcccaccucgagcaguccggcgccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaaccucguccaccagaucuccgaccgcgucucccucacccgcgaccgcgaccucuccaccgcccacauggacauccgcggccucacccaggacgacaccgccaccuacuucugcgcccgccagaaguucgcccgcggcgaccagggcugguucuucgaccucuggggccgcggcacccucaucgucgucuccuccgccuccaccaagggccccuccgucuucccccacgaccuccgc

SEQ ID NO: 19002 - RNA, 420 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuccaccgcccacauggacauccgcggccucacccaggacgacaccgccaccuacuucugcgcccgccagaaguucgcccgcggcgaccagggcugguucuucgaccucuggggccgcggcacccucaucgucgucuccuccgccuccaccaagggccccuccggccuccccccccgccucugcguc

SEQ ID NO: 19003 - RNA, 417 nt, Artificial Sequence
  derived and/or modified sequence opt2 from anti-HIV-1_HeavyChain
caggcccgccucgagcaguccggcuccggcgucaagaagcccggcgccuccguccgcgucuccugcuggaccuccgaggacaucuucgagggcuccgagcucauccacuggguccgccaggcccccggccagggccucgaguggaucggcugggucaagaccgucaccggcgccgucaacuucggcuccgccuacuuccgccaccgcgucucccucacccgcgaccgcgaccucuucaccgcccacauggacauccgcggccucacccagggcgacaccgccaccuacuucugcgcccgccagaaguucgcccgcggcgaccagggcugguucuucgaccucuggggccgcggcacccucaucgucgucuccuccgccuccaccaagggccccuccgucuucccccacgacuccgcc

SEQ ID NO: 19004 - RNA, 414 nt, Artificial Sequence
  derived and/or modified sequence opt2 from anti-HIV-1_HeavyChain
cagguccagcucguccaguccggcgccgaggucaagaagcccggcuccuccgucaaggucuccugcaaggucuccggcggcgucuucaccuccuacgccgucaccuggguccgccaggcccccggccagggccucgaguggaucggcugggucaaggccgucuccggcgccgucaacuacggcucccucgacuuccgccaccgcgucucccucacccgcgaccgcgaccucuucaccgcccacauggacauccgcggccucacccaggacgacaccgccaucuacuucugcgcccgccagaaguucgcccgcggcgaccagggcugguucuucgaccucuggggccgcggcacccucaucgucgucuccuccgccuccaccaagggccccuccgucuucccccacgaccuccgc

SEQ ID NO: 19005 - RNA, 417 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucuccggcgccgucaacuucggcucccccaacuuccgccagcgcgucucccucacccgcgaccgcgaccucuucaccgcccacauggacauccgcggccucacccagggcgacaccgccaccuacuucugcgcccgccagaaguucgagcgcggcggccagggcuggaucuucgaccucuggggccgcggcacccucaucgccgucuccuccgccuccaccaagggccccuccgucuucccccacgaccuccgc

SEQ ID NO: 19006 - RNA, 417 nt, Artificial Sequence
  derived and/or modified sequence opt2 from anti-HIV-1_HeavyChain
cagucccaccucgagcaguccggcuccgccaugaagaagcccggcgccuccgucaccgucuccugcuggaccuccgaggacaucuucgacaccaccgagcucaucuacuggguccgccaggcccccggccagggccucgaguggaucggcugggucaagaucgucuccggcaccgucaacuucgccucccucgacuuccgcaaccgcaucucccucucccgcgaccgcgaccucuccaccgcccacauggacauccgcggccucacccaggacgacaccgccaccuacuucugcgcccgccagaaguucgccucccgcuacuccggcgaccagggcuccuacuucgaccucuggggccgcggcacccucaucaucgucuccuccgccuccaccaagggccccuccgacgaccuccgc

SEQ ID NO: 19007 - RNA, 414 nt, Artificial Sequence
  derived and/or modified sequence opt2 from anti-HIV-1_HeavyChain
cagguccagcucguccaguccggcgccgaggucaagaagcccggcgccuccgucaaggucuccugcaaguccuccggcuacuccuucacccgcuucgacaucaccuggguccgccaggcccccggccagggccucgaguggaucggcugggucaagaccgucuccggcgccgucaacuucggcucccucaacuuccgccaccgcgucucccucacccgcgaccgcgaccucuucaccgcccacauggacauccgcggccucacccagggcgacaccgccaccuacuucugcgcccgccagaaguucgcccgcggcgaccagggcugguucuucgaccucuggggccgcggcacccucaucgucgucuccuccgccuccaccaagggccccuccgucuucccccacgaccuccgc

SEQ ID NO: 19008 - RNA, 420 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccuccgccuccaccaagggccccaucggccuccccccccgccucugcguc

SEQ ID NO: 19009 - RNA, 417 nt, Artificial Sequence
  derived and/or modified sequence opt2 from anti-HIV-1_HeavyChain
caggcccaccucgagcaguccggcgccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccuccgccuccaccaagggccccuccgucuucccccacgaccuccgc

SEQ ID NO: 19010 - RNA, 420 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuucaccgcccacauggacauccgcggccucacccaggacgacaccgccaccuacuucugcgcccgccagaaguucgcccgcggcgaccagggcugguucuucgaccucuggggccgcggcacccucaucgucgucuccuccgccuccaccaagggccccuccggccccucccccgagaucugcguc

SEQ ID NO: 19011 - RNA, 417 nt, Artificial Sequence
  derived and/or modified sequence opt2 from anti-HIV-1_HeavyChain
caggcccaccucgagcaguccggcgccggcgucaagcgccccggcgccuccguccgcgucuccugcuggaccuccgaggacaucuucgagaccaccgagcucauccacuggguccgccaggcccccggccagggccucgaguggaucggcugggucaagaccgucuccggcgccgucaacuucggcucccucaacuuccgccaccgcgucucccucacccgcgaccgcgaccucuucaccgcccacauggacauccgcggccucacccagggcgacaccgccaccuacuucugcgcccgccagaaguucgcccgcggcgaccagggcugguucuucgaccucuggggccgcggcacccucaucgucgucuccuccgccuccaccaagggccccuccgucuucccccacgaccuccgc

SEQ ID NO: 19012 - RNA, 417 nt, Artificial Sequence
  derived and/or modified sequence opt2 from anti-HIV-1_HeavyChain
cgcgcccaccucgagcaguccggcuccggcgucaagaagcucggcgccuccguccgcgucuccugcuggaccuccgaggacaucuucgagcgcaccgagcucauccacuggguccgccaggcccccggccagggccucgaguggaucggcugggucaaggccgucuccggcgccgccaacuacggcucccccaacuuccgccagcgcgucucccucacccgcgaccgcgaccucuucaccgcccacauggacauccgcggccucacccagggcgacaccgccaccuacuucugcgcccgccagaaguucgagcgcggcggccagggcuggaucuucgaccucuggggccgcggcacccucaucgccgucuccuccgccuccaccaagggccccuccgucuucccccacgaccuccgc

SEQ ID NO: 19013 - RNA, 417 nt, Artificial Sequence
  derived and/or modified sequence opt2 from anti-HIV-1_HeavyChain
cagguccaccucgagcaguccggcuccggcgucaagaagcucggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuucaccgcccacauggacauccgcggccucacccaggacgacaccgccaccuacuucugcgcccgccagaaguucgcccgcggcgaccagggcugguucuucgaccucuggggccgcggcacccucaucgucgucuccuccgccuccaccaagggccccuccgucuucccccacgaccuccgc

SEQ ID NO: 19014 - RNA, 417 nt, Artificial Sequence
  derived and/or modified sequence opt2 from anti-HIV-1_HeavyChain
cgcgcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaucgucuccggcgccgucaacuucggcucccccaacuuccgccagcgcgccucccucacccgcgaccgcgaccucuucaccgcccacauggacauccgcggccucacccagggcgacaccgccaccuacuucugcgcccgccagaaguucgagcgcggcggccagggcuggaucuucgaccucuggggccgcggcacccucaucgccgucuccuccgccuccaccaagggccccuccgucuuccccaccaucuacguc

SEQ ID NO: 19015 - RNA, 414 nt, Artificial Sequence
  derived and/or modified sequence opt2 from anti-HIV-1_HeavyChain
cagguccagcucguccaguccgaggccgaggucaagaagcccggcgccuccgucaagaucuccugcgccaccuccggcuacgccuucacccucuacuaccuccacuggguccgccaggcccccggccagggccucgaguggaucggcugggucaagaccgucaccggcgccgucaacuucggcuccgccuacuuccgccaccgcgucucccucacccgcgaccgcgaccucuucaccgcccacauggacauccgcggccucacccagggcgacaccgccaccuacuucugcgcccgccagaaguucuacaagggcggccagggcugguacuucgaccucuggggccgcggcacccucaucgucgucuccuccgccuccaccaagggccccuccgucuucccccacgaccuccgc

SEQ ID NO: 19016 - RNA, 420 nt, Artificial Sequence
  derived and/or modified sequence opt2 from anti-HIV-1_HeavyChain
caggcccaccccgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaucgucuccggcgccgucaacuucggcucccccaacuuccgccagcgcgucucccucacccgcgaccgcgaccucuucaccgcccacauggacauccgcggccucacccagggcgacaccgccaccuacuucugcgcccgccagaaguucgagcgcggcggccagggcuggaucuucgaccucuggggccgcggcacccucaucgccgucuccuccgccuccaccaagggccccuccggccuccccccccgccucugcguc

SEQ ID NO: 19017 - RNA, 417 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucuccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccuccgccuccaccaagggccccuccgucuuccccccccgcuccacc

SEQ ID NO: 19018 - RNA, 417 nt, Artificial Sequence
  derived and/or modified sequence opt2 from anti-HIV-1_HeavyChain
caggcccaccucgagcaguccggcuccggcgucaagcgccccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccuccgccuccaccaagggccccuccgucuucccccacgaccuccgc

SEQ ID NO: 19019 - RNA, 417 nt, Artificial Sequence
  derived and/or modified sequence opt2 from anti-HIV-1_HeavyChain
ggcgcccaccucgagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccuccgccuccaccaagggccccuccgucuucccccacgaccuccgc

SEQ ID NO: 19020 - RNA, 417 nt, Artificial Sequence
  derived and/or modified sequence opt2 from anti-HIV-1_HeavyChain
cgccacgaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaucgucuccggcgccgucaacuucggcucccccaacuuccgccagcgcgucucccucacccgcgaccgcgaccucuucaccgcccacauggacauccgcggccucacccagggcgacaccgccaccuacuucugcgcccgccagaaguucgagcgcggcggccagggcuggaucuucgaccucuggggccgcggcacccucaucgccgucuccuccgccuccaccaagggccccuccgucuucccccacgaccuccgc

SEQ ID NO: 19021 - RNA, 420 nt, Artificial Sequence
  derived and/or modified sequence opt2 from anti-HIV-1_HeavyChain
caggcccaccucgagcaguccggcuccggcgucaagaagcccggcgccuccguccgcgucuccugcugguccuccgaggacaucuucgagcgcaccgagcucauccacuggguccgccaggcccccggccagggccucgaguggaucggcugggucaagaccgucaccggcgccgucaacuucggcucccucgacuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccuccgccuccaccaagggccccuccgucaccaucuacguc

SEQ ID NO: 19022 - RNA, 414 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccuccgccucccccggccccaucggccccuccccccgcuccgcc

SEQ ID NO: 19023 - RNA, 417 nt, Artificial Sequence
  derived and/or modified sequence opt2 from anti-HIV-1_HeavyChain
caggcccaccucgagcaguccgccuccggcgucaagcgccccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccuccgccuccaccaagggccccuccgucuucccccacgaccuccgc

SEQ ID NO: 19024 - RNA, 417 nt, Artificial Sequence
  derived and/or modified sequence opt2 from anti-HIV-1_HeavyChain
cagguccagcucguccaguccggcgccgaggucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccuccgccuccaccaagggccccuccgucuuccccaccaucuacguc

SEQ ID NO: 19025 - RNA, 417 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgagcgcaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccuccgccuccaccaagggccccuccgucuuccccaccaucugcguc

SEQ ID NO: 19026 - RNA, 420 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgacaccaccgagcucauccacuggguccgccaggcccccggccagggccucgaguggaucggcugggucaagaccgucuccggcgccgucaacuucggcucccucaacuuccgccaccgcgucucccucacccgcgaccgcgaccucuucaccgcccacauggacauccgcggccucacccagggcgacaccgccaccuacuucugcgcccgccagaaguucgcccgcggcgaccagggcugguucuucgaccucuggggccgcggcacccucaucgucgucuccuccgccuccaccaacggccccaucggccccucccccaccgaccuccgc

SEQ ID NO: 19027 - RNA, 417 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgagcgcaccgagcucauccaguggguccgccaggcccccggccagggccucgaguggaugggcugggucaaggccgucuccggcgccgucaacuacggcucccucgacuuccgccaccgcgucucccucacccgcgaccgcgaccucuucaccgcccacauggacauccgcggccucacccaggacgacaccgccaccuacuucugcgcccgccagaaguucgcccgcggcgaccagggcugguucuucgaccucuggggccgcggcacccucaucgucgucuccuccgccuccaccaagggccccuccgucuucccccacgaccuccgc

SEQ ID NO: 19028 - RNA, 417 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgacaccaccgagcucaucuacuggguccgccaggcccccggccagggccucgaguggaucggcugggucaaggccgucuccggcgccgucaacuacggcucccucgacuuccgccaccgcgucucccucacccgcgaccgcgaccucuccaccgcccacauggacauccgcggccucacccaggacgacaccgccaccuacuucugcgcccgccagaaguucgcccgcggcgaccagggcugguucuucgaccucuggggccgcggcacccucaucgucgucuccuccgccuccaccaagggccccuccgucuucccccacgaccuccgc

SEQ ID NO: 19029 - RNA, 417 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuccaccgcccacauggacauccgcggccucacccaggacgacaccgccaccuacuucugcgcccgccagaaguucgcccgcggcgaccagggcugguucuucgaccucuggggccgcggcacccucaucgucgucuccuccgccuccaccaagggccccuccgucuuccccaccaucuacguc

SEQ ID NO: 19030 - RNA, 417 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccuccgccuccaccaagggccccuccgucuucccccacgacccccgc

SEQ ID NO: 19031 - RNA, 423 nt, Artificial Sequence
  derived and/or modified sequence opt2 from anti-HIV-1_HeavyChain
caggucuacauggagcaggccggcgccggcaugaagaagcccggcgccuccaugaccgucuccugcaagaccgccgacgaggacaucuucgacgccgccuacaugcacuggguccgccaggcccccggccagaccuucgaguggcucggcuggaugaagcccgucaccggcgccgucaacuacgcccgccaguuccagggccgcgucuccuucuaccgcacccgcgagcucggcaucgccuacauggaccuccgcgaccucaaguucgacgacaccgccgucuacuucugcgcccgcaagaccaagggcgacgucuccggcgacgaccgcggcuucuucuucgaccucuggggccgcggcacccgcgucaucgucuccuccgccuccaccaagggccccuccgucuucccccacgaccuccgc

SEQ ID NO: 19032 - RNA, 423 nt, Artificial Sequence
  derived and/or modified sequence opt2 from anti-HIV-1_HeavyChain
caggucuacauggagcaggccggcggcggcaugaagaagcccggcgccuccaugaccgucuccugcaagaccgccgacgaggacaucuucgacgccgccuacaugcacuggguccgccaggcccgcggccagaccuucgaguggcucggcuggaugaagcccgucaccggcgccgucaacuacgcccgccaguuccagggccgcgucuccuucuaccgcacccgcgagcucggcaucgccuacauggaccuccgcgaccucaaguucgacgacaccgccgucuacuucugcgcccgcaagaccaagggcgacgucuccggcgacgaccgcggcuucuucuucgaccucuggggccgcggcacccgcgucaucgucuccuccgccuccaccaagggccccuccgucuuccccaccaucuacguc

SEQ ID NO: 19033 - RNA, 423 nt, Artificial Sequence
  derived and/or modified sequence opt2 from anti-HIV-1_HeavyChain
caggucuacauggagcaggccggcgccggcgucaagaagcccggcgccuccgucacccucuccugcaagaccgccgacgaggacgucuucgacgccgccuacaugcacuggguccgccaggcccccggccagaccuucgaguggcucggcuggaugaagcccgucaccggcgccgucuccuacgcccgcaaguuccagggccgcgucuccuucuacaugacccgcgagcucggcauggccuacauggaccuccgcaaccuccgcuucgacgacaccgccgucuacuucugcgcccgcaagaccgccggcgacgucuccggcgacaaccgcggcuacuucuucgaccucuggggccgcggcucccgcgucaucgucuccuccgccuccaccaagggccccuccgucuuccccaccaucuacguc

SEQ ID NO: 19034 - RNA, 423 nt, Artificial Sequence
  derived and/or modified sequence opt2 from anti-HIV-1_HeavyChain
caggucuacuccggcgccggccgcggcggcgucaagaagcccggcgccuccgucacccucuccugcaagaccgccgacgaggacgucuucgacgccgccuacaugcacuggguccgccaggcccccggccagaccuucgaguggcucggcuggaugaagcccgucaccggcgccgucaacuacgcccgcaaguuccagggccgcgucuccuucuaccgcacccgcgagcucggcaucgccuacauggaccuccgcaaccuccgcuucgacgacaccgccgucuacuucugcgcccgcaagaccgccggcgacgucuccggcgacaagcgcggcuucuucuucgaccucuggggccgcggcucccgcgucaucgucuccuccgccuccaccaagggccccuccgucuuccccaccaucuacguc

SEQ ID NO: 19035 - RNA, 417 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucuccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccuccgccuucaccaagggccccuccgucuucccccacgaccuccgc

SEQ ID NO: 19036 - RNA, 414 nt, Artificial Sequence
  derived and/or modified sequence opt2 from anti-HIV-1_HeavyChain
cagguccagcucggccaguccggcgccgagaugaagaagcccggcuccuccgucaaggucuccugcaaggccuccggcggcaccuuccgccacucccccaucuccuggguccgccaggcccccggccagggccucgaguggaucggcugggucaaggccgucuccggcgccgucaacuacggcucccucgacuuccgccaccgcgucucccucacccgcgaccgcgaccucuccaccgcccacauggacauccgcggccucacccaggacgacaccgccaccuacuucugcgcccgccagaaguucgcccgcggcgaccagggcugguucuucgaccucuggggccgcggcacccucaucgucgucuccuccgccuccaccaagggccccuccgucuucccccacgaccuccgc

SEQ ID NO: 19037 - RNA, 417 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgacaccaccgagcucaucuacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccuccgccuccaccaagggccccuccgucuucccccacgaccuccgc

SEQ ID NO: 19038 - RNA, 423 nt, Artificial Sequence
  derived and/or modified sequence opt2 from anti-HIV-1_HeavyChain
caggucuacauggagcaggccggcgccggcgucaagaagcccggcgccuccgucacccucuccugcaagaccgccgacgaggacgucuucgacgccgccuacaugcacuggguccgccaggcccccggccagaccuucgaguggcucggcuggaugaagcccgucaccggcgccgucuccuacgcccgcaaguuccagggccgcgucuccuucuacaugacccgcgagcucggcauggccuacauggaccuccgcaaccuccgcuucgacgacaccgccgucuacuucugcgcccgcaagaccgccggcgacgucuccggcgacaaccgcggcuacuucuucgaccucuggggccgcggcuccugggucaucgucuccuccgccuccaccaagggccccuccgucuucccccacgaccuccgc

SEQ ID NO: 19039 - RNA, 423 nt, Artificial Sequence
  derived and/or modified sequence opt2 from anti-HIV-1_HeavyChain
caggucuacauggagcaggccggcggcggcgucaagaagcccggcgccuccgucacccucuccugcaagaccgccgacgaggacgucuucgacgccgccuacaugcacuggguccgccaggcccccggccagaccuucgaguggcucggcuggaugaagcccgucaccggcgccgucaacuacgcccgcaaguuccagggccgcgucuccuucuaccgcacccgcgagcucggcaucgccuacauggaccuccgcaaccuccgcuucgacgacaccgccgucuacuucugcgcccgcaagaccgccggcgacgucuccggcgacaagcgcggcuucuucuucgaccucuggggccgcggcucccgcgucaucgucuccuccgccuccaccaagggccccuccgucuuccccaccaucugcguc

SEQ ID NO: 19040 - RNA, 417 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgagcgcaccgagcucauccacuggguccgccaggcccccggccgcggccucgaguggaucggcugggucaaggccgucuccggcgccgucaacuacggcucccucgacuuccgccaccgcgucucccucacccgcgaccgcgaccucuucaccgcccacauggacauccgcggccucacccaggacgacaccgccaccuacuucugcgcccgccagaaguucgcccgcggcgaccagggcugguucuucgaccucuggggccgcggcacccucaucgucgucuccuccgccuccaccaagggccccuccgucuucccccacgaccuccgc

SEQ ID NO: 19041 - RNA, 423 nt, Artificial Sequence
  derived and/or modified sequence opt2 from anti-HIV-1_HeavyChain
caggucuacauggagcaggccggcggcggcgucaagaagcccggcgccuccgucacccucuccugcaagaccgccgacgaggacgucuucgacgccgccuacaugcacuggguccgccaggcccccggccagaccuucgaguggcucggcuggaugaagcccgucaccggcgccgucaacuacgcccgcaaguuccagggccgcgucuccuucuaccgcacccgcgagcucggcaucgccuacauggaccuccgcaaccuccgcuucgacgacaccgccgucuacuucugcgcccgcaagaccgccggcgacgucuccggcgacaagcgcggcuucuucuucgaccucuggggccgcggcucccgcgucaucgucuccuccgccuccaccaagggccccuccgucuuccccaccaucuacguc

SEQ ID NO: 19042 - RNA, 423 nt, Artificial Sequence
  derived and/or modified sequence opt2 from anti-HIV-1_HeavyChain
caggucuucauggagcaggccggcgccggcaugaagaagcccggcgccuccaugaccgucuccugcaagaccgccgacgaggacgucuucgacgccgccuacaugcacuggguccgccaggcccccggccagaccuucgaguggcucggcuggaugaagcccgucaccggcgccgucaacuacgcccgcaaguuccagggccgcgucuccuucuaccgcacccgcgagcucggcaucgccuacauggaccuccgcaaccuccgcuucgacgacaccgccgucuacuucugcgcccgcaagaccgccggcgacgucuccggcgacaagcgcggcuucuucuucgaccucuggggccgcggcucccgcgucaucgucuccuccgccuccaccaagggccccuccgucuucccccacgaccuccgc

SEQ ID NO: 19043 - RNA, 423 nt, Artificial Sequence
  derived and/or modified sequence opt2 from anti-HIV-1_HeavyChain
caggucuacauggagcaggccggcgccggcgucaagaagcccggcgccuccgucacccucuccugcaagaccgccgacgaggacgucuucgacgccgccuacaugcacuggguccgccaggcccccggccagaccuucgaguggcucggcuggaugaagcccgucaccggcgccgucaacuacgcccgcaaguuccagggccgcgucuccuucuaccgcacccgcgagcucggcaucgccuacauggaccuccgcaaccuccgccucgacgacaccgccgucuacuucugcgcccgcaagaccgccggcgacgucuccggcgacaagcgcggcuucuucuucgaccucuggggccgcggcucccgcgucaucgucuccuccgccuccaccaagggccccuccgucuucccccacgaccuccgc

SEQ ID NO: 19044 - RNA, 420 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgagcgcaccgagcucaucuacuggguccgccaggcccccggccgcggccucgaguggaucggcugggucaagaccgucuccggcaccgucaacuucggcuccuccgacuuccgcaaccgcaucucccucacccgcgaccgcgaccucuccaccgcccacauggacauccgcggccucacccaggacgacaccgccaccuacuucugcgcccgccagaaguucgagucccucuacuccgacgaccagggcuccuacuucgaccucuggggccgcggcacccucaucaucgucuccuccgccuccaccaagggccccuccgucuuccccaccauc

SEQ ID NO: 19045 - RNA, 423 nt, Artificial Sequence
  derived and/or modified sequence opt2 from anti-HIV-1_HeavyChain
caggucuacauggagcaggccggcggcggcgucaagaagcccggcgccuccgucacccucuccugcaagaccgccgacgaggacgucuucgacgccgccuacaugcacuggguccgccaggcccccggccagaccuucgaguggcucggcuggaugaagcccgucaccggcgccgucuccuacgcccgcaaguuccagggccgcgucuccuucuacaugacccgcgagcucggcauggccuacauggaccuccgcaaccuccgcuucgacgacaccgccgucuacuucugcgcccgcaagaccgccggcgacgucuccggcgacaaccgcggcuacuucuucgaccucuggggccgcggcucccgcgucaucgucuccuccgccuccaccaagggccccuccgucuuccccaccaucugcguc

SEQ ID NO: 19046 - RNA, 417 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguacuacgccggcggccagggcugguacuucgaccucuggggccgcggcacccucaucgucgucuccuccgccuccaccaagggccccuccgucuucccccacgaccuccgc

SEQ ID NO: 19047 - RNA, 426 nt, Artificial Sequence
  derived and/or modified sequence opt2 from anti-HIV-1_HeavyChain
caggcccaccucgagcaguccggcuccggcgucaagaagcccggcgccuccguccgcgucuccugcugguccuccgaggacaucuucgagcgcaccgagcucauccacuggguccgccaggcccccggccagggccucgaguggaucggcugggucaagaccgucaccggcgccgucaacuucggcucccucgacuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccuccgccuccaccaagggccccuccgucuucccccacgaccuccgc

SEQ ID NO: 19048 - RNA, 423 nt, Artificial Sequence
  derived and/or modified sequence opt2 from anti-HIV-1_HeavyChain
caggucuacaugggcgccggccgcggcggcgucaagaagcccggcgccuccgucacccucuccugcaagaccgccgacgaggacgucuucgacgccgccuacaugcacuggguccgccaggcccccggccagaccuucgaguggcucggcuggaugaagcccgucaccggcgccgucaacuacgcccgcaaguuccagggccgcgucuccuucuaccgcacccgcgagcucggcaucgccuacauggaccuccgcaaccuccgcuucgacgacaccgccgucuacuucugcgcccgcaagaccgccggcgacgucuccggcgacaagcgcggcuucuucuucgaccucuggggccgcggcucccgcgucaucgucuccuccgccuccaccaagggccccuccgucuuccccaccaucuacguc

SEQ ID NO: 19049 - RNA, 423 nt, Artificial Sequence
  derived and/or modified sequence opt2 from anti-HIV-1_HeavyChain
caggucuacauggagcaggccggcggcggcaugaagaagcccggcgccuccaugaccgucuccugcaagaccgccgacgaggacaucuucgacgccgccuacaugcacuggguccgccaggcccccggccagaccuucgaguggcucggcuggaugaagcccgucaccggcgccgucaacuacgcccgccaguuccagggccgcgucuccuucuaccgcacccgcgagcucggcaucgccuacauggaccuccgcgaccucaaguucgacgacaccgccgucuacuucugcgcccgcaagaccaagggcgacgucuccggcgacgaccgcggcuucuucuucgaccucuggggccgcggcacccgcgucaucgucuccuccgccuccaccaagggccccuccgucuuccccaccaucugcguc

SEQ ID NO: 19050 - RNA, 423 nt, Artificial Sequence
  derived and/or modified sequence opt2 from anti-HIV-1_HeavyChain
caggucuacauggagcaggccggcggcggcaugaagaagcccggcgccuccaugaccgucuccugcaagaccgccgacgaggacaucuucgacgccgccuacaugcacuggguccgccaggcccccggccagaccuucgaguggcucggcuggaugaagcccgucaccggcgccgucaacuacgcccgccaguuccagggccgcgucuccuucuaccgcacccgcgagcucggcaucgccuacauggaccuccgcgaccucaaguucgacgacaccgccgucuacuucugcgcccgcaagaccaagggcgacgucuccggcgacgaccgcggcuucuucuucgaccucuggggccgcggcacccgcgucaucgucuccuccgccuccaccaagggccccuccgucuucccccacgaccuccgc

SEQ ID NO: 19051 - RNA, 423 nt, Artificial Sequence
  derived and/or modified sequence opt2 from anti-HIV-1_HeavyChain
caggucuacauggagcaggccggcgccggcgucaagaagcccggcgccuccgucacccucuccugcaagaccgccgacgaggacgucuucgacgccgccuacaugcacuggguccgccaggcccccggccagaccuucgaguggcucggcuggaugaagcccgucaccggcgccgucaacuacgcccgcaaguuccagggcaaggucuccuucuaccgcacccgcgagcucggcaucgccuacauggaccuccgcaaccuccgcuucgacgacaccgccgucuacuucugcgcccgcaagaccgccggcgacgucuccggcgacaagcgcggcuucuucuucgaccucuggggccgcggcucccgcgucaucgucuccuccgccuccaccaagggccccuccgucuucccccacgaccuccgc

SEQ ID NO: 19052 - RNA, 423 nt, Artificial Sequence
  derived and/or modified sequence opt2 from anti-HIV-1_HeavyChain
caggucuacauggagcaggccggcgccggcgucaagaagcccggcgccuccgucacccucuccugcaagaccgccgacgaggacgucuucgacgccgccuacaugcacuggguccgccaggcccccggccagaccuucgaguggcucggcuggaugaagcccgucaccggcgccgucaacuacgcccgcaaguuccagucccgcgucuccuucuacggcacccgcgagcucggcaucgccuacauggaccuccgcaaccuccgcuucgacgacaccgccgucuacuucugcgcccgcaagaccgccggcgacgucuccggcgacaagcgcggcuucuucuucgaccucuggggccgcggcucccgcgucaucgucuccuccgccuccaccaagggccccuccgucuucccccacgaccuccgc

SEQ ID NO: 19053 - RNA, 420 nt, Artificial Sequence
  derived and/or modified sequence opt2 from anti-HIV-1_HeavyChain
cagggccacaccgucgagcaguccggcuccggcgucaagaagcucggcgccuccguccgcgucuccugcuggaccuccgaggacaucuucgagaccaccgagcucauccacuggguccgccaggcccccggccagggccucgaguggaucggcugggucaagaccgucuccggcgccgucaacuucggcucccucaacuuccgccaccgcgucucccucacccgcgaccgcgaccucuucaccgcccacauggacauccgcggccucacccagggcgacaccgccaccuacuucugcgcccgccagaaguucgcccgcggcgaccagggcugguucuucgaccucuggggccgcggcacccucaucgucgucuccuccgccuccaccaagggccccuccgucuucccccacgaccuccgc

SEQ ID NO: 19054 - RNA, 420 nt, Artificial Sequence
  derived and/or modified sequence opt2 from anti-HIV-1_HeavyChain
caggccacccccugguccaaccucggccgcggcgucaagaagcucggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccuccgccuccaccaagggccccuccgucuucccccacgaccuccgc

SEQ ID NO: 19055 - RNA, 423 nt, Artificial Sequence
  derived and/or modified sequence opt2 from anti-HIV-1_HeavyChain
caggucuucauggagcaggccggcgccggcaugaagaagcccggcgccuccaugaccgucuccugcaagaccgccgacgaggacgucuucgacgccgccuacaugcacuggguccgccaggcccccggccagaccuucgaguggcucggcuggaugaagcccgucaccggcgccgucuccuacgcccgcaaguuccagggccgcgucuccuucuacaugacccgcgagcucggcauggccuacauggaccuccgcaaccuccgcuucgacgacaccgccgucuacuucugcgcccgcaagaccgccggcgacgucuccggcgacaaccgcggcuacuucuucgaccucuggggccgcggcucccgcgucaucgucuccuccgccuccaccaagggccccuccgucuucccccacgaccuccgc

SEQ ID NO: 19056 - RNA, 423 nt, Artificial Sequence
  derived and/or modified sequence opt2 from anti-HIV-1_HeavyChain
caggucuacauggagcaguccggcggcggcgucaagaagcccggcgccuccgucacccucuccugcaagaccgccgacgaggacgucuucgacgccgccuacaugcacuggguccgccaggcccccggccagaccuucgaguggcucggcuggaugaagcccgucaccggcgccgucuccuacgcccgcaaguuccagggccgcgucuccuucuaccgcacccgcgagcucggcaucgccuacauggaccuccgcaaccuccgcuucgacgacaccgccgucuacuucugcgcccgcaagaccgccggcgacgucuccggcgacaagcgcggcuucuucuucgaccucuggggccgcggcucccgcgucaucgucuccuccgccuccaccaagggccccuccgucuucccccacgaccuccgc

SEQ ID NO: 19057 - RNA, 423 nt, Artificial Sequence
  derived and/or modified sequence opt2 from anti-HIV-1_HeavyChain
caggucuacauggagcgcggccgcggcggcgucaagaagcccggcgccuccgucacccucuccugcaagaccgccgacgaggacgucuucgacgccgccuacaugcacuggguccgccaggcccccggccagaccuucgaguggcucggcuggaugaagcccgucaccggcgccgucaacuacgcccgcaaguuccagggccgcgucuccuucuaccgcacccgcgagcucggcaucgccuacauggaccuccgcaaccuccgcuucgacgacaccgccgucuacuucugcgcccgcaagaccgccggcgacgucuccggcgacaagcgcggcuucuucuucgaccucuggggccgcggcucccgcgucaucgucuccuccgccuccaccaagggccccuccgucuucccccacgaccuccgc

SEQ ID NO: 19058 - RNA, 423 nt, Artificial Sequence
  derived and/or modified sequence opt2 from anti-HIV-1_HeavyChain
caggucuacauggagcaggccggcggcggcgucaagaagcccggcgccuccgucacccucuccugcaagaccgccgacgaggacgucuucgacgccgccuacaugcacuggguccgccaggcccccggccagaccuucgaguggcucggcuggaugaagcccgucaccggcgccgucuccuacgcccgccgcuuccagggccgcgucuccuucuacaugacccgcgagcucggcauggccuacauggaccuccgcaaccuccgcuucgacgacaccgccgucuacuucugcgcccgcaagaccgccggcgacgucuccggcgacaaccgcggcuacuucuucgaccucuggggccgcggcucccgcgucaucgucuccuccgccuccaccaagggccccuccgucuuccccaccaucugcguc

SEQ ID NO: 19059 - RNA, 423 nt, Artificial Sequence
  derived and/or modified sequence opt2 from anti-HIV-1_HeavyChain
caggucuacauggagcaggccggcggcggcgucaagaagcccggcgccuccgucacccucuccugcaagaccgccgacgaggacgucuucgacgccgccuacaugcacuggguccgccaggcccccggccagaccuucgaguggcucggcuggaugaagcccgucaccggcgccgucuccuacgcccgcaaguuccagggccgcgucuccuucuacaugacccgcgagcucggcauggccuacauggaccuccgcaaccuccgcuucgacgacaccgccgucuacuucugcgcccgcaagaccgccggcgacgucuccggcgacaaccgcggcuacuucuucgaccucuggggccgcggcucccgcgucaucgucuccuccgccuccaccaagggccccuccgucuucccccacgaccuccgc

SEQ ID NO: 19060 - RNA, 423 nt, Artificial Sequence
  derived and/or modified sequence opt2 from anti-HIV-1_HeavyChain
caggucuucauggagcaggccggcggcggcaugaagaagcccggcgccuccaugaccgucuccugcaagaccgccgacgaggacaucuucgacgccgccuacaugcacuggguccgccaggcccccggccagaccuucgaguggcucggcuggaugaagcccgucaccggcgccgucaacuacgcccgccaguuccagggccgcgucuccuucuaccgcacccgcgagcucggcaucgccuacauggaccuccgcgaccucaaguucgacgacaccgccgucuacuucugcgcccgcaagaccaagggcgacgucuccggcgacgaccgcggcuucuucuucgaccucuggggccgcggcacccgcgucaucgucuccuccgccuccaccaagggccccuccgucuucccccacgaccuccgc

SEQ ID NO: 19061 - RNA, 423 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccucgacuuccgccaccgcaucucccucacccgcgaccgcgaccucuucaccgcccacauggacauccgcggccucacccagggcgacaccgccaccuacuucugcgcccgccagaaguucgccucccgcuacuccggcgaccagggcuccuacuucgaccucuggggccgcggcacccucaucgucgucuccuccgccuccaccaagggccccuccgucuucccccacgaccuc

SEQ ID NO: 19062 - RNA, 423 nt, Artificial Sequence
  derived and/or modified sequence opt2 from anti-HIV-1_HeavyChain
caggucuucauggagcaggccggcgccggcaugaagaagcccggcgccuccaugaccgucuccugcaagaccgccgacgaggacgucuucgacgccgccuacaugcacuggguccgccaggcccccggccccgaccucgaguggcucggcuggaugaagcccgucaccggcgccgucaacuacgcccgcaaguuccagggccgcgucuccuucuaccgcacccgcgagcucggcaucgccuacauggaccuccgcgaccuccgcuucgacgacaccgccgucuacuucugcgcccgcaagaccgccggcgacgucuccggcgacaagcgcggcuucuucuucgaccucuggggccgcggcucccgcgucaucgucuccuccgccuccaccaaggcccaccgcuccucccccaccaucugcguc

SEQ ID NO: 19063 - RNA, 426 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccuccgccuccaccaagggccccuccgucuucccccacgaccuccgc

SEQ ID NO: 19064 - RNA, 423 nt, Artificial Sequence
  derived and/or modified sequence opt2 from anti-HIV-1_HeavyChain
caggucuacauggagcaggccggcggcggcgucaagaagcccggcgccuccgucacccucuccugcaagaccgccgacgaggacgucuucgacgccgccuacaugcacuggguccgccaggcccccggccagaccuucgaguggcucggcuggaugaagcccgucaccggcgccgucuccuacgcccgcaaguuccagggccgcgucuccuucuacaugacccgcgagcucggcauggccuacauggaccuccgcaaccuccgcuucaacgacaccgccgucuacuucugcgcccgcaagaccgccggcgacgucuccggcgacaaccgcggcuacuucuucgaccucuggggccgcggcucccgcgucaucgucuccuccgccuccaccaagggccccuccgucuucccccacgaccuccgc

SEQ ID NO: 19065 - RNA, 423 nt, Artificial Sequence
  derived and/or modified sequence opt2 from anti-HIV-1_HeavyChain
caggucuacauggagcaggccggcggcggcgucaagaagcccggcgccuccgucacccucuccugcaagaccgccgacgaggacgucuucgacgccgccuacaugcacuggguccgccaggcccccggccagaccuucgaguggcucggcuggaugaagcccgucaccggcgccgucaacuacgcccgcaaguuccagggccgcgucuccuucuaccgcacccgcgagcucggcaucgccuacauggaccuccgcaaccuccgcuucgacgacaccgccgucuacuucugcgcccgcaagaccgccggcgacgucuccggcgacaaccgcggcuacuucuucgaccucuggggccgcggcucccgcgucaucgucuccuccgccuccaccaagggccccuccggccucccccacgaccuccgc

SEQ ID NO: 19066 - RNA, 423 nt, Artificial Sequence
  derived and/or modified sequence opt2 from anti-HIV-1_HeavyChain
caggucuacauggagcaggccggcggcggcgucaagaagcccggcgccuccgucacccucuccugcaagaccgccgacgaggacgucuucgacgccgccuacaugcacuggguccgccaggcccccggccagaccuucgaguggcucggcuggaugaagcccgucaccggcgccgucaacuacgcccgcaaguuccagggccgcgucuccuucuaccgcacccgcgagcucggcaucgccuacauggaccuccgcaaccuccgcuucgacggcaccgccgucuacuucugcgcccgcaagaccgccggcgacgucuccggcgacaagcgcggcuucuucuucgaccucuggggccgcggcucccgcgucaucgucuccuccgccuccaccaagggccccuccgucuucccccacgaccuccgc

SEQ ID NO: 19067 - RNA, 423 nt, Artificial Sequence
  derived and/or modified sequence opt2 from anti-HIV-1_HeavyChain
caggucuacauggagcaggccggcggcggcgucaagaagcccggcgccuccgucacccucuccugcaagaccgccgacgaggacgucuucgacgccgccuacaugcacuggguccgccaggcccccggccagaccuucgaguggcucggcuggaugaagcccgucaccggcgccgucaacuacgcccgcaaguuccagggccgcgucuccuucuaccgcacccgcgagcucggcaucgccuacauggaccuccgcaaccuccgcuucgacgacaccgccgucuacuucugcgcccgcaagaccgccggcgacgucuccggcgacaagcgcggcuucuucuucgaccucuggggccgcggcucccgcgucaucgucuccuccgccuccaccaagggccccuccgucuucccccacgaccuccgc

SEQ ID NO: 19068 - RNA, 423 nt, Artificial Sequence
  derived and/or modified sequence opt2 from anti-HIV-1_HeavyChain
cagguccagcucguccaguccggcgccgaggucaagaagcccggcgccucccucaaggucuccugcaaggccuccggcuacaccuucaccgacuacuacauccacuggguccgccaggcccccggccagggccucgaguggaucggcugggucaagaucgucuccggcaccgucaacuucgccucccucgacuuccgcaaccgcaucucccucucccgcgaccgcgaccucuccaccgccuacauggacauccgcggccucacccaggacgacaccgccaccuacuucugcgcccgccagaaguucgccucccgcuacuccggcgaccagggcuccuacuucgaccucuggggccgcggcacccucaucgucgucuccuccgccuccaccaagggccccuccgucuucccccacgaccuccgc

SEQ ID NO: 19069 - RNA, 423 nt, Artificial Sequence
  derived and/or modified sequence opt2 from anti-HIV-1_HeavyChain
caggcccaccucgagcaguccggcuccggcgucaagaagcccggcgccuccguccgcgucuccugcugguccuccgaggacaucuucgagcgcaccgagcucauccacuggguccgccaggcccccggccagggccucgaguggaucggcugggucaagaccgucaccggcgccgucaacuucggcucccucgacuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccucaucgucgucuccuccgccuccacccgcgcccaccgcuccccccacgaccuccgc

SEQ ID NO: 19070 - RNA, 426 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgccagcgcgucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccuccgccuccaccaagggccccuccgucuucccccacgaccuccgc

SEQ ID NO: 19071 - RNA, 426 nt, Artificial Sequence
  derived and/or modified sequence opt2 from anti-HIV-1_HeavyChain
cagguccagcucguccaguccggcgccgaggucaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgccucccucgacuuccgcaaccgcaucucccucucccgcgaccgcgaccucuccaccgccuacauggacauccgcggccucacccaggacgacaccgccaccuacuucugcgcccgccagaaguucgccucccgcuacuccggcgaccagggcuccuacuucgaccucuggggccgcggcacccucaucgucgucuccuccgccuccaccaagggccccuccgucuucccccagaucugcguc

SEQ ID NO: 19072 - RNA, 426 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgagcgcaccgagcucaucuacuggguccgccaggcccccggccgcggccucgaguggaucggcuggaugaagaccgucuccggcaccgucaacuucggcuccuccgacuuccgcaaccgcaucucccucacccgcgaccgcgaccucuccaccgcccacauggacauccgcggccucacccaggacgacaccgccaccuacuucugcgcccgccagaaguucgagucccucuacuccgacgaccagggcuccuacuucgaccucuggggccgcggcacccucaucaucgucuccuccgccuccaccaaggcccaccgcuccucccccaccacccuccgc

SEQ ID NO: 19073 - RNA, 423 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgccucccucgacuuccgcaaccgcaucucccucucccgcgaccgcgaccucuccaccgcccacauggacauccgcggccucacccaggacgacaccgccaccuacuucugcgcccgccagaaguucgccucccgcuacuccggcgaccagggcuccuacuucgaccucuggggccgcggcacccucaucaucgucuccuccgccuccaccaagggccccuccgucuucccccgcuccgcc

SEQ ID NO: 19074 - RNA, 423 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggccaccagaucuccgaccgcgucucccucucccgcgaccgcgaccucuccaccgccuacauggacauccgcggccucacccaggacgacaccgccaccuacuucugcgcccgccagaaguucgccucccgcuacuccggcgaccagggcuccuacuucgaccucuggggccgcggcacccucaucgucgucuccuccgccuccaccaagggccccuccgucuucccccacgaccuccgc

SEQ ID NO: 19075 - RNA, 423 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgccucccucgacuuccgcaaccgcaucucccucucccgcgaccgcgaccucuccaccgcccacauggacauccgcggccucacccaggacgacaccgccaccuacuucugcgcccgccagaaguucgccucccgcuacuccggcgaccagggcuccuacuucgaccucuggggccgcggcacccucaucaucgucuccuccgccuccacccgcgcccaccgcuccuccccccgcuccgcc

SEQ ID NO: 19076 - RNA, 426 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcuccuccgacuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccuccgccuccaccaagggccccuccgucuucccccacgaccuccgc

SEQ ID NO: 19077 - RNA, 426 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucggcuccuccgacuuccgcaaccgcaucucccucacccgcgaccgcgaccucuccaccgcccacauggacauccgcggccucacccaggacgacaccgccaccuacuucugcgcccgccagaaguucgagucccucuacuccgacgaccagggcuccuacuucgaccucuggggccgcggcacccucaucaucgucuccuccgccuccaccaagggccccuccgucuuccccaccaucuacguc

SEQ ID NO: 19078 - RNA, 426 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgccucccucgacuuccgcaaccgcaucucccucucccgcgaccgcgaccucuccaccgccuacauggacauccgcggccucacccaggacgacaccgccaccuacuucugcgcccgccagaaguucgccucccgcuacuccggcgaccagggcuccuacuucgaccucuggggccgcggcacccucaucgucgucuccuccgccuccaccaagggccccuccgucuucccccacgaccuccgc

SEQ ID NO: 19079 - RNA, 423 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgccucccucgacuuccgcaaccgcaucucccucucccgcgaccgcgaccucuccaccgcccacauggacauccgcggccucacccaggacgacaccgccaccuacuucugcgcccgccagaaguucgccucccgcuacuccggcgaccagggcuccuacuucgaccucuggggccgcggcacccucaucaucgucuccuccgccuccaccaagggccccuccgucuuccccaccaucugc

SEQ ID NO: 19080 - RNA, 417 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgccaccgcgucucccucacccgcgaccgcgaccucuccaccgcccacauggacauccgcggccucacccaggacgacaccgccaccuacuucugcgcccgccagaaguucgcccgcggcgaccagggcugguucuucgaccucuggggccgcggcacccucaucgucgucuccuccgcccuccaccagggccccaucggccuccccccccgcuccacc

SEQ ID NO: 19081 - RNA, 423 nt, Artificial Sequence
  derived and/or modified sequence opt2 from anti-HIV-1_HeavyChain
caggucuacauggagcaggccggcggcggcgucaagaagcccggcgccuccgucacccucuccugcaagaccgccgacgaggacgucuucgacgccgccuacaugcacuggguccgccaggcccccggccagaccuucgaguggcucggcuggaugaagcccgucaccggcgccgucaacuacgcccgcaaguuccagggccgcgucuccuucuaccgcacccgcgagcucggcaucgccuacauggaccuccgcaaccuccgcuucgacgacaccgccgucuacuucugcgcccgcaagaccgccggcgacgucuccggcgacaagcgcggcuucuucuucgaccucuggggccgcggcucccgcgucaucgucuccuccgccuccaccaagggccccuccguccuccccccccgcuccgcc

SEQ ID NO: 19082 - RNA, 423 nt, Artificial Sequence
  derived and/or modified sequence opt2 from anti-HIV-1_HeavyChain
cagguccagcucguccaguccggcgccgaggucaagaagcccggcgccuccgucaagaucuccugcaaggccuccggcuacaccuucauccgccacggcauccacuggcuccgccagguccccggccagcgccccgaguggaugggcuggauccgccccaagaccggcgcccgcaaccaggcccgccaguuccagccccgcaucucccucgcccgcgaccgcgcccucuccaccgccuaccucgaccucaacucccucaccuccgccgacuccggcaccuacuucugcgcccgccagaccuucaagcccgacuucuacuucgccgaccagggcugguccuucaaccucuggggccgcggcgcccacuucaucgucuccuccgcccuccaccagggccccaucggccuccccccccgcuccacc

SEQ ID NO: 19083 - RNA, 426 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgagcgcaccgagcucaucuacuggguccgccaggcccccggccagggccucgaguggaucggcugggucaagaucgucuccggcaccgucaacuucgccucccucgacuuccgcaaccgcaucucccucucccgcgaccgcgaccucuccaccgccuacauggacauccgcggccucacccaggacgacaccgccaccuacuucugcgcccgccagaaguucgccucccgcuacuccggcgaccagggcuccuacuucgaccucuggggccgcggcacccucaucgucgucuccuccgccuccaccaagggccccuccgucuucccccacgaccuccgc

SEQ ID NO: 19084 - RNA, 426 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccucgacuuccgccaccgcaucucccucacccgcgaccgcgaccucuucaccgcccacauggacauccgcggccucacccagggcgacaccgccaccuaccucugcgcccgccagaaguucgagucccgcuacaccggcggccagggcugguacuucgaccucuggggccgcggcacccacaucgucgucuccuccgccuccaccaagggccccuccgucuuccccaccaucugcguc

SEQ ID NO: 19085 - RNA, 426 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgccucccucgacuuccgcaaccgcaucucccucucccgcgaccgcgaccucuccaccgccuacauggacauccgcggccucacccaggacgacaccgccaccuacuucugcgcccgccagaaguucgccucccgcuacuccggcgaccagggcuccuacuucgaccucuggggccgcggcacccucaucgucgucuccuccgccuccaccaagggccccuccgucuucccccagaucugcguc

SEQ ID NO: 19086 - RNA, 426 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccucgacuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccuccgccuccaccaagggccccuccgucuuccccaccaucugcguc

SEQ ID NO: 19087 - RNA, 426 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucgagucccucuacuccgacgaccagggcuccuacuucgaccucuggggccgcggcacccucaucaucgucuccuccgccuccaccaagggccccuccgucuuccccaccaucugcguc

SEQ ID NO: 19088 - RNA, 426 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucuccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccuccgccuccaccaagggccccuccgucuucccccacgaccuccgc

SEQ ID NO: 19089 - RNA, 426 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgccucccucgacuuccgcaaccgcaucucccucucccgcgaccgcgaccucuccaccgcccacauggacauccgcggccucacccaggacgacaccgccaccuacuucugcgcccgccagaaguucgccucccgcuacuccggcgaccagggcuccuacuucgaccucuggggccgcggcacccucaucaucgucuccuccgccuccaccaagggccccuccgucuuccccaccaucugcguc

SEQ ID NO: 19090 - RNA, 426 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcaccgucaacuucggcucccucaacuuccgccagcgcgucucccucacccgcgaccgcgaccucuucaccgcccacauggacauccgcggccucacccaggacgacaccgccaccuacuucugcgcccgccagaaguucgccucccgcuacuccggcgaccagggcuccuacuucgaccucuggggccgcggcacccucaucgucgucuccuccgccuccaccaagggccccuccgucuuccccaccaucugcguc

SEQ ID NO: 19091 - RNA, 426 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgccucccucgacuuccgcaaccgcaucucccucucccgcgaccgcgaccucuccaccgcccacauggacauccgcggccucacccaggacgacaccgccaccuacuucugcgcccgccagaaguucgccucccgcuacuccggcgaccagggcuccuacuucgaccucuggggccgcggcacccucaucaucgucuccuccgccuccaccaagggccaccgcuccucccccaccaucugcguc

SEQ ID NO: 19092 - RNA, 423 nt, Artificial Sequence
  derived and/or modified sequence opt2 from anti-HIV-1_HeavyChain
caggucuacauggagcaggccggcgccggcaugaagaagcccggcgccuccaugaccgucuccugcaagaccgccgacgaggacgucuucgacgccgccuacaugcacuggguccgccaggcccccggccagaccuucgaguggcucggcuggaugaagcccgucaccggcgccgucaacuacgcccgcaaguuccagggccgcgucuccuucuaccgcacccgcgagcucggcaucgccuacauggaccuccgcaaccuccgcuucgacgacaccgccgucuacuucugcgcccgcaagaccgccggcgacgucuccggcgacaagcgcggcuucuucuucgaccucuggggccgcggcucccgcgucaucgucuccuccgccuccaccaagggccccuccgucuuccccaccaucuacguc

SEQ ID NO: 19093 - RNA, 423 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgacaccaccgagcucuacuggguccgccaggcccccggccagggccucgaguggaucggcugggucaagaucgucuccggcaccgucaacuucgccucccucgacuuccgcaaccgcaucucccucucccgcgaccgcgaccucuccaccgccuacauggacauccgcggccucacccaggacgacaccgccaccuacuucugcgcccgccagaaguucgccucccgcuacuccggcgaccagggcuccuacuucgaccucuggggccgcggcacccucaucgucgucuccuccgccuccaccaagggccccuccgucuucccccacgaccuccgc

SEQ ID NO: 19094 - RNA, 423 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgcccgccaguuccagggccgcgucuccuucuaccgcacccgcgagcucggcaucgccuacauggaccuccgcgaccucaaguucgacgacaccgccgucuacuucugcgcccgcaagaccaagggcgacgucuccggcgacgaccgcggcuucuucuucgaccucuggggccgcggcacccgcgucaucgucuccuccgccuccaccaagggccccuccgucuucccccacgaccccgcc

SEQ ID NO: 19095 - RNA, 426 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccuccgccuccaccaagggccccuccgucuuccccaccaucugcguc

SEQ ID NO: 19096 - RNA, 426 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcuccgagcucauccacuggguccgccaggcccccggccagggccucgaguggaucggcugggucaagaccgucaccggcgccgucaacuucggcucccccaacuuccgccagcgcgucucccucacccgcgaccgcgaccucuccaccgcccacauggacauccgcggccucacccaggacgacaccgccaccuacuucugcgcccgccagaaguucgagucccucuacuccgacgaccagggcuccuacuucgaccucuggggccgcggcacccucaucaucgucuccuccgccuccaccaagggccccuccgucuuccccaccaucugcguc

SEQ ID NO: 19097 - RNA, 426 nt, Artificial Sequence
  derived and/or modified sequence opt2 from anti-HIV-1_HeavyChain
caggcccaccucgagcaguccgccuccggcgucaagcgccccggcgccuccguccgcgucuccugcuggaccuccgaggacaucuucgagcgcaccgagcucaucuacuggguccgccaggcccccggccagggccucgaguggaucggcugggucaagaccgucuccggcgccgucaacuucggcucccaggacuuccgcgaccgcuucucccucacccgcgaccgcgaccucuucaccgcccacauggacauccgcggccucacccagggcgacaccgccaccuacuucugcgcccgccagaaguucgccucccgcuacuccggcgaccagggcuccuacuucgaccucuggggccgcggcacccucaucgucgucuccuccgccuccaccaagggccccuccgucuuccccaccaucugcguc

SEQ ID NO: 19098 - RNA, 426 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuucaccgcccacauggacauccgcggccucacccaggacgacaccgccaccuacuucugcgcccgccagaaguucgagucccgcuacaccggcggccagggcugguacuucgaccucuggggccgcggcacccacaucgucgucuccuccgccuccaccaagggccccuccgucuuccccaccaucugcguc

SEQ ID NO: 19099 - RNA, 423 nt, Artificial Sequence
  derived and/or modified sequence opt2 from anti-HIV-1_HeavyChain
cagguccacauggagcaggccggcggcggcaugaagaagcccggcgccuccaugaccgucuccugcaagaccgccgacgaggacaucuucgacgccgccuacaugcacuggguccgccaggcccccggccagaccuucgaguggcucggcuggaugaagcccgucaccggcgccgucaacuacgcccgccaguuccagggccgcgucuccuuccuccaggaccagggcauccgcaucgccuacauggaccuccgcgaccucaaguucgacgacaccgccgucuacuucugcgcccgcaagaccaagggcgacgucuccggcgacgaccgcggcuucuucuucgaccucuggggccgcggcacccgcgucaucgucuccuccucccuccaccagggccccaucggccuccccccccgcuccgcc

SEQ ID NO: 19100 - RNA, 426 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcuccuccgacuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccuccgccuccaccaagggccccuccgucuuccccaccaucuacguc

SEQ ID NO: 19101 - RNA, 426 nt, Artificial Sequence
  derived and/or modified sequence opt2 from anti-HIV-1_HeavyChain
caggucuacauggagcaggccggcggcggcgucaagaagcccggcgccuccgucacccucuccugcaagaccgccgacgaggacgucuucgacgccgccuacaugcacuggguccgccaggcccccggccagaccuucgaguggcucggcuggaugaagcccgucaccggcgccgucaacuacgcccgcaacuuccagggccgcgucuccuucuaccgcacccgcgagcucggcaucgccuacauggaccuccgcaaccuccgcuucgacgacaccgccgucuacuucugcgcccgcaagaccaagggcgacgucuccggcgacgaccgcggcuucuucuucgaccucuggggccgcggcacccgcgucaucgucuccuccggccuccaccagcgcgcccaccgcuccucccccaccaucugcguc

SEQ ID NO: 19102 - RNA, 426 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgccucccucgacuuccgcaaccgcaucucccucucccgcgaccgcgaccucuccaccgccuacauggacauccgcggccucacccaggacgacaccgccaccuacuucugcgcccgccagaaguucgccucccgcuacuccggcgaccagggcuccuacuucgaccucuggggccgcggcacccucaucgucgucuccuccgccuccaccaagggccccuccgucuuccccaccaucugcguc

SEQ ID NO: 19103 - RNA, 423 nt, Artificial Sequence
  derived and/or modified sequence opt2 from anti-HIV-1_HeavyChain
caggucuacauggagcaggccggcgucggcgucaagaagcccggcgccuccgucacccucuccugcaagaccgccgacgaggacgucuucgacgccgccuacaugcacuggguccgccaggcccccggccccgaccucgaguggcucggcuggaugaagcccgucaccggcgccgucaacuacgcccgcaaguuccagggccgcgucuccuucuaccgcacccgcgagcucggcaucgccuacauggaccuccgcaaccuccgcuucgacgacaccgccgucuacuucugcgcccgcaagaccgccggcgacgucuccggcgacaagcgcggcuucuucuucgaccucuggggccgcggcucccgcgucaucgucuccuccgccuccaccaagggccccuccgucuuccccaccaucugcguc

SEQ ID NO: 19104 - RNA, 426 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgccucccucgacuuccgcaaccgcaucucccucucccgcgaccgcgaccucuccaccgcccacauggacauccgcggccucacccaggacgacaccgccaccuacuucugcgcccgccagaaguucgccucccgcuacuccggcgaccagggcuccuacuucgaccucuggggccgcggcacccucaucaucgucuccuccgccuccaccaagggccccuccgucuucccccacgaccuccgc

SEQ ID NO: 19105 - RNA, 426 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgagcgcaccgagcucauccacuggguccgccaggcccccggccagggccucgaguggaucggcugggucaaggccgucaccggcgccgucaacuucggcucccucgacuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccuccgccuccaccaagggccccuccgucuucccccacgaccuccgc

SEQ ID NO: 19106 - RNA, 426 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgagcgcaucggcugggucaagaccgucaccggcgccgucaacuucggcucccucgacuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccuccgccuccaccaagggccccuccgucuuccccaccaucugcguc

SEQ ID NO: 19107 - RNA, 423 nt, Artificial Sequence
  derived and/or modified sequence opt2 from anti-HIV-1_HeavyChain
gaggucuacauggagcgcggccgcggcggcgucaagaagcccggcgccuccgccacccucuccugcaagaccgccgacgaggacgucuucgacgccgccuacaugcacuggguccgccaggcccccggccagaccuucgaguggcucggcuggaugaagcccgucaccggcgccgucuccuacgcccgcaaguuccagggccgcgucuccuucuacaugacccgcgagcucggcauggccuacauggaccuccgcaaccuccgcuucgacgacaccgccgucuacuucugcgcccgcaagaccgccggcgacgucuccggcgacaaccgcggcuacuucuucgaccucuggggccgcggcucccgcgucaucgucuccuccgccuccaccaagggccccuccgucuucccccacgaccuccgc

SEQ ID NO: 19108 - RNA, 426 nt, Artificial Sequence
  derived and/or modified sequence opt2 from anti-HIV-1_HeavyChain
caggcccaccucgagcaguccggcuccggcgucaagaagcccggcgccuccgcccgcgucuccugcugguccuccgaggacaucuucgagcgcaucgagcucauccacuggguccgccaggcccccggccagggccucgaguggaucggcugggucaagaccgucgccggcgccgucaacuucggcucccucgacuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccuccgccuccaccaagggccccuccgucuucccccacgaccuccgc

SEQ ID NO: 19109 - RNA, 426 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgccucccucgacuuccgcaaccgcaucucccucucccgcgaccgcgaccucuccaccgcccacauggacauccgcggccuccgccaggacgacaccgccaccuacuucugcgcccgccagaaguucgagucccgcuacuccggcgaccagggcuccuacuucgaccucuggggccgcggcacccucaucaucgucuccuccgccuccaccaagggccccuccgucuuccccaccaucuacguc

SEQ ID NO: 19110 - RNA, 426 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgccucccucgacuuccgcaacggcaucucccucucccgcgaccgcgaccucuccaccgccuacauggacauccgcggccucacccaggacgacaccgccaccuacuucugcgcccgccagaaguucgccucccgcuacuccggcgaccagggcuccuacuucgaccucuggggccgcggcacccucaucgucgucuccuccgccuccaccaagggccccuccgucuucccccacgaccuccgc

SEQ ID NO: 19111 - RNA, 426 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgccucccucgacuuccgcaaccgcaucucccucucccgcgaccgcgaccucuccaccgcccacauggacauccgcggccucacccaggacgacaccgccaccuacuucugcgcccgccagaaguucgccucccgcuacuccggcgaccagggcuccuacuucgaccucuggggccgcggcacccucaucgucgucuccuccgccuccaccaagggccccuccgucuucccccacgaccuccgc

SEQ ID NO: 19112 - RNA, 426 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccggcgacauccuccgcaaguccgagcucauccacuggguccgccaggcccccggccagggccucgaguggaucggcugggucaagaccgucaccggcgccgucaacuucggcucccucgacuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccuccgccuccaccaagggccccuccgucuucccccacgaccuccgc

SEQ ID NO: 19113 - RNA, 426 nt, Artificial Sequence
  derived and/or modified sequence opt2 from anti-HIV-1_HeavyChain
cagguccaccucgagcaguccggcuccggcgucaagaagcccggcgccuccguccgcgucuccugcugguccuccgaggacaucuucgagcgcaccgagcucauccacuggguccgccaggcccccggccagggccucgaguggaucggcugggucaagaccgucaccggcgccgucaacuucggcucccucgacuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccuccgccugcaccaagggccccuccgucuucccccacgaccuccgc

SEQ ID NO: 19114 - RNA, 426 nt, Artificial Sequence
  derived and/or modified sequence opt2 from anti-HIV-1_HeavyChain
caggcccaccucgagcaguccugguccggcgucaagaagcccggcgccuccguccgcgucuccugcugguccuccgaggacaucuucgagcgcaccgagcucauccacuggguccgccaggcccccggccagggccucgaguggaucggcugggucaagaccgucaccggcgccgucaacuucggcucccucgacuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccuccgccuccaccaagggccccuccgucuucccccacgaccuccgc

SEQ ID NO: 19115 - RNA, 426 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgagcgcaccgagcucaucuacuggguccgccaggcccccggccgcggccccgaguggaucggcugggucaagaccgucuccggcaccgucaacuucggcuccuccgacuuccgcaaccgcaucucccucacccgcgaccgcgaccucuccaccgcccacauggacauccgcggccucacccaggacgacaccgccaccuacuucugcgcccgccagaaguucgagucccucuacuccgacgaccagggcuccuacuucgaccucuggggccgcggcacccucaucaucgucuccuccgccuccaccaagggccccuccgucuucccccacgaccuccgc

SEQ ID NO: 19116 - RNA, 426 nt, Artificial Sequence
  derived and/or modified sequence opt2 from anti-HIV-1_HeavyChain
caggcccaccucgagcaguccggcuccggcgucaagaagcccggcgccuccguccgcgucuccugcugguccuccgaggacaucuucgagcgcaccgagcucauccacuggguccgccaggcccccggccagggccucgaguggaucggcugggucaagaccgucaccggcgccgucaacuucggcucccucgacuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccuccgccuccaccaagggccccuccgucuuccccaccauccuccgc

SEQ ID NO: 19117 - RNA, 426 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgagcgcaccgagcucaucuacuggguccgccaggcccccggccgcggccucgaguggaucggcugggucaagaccgucuccggcaccgucaacuucggcuccuccgacuuccgcaaccgcaucucccucacccgcgaccgcgaccucuccaccgcccacauggacauccgcggccucacccaggacgacaccgccaccuacuucugcgcccgccagaaguucgagucccucuacuccgacgaccagggcuccuacuucgaccucuggggccgcggcacccucaucgccgucuccuccgccuccaccaagggccccuccgucuucccccacgaccuccgc

SEQ ID NO: 19118 - RNA, 426 nt, Artificial Sequence
  derived and/or modified sequence opt2 from anti-HIV-1_HeavyChain
cagucccaccucaagcaguccggcuccgccaugaagaagcccggcgccuccguccgcgucuccugcuggaccuccgaggacaucuucgagcgcaccgagcucaucuacuggguccgccaggcccccggccgcggccucgaguggaucggcugggucaagaccgucuccggcaccgucaacuucggcuccuccgacuuccgcaaccgcaucucccucacccgcgaccgcgaccucuccaccgcccacauggacauccgcggccucacccaggacgacaccgccaccuacuucugcgcccgccagaaguucgagucccucuacuccgacgaccagggcuccuacuucgaccucuggggccgcggcacccucaucaucgucuccuccgccuccaccaagggccccuccgucuucccccacgaccuccgc

SEQ ID NO: 19119 - RNA, 426 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgagcgcaccgagcucauccacuggguccgccaggcccccggccagggccucgaguggaucgagugggucaaggccgucuccggcgccgucaacuacggcucccucgacuuccgccaccgcgucucccucacccgcgaccgcgaccucuucaccgcccacauggacauccgcggccucacccaggacgacaccgccaccuacuucugcgcccgccagaaguucgagucccgcuacaccggcggccagggcugguacuucgaccucuggggccgcggcacccacaucgucgucuccuccgccuccaccaagggccccuccgucuucccccacgaccuccgc

SEQ ID NO: 19120 - RNA, 426 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgccucccucgacuuccgcaaccgcaucucccucucccgcgaccgcgaccucuccaccgcccacauggacauccgcggccucacccaggacgacaccgccaccuacuucugcgcccgccagaaguucgagucccgcuacuccggcgaccagggcuccuacuucgaccucuggggccgcggcacccucaucaucgucuccuccgccuccaccaagggccccuccgucuucccccacgaccuccgc

SEQ ID NO: 19121 - RNA, 426 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcucccucgacuuccgcaaccgcaucucccucucccgcgaccgcgaccucuccaccgccuacauggacauccgcggccucacccaggacgacaccgccaccuacuucugcgcccgccagaaguucgccucccgcuacuccggcgaccagggcuccuacuucgaccucuggggccgcggcacccucaucgucgucuccuccgccuccaccaagggccccuccgucuucccccacgaccuccgc

SEQ ID NO: 19122 - RNA, 426 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcuccgagcucauccacuggguccgccaggcccccggccagggccucgaguggaucggcugggucaagaccgucaccggcgccgucaacuucggcucccccaacuuccgccagcgcgucucccucucccgcgaccgcgaccucuccaccgcccacauggacauccgcggccucacccaggacgacaccgccaccuacuucugcgcccgccagaaguucgccucccgcuacuccggcgaccagggcuccuacuucgaccucuggggccgcggcacccucaucaucgucuccuccgccuccaccaagggccccuccgucuucccccacgaccuccgc

SEQ ID NO: 19123 - RNA, 426 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgagcgcaccgagcucaucuacuggguccgccaggcccccggccgcggccucgaguggaucggcugggucaagaccgucuccggcaccgucaacuucggcuccuccgacuuccgcaaccgcaucucccucacccgcgaccgcgaccucuccaccgcccacauggacauccgcggccucacccaggacgacaccgccaccuacuucugcgcccgccagaaguucgagucccucuacuccgacgaccagggcuccuacuucgaccucuggggccgcggcacccucaucaucgucuccuccgccuccaccaagggccccuccgucuucccccacgaccuccgc

SEQ ID NO: 19124 - RNA, 426 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccgcggccucgaguggaucggcugggucaagaccgucuccggcaccgucaacuucggcuccuccgacuuccgcaaccgcaucucccucacccgcgaccgcgaccucuccaccgcccacauggacauccgcggccucacccaggacgacaccgccaccuacuucugcgcccgccagaaguucgagucccucuacuccgacgaccagggcuccuacuucgaccucuggggccgcggcacccucaucaucgucuccuccgccuccaccaagggccccuccgucuucccccacgaccuccgc

SEQ ID NO: 19125 - RNA, 426 nt, Artificial Sequence
  derived and/or modified sequence opt2 from anti-HIV-1_HeavyChain
cagguccaccucgagcaguccggcuccggcgucaagaagcccggcgccuccguccgcgucuccugcugguccuccgaggacaucuucgagcgcaccgagcucauccacuggguccgccaggcccccggccagggccucgaguggaucggcugggucaagaccgucaccggcgccgucaacuucggcucccucgacuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccuccgccuccaccaagggccccuccgucuucccccacgaccuccgc

SEQ ID NO: 19126 - RNA, 426 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgccucccucgacuuccgcaaccgcaucucccucucccgcgaccgcgaccucuccaccgcccacauggacauccgcggccuccgccaggacgacaccgccaccuacuucugcgcccgccagaaguucgagucccgcuacuccggcgaccagggcuccuacuucgaccucuggggccgcggcacccucaucaucgucuccuccgccuccaccaagggccccuccgucuucccccacgaccuccgc

SEQ ID NO: 19127 - RNA, 423 nt, Artificial Sequence
  derived and/or modified sequence opt2 from anti-HIV-1_HeavyChain
caggucuacauggagcaggccggcgccggcgucaagaagcccggcgccuccgucacccucuccugcaagaccgccgacgaggacgucuucgacgccgccuacaugcacuggguccgccaggcccccggccagaccuucgaguggcucggcuggaugaagcccgucaccggcgccgucuccuacgcccgcaaguuccagggccgcgucuccuucuacaugacccgcgagcucggcgucgccuacauggaccuccgcaaccuccgcuucgacgacaccgccgucuacuucugcgcccgcaagaccgccggcgacgucuccggcgacaaccgcggcuacuucuucgaccucuggggccgcggcucccgcgucaucgucuccuccgccuccaccaagggccccuccgucuucccccacgaccuccgc

SEQ ID NO: 19128 - RNA, 426 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgccucccucgacuuccgcaaccgcaucucccucucccgcgaccgcaaccucuccaccgcccacauggacauccgcggccuccgccaggacgacaccgccaccuacuucugcgcccgccagaaguucgagucccgcuacuccggcgaccagggcuccuacuucgaccucuggggccgcggcacccucaucaucgucuccuccgccuccaccaagggccccuccgucuucccccacgaccuccgc

SEQ ID NO: 19129 - RNA, 423 nt, Artificial Sequence
  derived and/or modified sequence opt2 from anti-HIV-1_HeavyChain
cagguccagcucguccaguccggcgccgaggucaagaagcccggcgccuccgucacccucuccugcaagaccgccgacgaggacgucuucgacgccgccuacaugcacuggguccgccaggcccccggccagaccuucgaguggcucggcuggaugaagcccgucaccggcgccgucuccuacgcccgcaaguuccagggccgcgucuccuucuacaugacccgcgagcucggcauggccuacauggaccuccgcaaccuccgcuucgacgacaccgccgucuacuucugcgcccgcaagaccgccggcgacgucuccggcgacaaccgcggcuacuucuucgaccucuggggccgcggcucccgcgucaucgucuccuccgccuccaccaagggccccuccgucuuccccaccaucuacguc

SEQ ID NO: 19130 - RNA, 426 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucguccacuggguccgccaggcccccggccagggccucgaguggaucggcugggucaagaccgucaccggcgccgucaacuucggcucccccaacuuccgccagcgcgucucccucacccgcgaccgcgaccucuucaccgcccacauggacauccgcggccucacccaggacgacaccgccaccuacuucugcgcccgccagaaguucgccucccgcuacuccggcgaccagggcuccuacuucgaccucuggggccgcggcacccucaucgucgucuccuccgccuccaccaagggccccuccgucuucccccacgaccuccgc

SEQ ID NO: 19131 - RNA, 426 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgccucccucgacuuccgcaaccgcaucucccucucccgcgaccgcgaccucuccaccgccuacauggacauccgcggccucacccaggacgacaccgccaccuacuucugcgcccgccagaaguucgccucccgcuacuccggcgaccagggcuccuacuucgaccucuggggccgcggcacccucaucaucgucuccuccgccuccaccaagggcccccucggccucccccacgaccuccgc

SEQ ID NO: 19132 - RNA, 426 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuccaccgcccacauggacauccgcggccucacccaggacgacaccgccaccuacuucugcgcccgccagaaguucgccucccgcuacuccggcgaccagggcuccuacuucgaccucuggggccgcggcacccucaucgucgucuccuccgccuccaccaagggccccuccgucuucccccacgaccuccgc

SEQ ID NO: 19133 - RNA, 426 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucaucuacuggguccgccaggcccccggccagggccucgaguggaucggcugggucaagaucgucuccggcaccgucaacuucgccucccucgacuuccgcaaccgcaucucccucucccgcgaccgcgaccucuccaccgcccacauggacauccgcggccucacccaggacgacaccgccaccuacuucugcgcccgccagaaguucgccucccgcuacuccggcgaccagggcuccuacuucgaccucuggggccgcggcacccucaucaucgucuccuccgccuccaccaagggccccuccgucuucccccacgaccuccgc

SEQ ID NO: 19134 - RNA, 426 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgcaaccgcaucucccucacccgcgaccgcgaccucuccaccgcccacauggacauccgcggccucacccaggacgacaccgccaccuacuucugcgcccgccagaaguucgagucccucuacuccgacgaccagggcuccuacuucgaccucuggggccgcggcacccucaucaucgucuccuccgccuccaccaagggccccuccgucuucccccacgaccuccgc

SEQ ID NO: 19135 - RNA, 426 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucgagucccucuacuccgacgaccagggcuccuacuucgaccucuggggccgcggcacccucaucaucgucuccuccgccuccaccaagggccccuccgucuucccccacgaccuccgc

SEQ ID NO: 19136 - RNA, 426 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcuccuccgacuuccgcaaccgcaucucccucacccgcgaccgcgaccucuccaccgcccacauggacauccgcggccucacccaggacgacaccgccaccuacuucugcgcccgccagaaguucgagucccucuacuccgacgaccagggcuccuacuucgaccucuggggccgcggcacccucaucaucgucuccuccgccuccaccaagggccccuccgucuucccccacgaccuccgc

SEQ ID NO: 19137 - RNA, 426 nt, Artificial Sequence
  derived and/or modified sequence opt2 from anti-HIV-1_HeavyChain
cagucccaccucgagcaguccggcuccgccaugaagaagcccggcgccuccgcccgcgucuccugcuggaccuccgaggacaucuucgacaccaccgagcucaucuacuggguccgccaggcccccggccagggccucgaguggaucggcugggucaagaucgucuccggcaccgucaacuucgccucccucgacuuccgcaaccgcaucucccucucccgcgaccgcgaccucuccaccgcccacauggacauccgcggccucacccaggacgacaccgccaccuacuucugcgcccgccagaaguucgccucccgcuacuccggcgaccagggcuccuacuucgaccucuggggccgcggcacccacaucgucgucuccuccgccuccaccaagggccccuccgucuucccccacgaccuccgc

SEQ ID NO: 19138 - RNA, 426 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuucaccgcccacauggacauccgcggccucacccaggacgacaccgccaccuacuucugcgcccgccagaaguucgagucccgcuacaccggcggccagggcugguacuucgaccucuggggccgcggcacccacaucgucgucuccuccgccuccaccaagggccccuccgucuucccccacgaccuccgc

SEQ ID NO: 19139 - RNA, 426 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuccaccgcccacauggacauccgcggccucacccaggacgacaccgccaccuacuucugcgcccgccagaaguucgagucccgcuacaccggcggccagggcugguacuucgaccucuggggccgcggcacccacaucgucgucuccuccgccuccaccaagggccccuccgucuucccccacgaccuccgc

SEQ ID NO: 19140 - RNA, 426 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgagcgcaccgagcucaucuacuggguccgccaggcccccggccgcggccucgaguggaucggcugggucaagaccgucuccggcaccgucaacuucggcuccuccgacuuccgcaaccgcaucucccucacccgcgaccgcgaccucuccaccgcccacauggacauccgcggccucacccaggacgacaccgccaccuacuucugcgcccgccagaaguucgccucccgcuacuccggcgaccagggcuccuacuucgaccucuggggccgcggcacccucaucaucgucuccuccgccuccaccaagggccccuccgucuucccccacgaccuccgc

SEQ ID NO: 19141 - RNA, 426 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgagcgcaccgagcucaucuacuggguccgccaggcccccggccgcggccucgaguggaucggcugggucaagaccgucuccggcaccgucaacuucggcuccuccgacuuccgcaaccgcaucucccucacccgcgaccgcgaccucuccaccgcccgcauggacauccgcggccucacccaggacgacaccgccaccuacuucugcgcccgccagaaguucgagucccucuacuccgacgaccagggcuccuacuucgaccucuggggccgcggcacccucaucaucgucuccuccgccuccaccaagggccccuccgucuuccccaccgaccuccgc

SEQ ID NO: 19142 - RNA, 426 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccaggacgacaccgccaccuacuucugcgcccgccagaaguucgccucccgcuacuccggcgaccagggcuccuacuucgaccucuggggccgcggcacccucaucgucgucuccuccgccuccaccaagggccccuccgucuucccccacgaccuccgc

SEQ ID NO: 19143 - RNA, 426 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgagcgcaccgagcucaucuacuggguccgccaggcccccggccgcggccucgaguggaucggcugggucaagaccgucuccggcaccgucaacuucggcuccuccgacuuccgcaaccgcaucucccucacccgcgaccgcgaccucuccaccgcccacauggacauccgcggccucacccaggacgacaccgccaccuacuucugcgcccgccagaaguucgagucccucuacuccgacgaccagggcuccuacuucgaccucuggggccgcggcacccucaucaucgucuccuccgccuccaccaacggccccaucggccucccccacgaccuccgc

SEQ ID NO: 19144 - RNA, 426 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccuccgccuccaccaagggccccuccgucuucccccacgaccuccgc

SEQ ID NO: 19145 - RNA, 426 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccaggacgacaccgccaccuacuucugcgcccgccagaaguucgccucccgcuacuccggcgaccagggcuccuacuucgaccucuggggccgcggcacccucaucgucgucuccuccgccuccaccaagggccccuccgucuucccccacgaccuccgc

SEQ ID NO: 19146 - RNA, 426 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgagcgcaccggccucaucuacuggguccgccaggcccccggccgcggccucgaguggaucggcugggucaagaccgucuccggcaccgucaacuucggcuccuccgacuuccgcaaccgcaucucccucacccgcgaccgcgaccucuccaccgcccacauggacauccgcggccucacccaggacgacaccgccaccuacuucugcgcccgccagaaguucgagucccucuacuccgacgaccagggcuccuacuucgaccucuggggccgcggcacccucaucaucgucuccuccgccuccaccaagggccccuccgucuucccccacgaccuccgc

SEQ ID NO: 19147 - RNA, 426 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccagaucuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccuccgccuccaccaagggccccuccgucuucccccacgaccuccgc

SEQ ID NO: 19148 - RNA, 426 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgacaccaccgagcucauccacuggguccgccaggcccccggccagggccucgaguggaucggcugggucaagaccgucaccggcgccgucaacuucggcucccucgacuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccuccgccuccaccaagggccccuccgucuucccccacgaccuccgc

SEQ ID NO: 19149 - RNA, 426 nt, Artificial Sequence
  derived and/or modified sequence opt2 from anti-HIV-1_HeavyChain
cagucccaccucgagcaguccggcuccgaggucaagaagcccggcgccuccguccgcgucuccugcuggaccuccgaggacaucuucgagcgcaccgagcucaucuacuggguccgccaggcccccggccgcggccucgaguggaucggcugggucaagaccgucuccggcaccgucaacuucggcuccuccgacuuccgcaaccgcaucucccucacccgcgaccgcgaccucuccaccgcccacauggacauccgcggccucacccaggacgacaccgccaccuacuucugcgcccgccagaaguucgagucccucuacuccgacgaccagggcuccuacuucgaccucuggggccgcggcacccucaucaucgucuccuccgccuccaccaagggccccuccgucuucccccacgaccuccgc

SEQ ID NO: 19150 - RNA, 423 nt, Artificial Sequence
  derived and/or modified sequence opt2 from anti-HIV-1_HeavyChain
caggucuacauggagcaggccggcggcggcgucaagaagcccggcgccuccgucacccucuccugcaagaccgccgacgaggacaucuucgacgccgccuacaugcacuggguccgccaggcccccggccagaccuucgaguggcucggcuggaugaagcccgucaccggcgccgucaacuacgcccgccaguuccagggccgcgucuccuucuaccgcacccgcgagcucggcaucgccuacauggaccuccgcgaccucaaguucgacgacaccgccgucuacuucugcgcccgcaagaccaagggcgacgucuccggcgacgaccgcggcuucuucuucgaccucuggggccgcggcacccgcgucaucgucuccuccgccuccaccaagggccccuccgucuucccccacgaccuccgc

SEQ ID NO: 19151 - RNA, 426 nt, Artificial Sequence
  derived and/or modified sequence opt2 from anti-HIV-1_HeavyChain
cagucccaccucgagcaguccggcuccgaggucaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgccucccucgacuuccgcaaccgcaucucccucucccgcgaccgcgaccucuccaccgcccacauggacauccgcggccucacccaggacgacaccgccaccuacuucugcgcccgccagaaguucgccucccgcuacuccggcgaccagggcuccuacuucgaccucuggggccgcggcacccucaucaucgucuccuccgccuccaccaagggccccuccgucuucccccacgaccuccgc

SEQ ID NO: 19152 - RNA, 426 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucuccggcgccgucaacuucggcucccccaacuuccgccaccgcgucucccucucccgcgaccgcgaccucuccaccgccuacauggacauccgcggccucacccaggacgacaccgccaccuacuucugcgcccgccagaaguucgccucccgcuacuccggcgaccagggcuccuacuucgaccucuggggccgcggcacccucaucgucgucuccuccgccuccaccaagggccccuccgucuucccccacgaccuccgc

SEQ ID NO: 19153 - RNA, 426 nt, Artificial Sequence
  derived and/or modified sequence opt2 from anti-HIV-1_HeavyChain
caggcccaccucgagcaguccggcuccggcgucaagaagcccggcgccuccguccgcgucuccugcugguccuccgaggacaucuucgagcgcaccgagcucauccacuggguccgccaggcccccggccagggccucgaguggaucggcugggucaagaccgucaccggcgccgucaacuucggcucccucgacuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccuccgccuccgccaagggccccuccgucuucccccacgaccuccgc

SEQ ID NO: 19154 - RNA, 426 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgagcgcaccgagcucaucuacuggguccgccaggcccccggccgcggccucgaguggaucggcugggucaagaccgucuccggcaccgucaacuucggcuccuccgacuuccgcaaccgcaucucccucacccgcgaccgcgaccucuccaccgcccacauggacauccgcggccucacccaggacgacaccgccaccuacuucugcgcccgccagaaguucgagucccucuacuccgacgaccagggcuccuacuucgaccucuggggccgcggcacccucaucgucgucuccuccgccuccaccaagggccccuccgucuuccccccccgcuccgcc

SEQ ID NO: 19155 - RNA, 426 nt, Artificial Sequence
  derived and/or modified sequence opt2 from anti-HIV-1_HeavyChain
cagguccacauggagcaggccggcggcggcgucaagaagcccggcgccuccgucacccucuccugcaagaccgccgacgaggacgucuucgacgccgccuacaugcacuggguccgccaggcccccggccagaccuucgaguggcucggcuggaugaagcccgucaccggcgccgucaacuacgcccgcaaguuccagggccgcgucuccuucuaccgcacccgcgagcucggcaucgccuacauggaccuccgcaaccuccgcuucgacgacaccgccgucuacuucugcgcccgcaagaccaagggcgacgucuccggcgacgaccgcggcuucuucuucgaccucuggggccgcggcacccgcgucaucgucuccuccgccuccaccaagggcccccuccgcuccuucccccgccgcuccgcc

SEQ ID NO: 19156 - RNA, 426 nt, Artificial Sequence
  derived and/or modified sequence opt2 from anti-HIV-1_HeavyChain
caggcccaccucgagcaguccggcuccggcgucaagaagcccggcgccuccguccgcgucuccugcugguccuccgaggacaucuucgagcgcaccgagcucauccacuggguccgccaggcccccggccagggccucgaguggaucggcugggucaagaccgucaccggcgccgucaacuucggcucccucgacuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccuccgccuccaccaagggccccuccgucuuccccaccaucuacguc

SEQ ID NO: 19157 - RNA, 426 nt, Artificial Sequence
  derived and/or modified sequence opt2 from anti-HIV-1_HeavyChain
gagucccaccucgagcaguccggcuccgccaugaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgccucccucgacuuccgcaaccgcaucucccucucccgcgaccgcgaccucuccaccgcccacauggacauccgcggccucacccaggacgacaccgccaccuacuucugcgcccgccagaaguucgccucccgcuacuccggcgaccagggcuccuacuucgaccucuggggccgcggcacccucaucaucgucuccuccgccuccaccaagggccccuccgucuucccccacgaccuccgc

SEQ ID NO: 19158 - RNA, 429 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaucgucuccggcgccgucaacuucggcucccccaacuuccgccagcgcgucucccucacccgcgaccgcgaccucuucaccgcccacauggacauccgcggccucacccaggacgacaccgccaccuacuucugcgcccgccagaaguucgccucccgcuacuccggcgaccagggcuccuacuucgaccucuggggccgcggcacccucaucgucgucuccuccgccuccaccaagggccccuccggccuccccccccgcuccugcguc

SEQ ID NO: 19159 - RNA, 423 nt, Artificial Sequence
  derived and/or modified sequence opt2 from anti-HIV-1_HeavyChain
cagguccaccucguccaguccggcgccgaggucaagaagcccggcgccuccgucaaggucuccugcaaggccuccggcuacaccuucaccaccuccggcauccacuggcuccgccagguccccggccagcgccccgaguggaugggcuggauccgccccaagaccggcgcccgcaaccaggcccgccaguuccagccccgcaucucccucacccgcgaccgcgcccucuccaccgccuaccucgaccucaacucccucaccuccgccgacuccggcaccuacuucugcgcccgccagaccuucaagcccgacuucuacuucgccgaccagggcugguccuucaaccucuggggccgcggcgcccacuucaucgucuccuccgccuccaccaagggccccuccgucuucccccacgaccuccgc

SEQ ID NO: 19160 - RNA, 429 nt, Artificial Sequence
  derived and/or modified sequence opt2 from anti-HIV-1_HeavyChain
caggcccaccucgagcaguccggcuccggcgucaagaagcccggcgccuccguccgcgucuccugcugguccuccgaggacaucuucgagcgcaccgagcucauccacuggguccgccaggcccccggccagggccucgaguggaucggcugggucaagaccgucaccggcgccgucaacuucggcucccucgacuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccuccgccuccacccagggccccaucggccuccccccccgccucugcguc

SEQ ID NO: 19161 - RNA, 426 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgccucccucgacuuccgcaaccgcaucucccucucccgcgaccgcgaccucuccaccgcccacauggacauccgcggccucacccaggacgacaccgccaccuacuucugcgcccgccagaaguucgccucccgcuacuccggcgaccagggcuccuacuucgaccucuggggccgcggcacccucaucaucgucuccuccgccuccaccaagggccccaucggccuccccccccgcuccacc

SEQ ID NO: 19162 - RNA, 426 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcucccucgacuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccuccgccuccaccaagggccccuccgucuuccccaccaucugcguc

SEQ ID NO: 19163 - RNA, 426 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccuccgcccuccaccagggccccaucggccuccccccccgcuccacc

SEQ ID NO: 19164 - RNA, 429 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgccucccucgacuuccgcaaccgcgucucccucucccgcgaccgcgaccucuccaccgccuacauggacauccgcggccucacccaggacgacaccgccaccuacuucugcgcccgccagaaguucgccucccgcuacuccggcgaccagggcuccuacuucgaccucuggggccgcggcacccucaucgucgucuccuccgcccuccaccagggccccaucggccccucccccaccauccuccgc

SEQ ID NO: 19165 - RNA, 426 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgccucccucgacuuccgcaaccgcaucucccucucccgcgaccgcgaccucuccaccgcccacauggacauccgcggccucacccaggacgacaccgccaccuacuucugcgcccgccagaaguucgccucccgcuacuccggcgaccagggcuccuacuucgaccucuggggccgcggcacccucaucaucgucuccuccgccuccaccaagggccccuccgucuuccccaccaucuacguc

SEQ ID NO: 19166 - RNA, 426 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgccucccucgacuuccgcaaccgcaucucccucucccgcgaccgcgaccucuccaccgccuacauggacauccgcggccucacccaggacgacaccgccaccuacuucugcgcccgccagaaguucgagucccgcuacaccggcggccagggcugguacuucgaccucuggggccgcggcacccacaucgucgucuccuccgccuccaccaagggccccuccgucuuccccaccaucugcguc

SEQ ID NO: 19167 - RNA, 426 nt, Artificial Sequence
  derived and/or modified sequence opt2 from anti-HIV-1_HeavyChain
cagguccagcucguccaguccggcgccgaggucaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgccucccucgacuuccgcaaccgcaucucccucucccgcgaccgcgaccucuccaccgcccacauggacauccgcggccucacccaggacgacaccgccaccuacuucugcgcccgccagaaguucgagucccgcuacaccggcggccagggcugguacuucgaccucuggggccgcggcacccacaucgucgucuccuccgccuccaccaagggccccuccgucuuccccaccaucugcguc

SEQ ID NO: 19168 - RNA, 426 nt, Artificial Sequence
  derived and/or modified sequence opt2 from anti-HIV-1_HeavyChain
cgccgccaccucgagcaguccggcuccggcgucaagaagcccggcgccuccguccgcgucuccugcugguccuccgaggacaucuucgagcgcaccgagcucauccacuggguccgccaggcccccggccagggccucgaguggaucggcugggucaagaccgucaccggcgccgucaacuucggcucccucgacuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccuccgccuccaccaagggccccuccgucuucccccacgaccuccgc

SEQ ID NO: 19169 - RNA, 426 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgccucccucgacuuccgcaaccgcaucucccucucccgcgaccgcgaccucuccaccgccuacauggacauccgcggccucacccaggacgacaccgccaccuacuucugcgcccgccagaaguucgagucccgcuacuccggcgaccagggcuccuacuucgaccucuggggccgcggcacccucaucaucgucuccuccgccuccaccaagggccccuccgucuuccccaccaucugcguc

SEQ ID NO: 19170 - RNA, 429 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccucgacuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccuccgccuccaccaagggcccccaccccgucuucccccacgaccucccc

SEQ ID NO: 19171 - RNA, 426 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgagcgcaccgagcucaucuacuggguccgccaggcccccggccagggccucgaguggaucggcugggucaagaucgucuccggcaccgucaacuucgccucccucgacuuccgcaaccgcaucucccucucccgcgaccgcgaccucuccaccgccuacauggacauccgcggccucacccaggacgacaccgccaccuacuucugcgcccgccagaaguucgccucccgcuacuccggcgaccagggcuccuacuucgaccucuggggccgcggcacccucaucgucgucuccuccgccuccaccaagggccccuccgucuuccccaccaucuacguc

SEQ ID NO: 19172 - RNA, 429 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacugggcccgccaggcccccggccagggccucgaguggaucggcugggucaagaccgucaccggcgccgucaacuucggcucccucgacuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccuccgccuccaccaagggcccccucggccuccccccccgccucucccgc

SEQ ID NO: 19173 - RNA, 426 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgccucccucgacuuccgcaaccgcaucucccucucccgcgaccgcgaccucuccaccgcccacauggacauccgcggccucacccaggacgacaccgccaccuacuucugcgcccgccagaaguucgccucccgcuacuccggcgaccagggcuccuacuucgaccucuggggccgcggcacccucaucaucgucuccuccgccuccaccaagggccccuccggccuccccccccgcuccgcc

SEQ ID NO: 19174 - RNA, 426 nt, Artificial Sequence
  derived and/or modified sequence opt2 from anti-HIV-1_HeavyChain
cagguccagcucguccaguccggcgccgaggucaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgccucccucgacuuccgcaaccgcaucucccucucccgcgaccgcgaccucuccaccgcccacauggacauccgcggccuccgccaggacgacaccgccaccuacuucugcgcccgccagaaguucgagucccgcuacuccggcgaccagggcuccuacuucgaccucuggggccgcggcacccucaucaucgucuccuccgccuccaccaagggccccuccgucuucccccacgaccuccgc

SEQ ID NO: 19175 - RNA, 426 nt, Artificial Sequence
  derived and/or modified sequence opt2 from anti-HIV-1_HeavyChain
gaggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaucgucuccggcaccgucaacuucgccucccucgacuuccgcaaccgcaucucccucucccgcgaccgcgaccucuccaccgccuacauggacauccgcggccucacccaggacgacaccgccaccuacuucugcgcccgccagaaguucgccucccgcuacuccggcgaccagggcuccuacuucgaccucuggggccgcggcacccucaucgucgucuccuccgccuccaccaagggccccuccgucuucccccacgaccuccgc

SEQ ID NO: 19176 - RNA, 423 nt, Artificial Sequence
  derived and/or modified sequence opt2 from anti-HIV-1_HeavyChain
cagguccagcucguccaguccggcgccgaggucaagaagcccggcgccuccgucaaggucuccugccgcgccuccggcuacaccuucggcaaccacgccaucuccuggguccgccaggcccccggccagggccucgaguggaugggcuggauccgccccaagaccggcgcccgcaaccaggcccgccaguuccagccccgcaucucccucacccgcgaccgcgcccucuccaccgccuaccucgaccucaacucccucaccuccgccgacuccggcaccuacuucugcgcccgccagaccuucaagcccgacuucuacuucgccgaccagggcugguccuucaaccucuggggccgcggcgcccacuucaucgucuccuccgccuccaccaagggccccuccgucuucccccacgaccuccgc

SEQ ID NO: 19177 - RNA, 429 nt, Artificial Sequence
  derived and/or modified sequence opt2 from anti-HIV-1_HeavyChain
cagggccacaaccucgagcaguccggcuccgaggucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccucgacuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccuccgccuccaccaagggccccuccgucuucccccacgaccuccgc

SEQ ID NO: 19178 - RNA, 426 nt, Artificial Sequence
  derived and/or modified sequence opt2 from anti-HIV-1_HeavyChain
cccaccaccuggaacaaguccggcuccgacgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgccaccgcgucucccucacccgcgaccgcgaccucuccaccgcccacauggacauccgcggccucacccaggacgacaccgccaccuacuucugcgcccgccagaaguucgagucccucuacuccgacgaccagggcuccuacuucgaccucuggggccgcggcacccucaucaucgucuccuccgccuccaccaagggccccuccgucuucccccacgaccuccgc

SEQ ID NO: 19179 - RNA, 432 nt, Artificial Sequence
  derived and/or modified sequence opt2 from anti-HIV-1_HeavyChain
cacgucacccccuggaacgaguacgucggccgcgccaugaagaagcccggccgcuccguccgcgucuccugcuggaccuccgaggacaucuucgacaccaccgagcucaucuacuggguccgccaggcccccggccagggccucgaguggaucggcugggucaagaucgucuccggcaccgucaacuucgccucccucgacuuccgcaaccgcaucucccucucccgcgaccgcgaccucuccaccgccuacauggacauccgcggccucacccaggacgacaccgccaccuacuucugcgcccgccagaaguucgccucccgcuacuccggcgaccagggcuccuacuucgaccucuggggccgcggcacccucaucgucgucuccuccgccuccaccaagggccccuccgucuucccccacgaccuccgc

SEQ ID NO: 19180 - RNA, 372 nt, Artificial Sequence
  derived and/or modified sequence opt2 from anti-HIV-1_HeavyChain
cagguccagcucguccaguccggcgccgagguccgccgccccggcgccuccgucaaggucuccugcaaggccuccggcuucuccuuccucggccacuacauccacuggguccgccaggcccccggccagggccucgaguggaucggcugggucaaggccgucuccggcgccgucaacuacggcucccucgacuuccgccaccgcgucucccucacccgcgaccgcgaccucuccaccgcccacauggacauccgcggccucacccaggacgacaccgccaccuacuucugcgcccgccagaaguucgcccgcggcgaccagggcugguucuucgaccucuggggccgcggcacccucaucgucgucuccucc

SEQ ID NO: 19181 - RNA, 372 nt, Artificial Sequence
  derived and/or modified sequence opt2 from anti-HIV-1_HeavyChain
cagguccagcucguccaguccggcgccgaggucaagaagcccggcgccuccgucaaggucuccugcaaggccuccggcuacaccuucaccuccuacggcaucuccuggguccgccaggcccccggccagggccucgaguggaucggcugggucaagaucgucuccggcgccgucaacuucggcucccccaacuuccgccagcgcgucucccucacccgcgaccgcgaccucuucaccgcccacauggacauccgcggccucacccagggcgacaccgccaccuacuucugcgcccgccagaaguucgagcgcggcggccagggcuggaucuucgaccucuggggccgcggcacccucaucgccgucuccucc

SEQ ID NO: 19182 - RNA, 372 nt, Artificial Sequence
  derived and/or modified sequence opt2 from anti-HIV-1_HeavyChain
cagguccagcucguccaguccgaggccgaggucaagaagcccggcgccuccgucaagaucuccugcgccaccuccggcuacgccuucacccucuacuaccuccacuggguccgccaggcccccggccagggccucgaguggaucggcugggucaagaccgucaccggcgccgucaacuucggcuccgccuacuuccgccaccgcgucucccucacccgcgaccgcgaccucuucaccgcccacauggacauccgcggccucacccagggcgacaccgccaccuacuucugcgcccgccagaaguucuacaagggcggccagggcugguacuucgaccucuggggccgcggcacccucaucgucgucuccucc

SEQ ID NO: 19183 - RNA, 372 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucaagaccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccucc

SEQ ID NO: 19184 - RNA, 375 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgagcgcaccgagcucauccacuggguccgccaggcccccggccgcggccucgaguggaucggcugggucaaggccgucuccggcgccgucaacuacggcucccucgacuuccgccaccgcgucccccucacccgcgaccgcgaccucuucaccgcccacauggacauccgcggccucacccaggacgacaccgccaccuacuucugcgcccgccagaaguucgcccgcggcgaccagggcugguucuucgaccucuggggccgcggcacccucaucgucgucuccucc

SEQ ID NO: 19185 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggacccccgaggacaucuucgagcgcaccgagcucauccacuggguccgccaggcccccggccagggccucgaguggaucggcugggucaagaucgucuccggcgccgucaacuucggcucccccaacuuccgccagcgcgucucccucacccgcgaccgcgaccucuucaccgcccacauggacauccgcggccucacccagggcgacaccgccaccuacuucugcgcccgccagaaguucgagcgcggcggccagggcuggaucuucgaccucuggggccgcggcacccucaucgccgucuccucc

SEQ ID NO: 19186 - RNA, 375 nt, Artificial Sequence
  derived and/or modified sequence opt2 from anti-HIV-1_HeavyChain
caggcccaccucgagcaguccgccuccggcgucaagcgccccggcgccuccguccgcgucuccugcuggaccuccgaggacaucuucgagggcuccgagcucauccacuggguccgccaggcccccggccagggccucgaguggaucggcugggucaagaccgucaccggcgccgucaacuucggcuccgccuacuuccgccaccgcgucucccucacccgcgaccgcgaccucuucaccgcccacauggacauccgcggccucacccagggcgacaccgccaccuacuucugcgcccgccagaaguucuacaagggcggccagggcugguacuucgaccucuggggccgcggcacccucaucgucgucuccucc

SEQ ID NO: 19187 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucuccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccucc

SEQ ID NO: 19188 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcugguccuccgaggacaucuucgagcgcgccgagcucauccacuggguccgccaggcccccggccagggccucgaguggaucggcugggucaagaccgucaccggcgccgucaacuucggcucccccaacuuccgccagcgcgucucccucacccgcgaccgcgaccucuucaccgcccacauggacauccgcggccucacccagggcgacaccgccaccuacuucugcgcccgccagaaguucgagcgcggcggccagggcuggaucuucgaccucuggggccgcggcacccucaucgccgucuccucc

SEQ ID NO: 19189 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccucgacuuccgccaccgcaucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccucc

SEQ ID NO: 19190 - RNA, 375 nt, Artificial Sequence
  derived and/or modified sequence opt2 from anti-HIV-1_HeavyChain
cagguccaccucgagcaguccggcuccggcgucaagaagcucggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuccaccgcccacauggacauccgcggccucacccaggacgacaccgccaccuacuucugcgcccgccagaaguucgcccgcggcgaccagggcugguucuucgaccucuggggccgcggcacccucaucgucgucuccucc

SEQ ID NO: 19191 - RNA, 375 nt, Artificial Sequence
  derived and/or modified sequence opt2 from anti-HIV-1_HeavyChain
caggccuaccucgagcaguccggcuccaucaugaagaagcccggcgccuccguccgcgucuccugcuggaccuccgaggacaucuucgaccgcaccgagcucaucuacuggguccgccaggcccccggccagggccucgaguggaucggcugggucaagaucgucuccggcgccgucaacuucggcucccucgacuuccgcaaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccucc

SEQ ID NO: 19192 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucaucaacuggguccgccaggcccccggccagggccucgaguggaucggcugggucaaggccgucuccggcgccgucaacuacggcucccucgacuuccgccaccgcgucucccucacccgcgaccgcgaccucuccaccgcccacauggacauccgcggccucacccaggacgacaccgccaccuacuucugcgcccgccagaaguucgcccgcggcgaccagggcugguucuucgaccucuggggccgcggcacccucaucgucgucuccucc

SEQ ID NO: 19193 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcugguccuccgaggacaucuucgagcgcaccgagcucauccacuggguccgccaggcccccggccagggccucgaguggaucggcugggucaagaccgucaccggcgccgucaacuucggcucccucgacuuccgccaccgcaucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccucc

SEQ ID NO: 19194 - RNA, 375 nt, Artificial Sequence
  derived and/or modified sequence opt2 from anti-HIV-1_HeavyChain
caggcccaccucgagcaguccggcuccggcgucaagaagcccggcaccuccguccgcgucuccugcuggaccuccgaggacaucuucgagcgcaccgagcucauccacuggguccgccaggcccccggccagggccucgaguggaucggcugggucaagaucgucuccggcgccgucaacuucggcucccccaacuuccgccagcgcgucucccucacccgcgaccgcgaccucuucaccgcccacauggacauccgcggccucacccagggcgacaccgccaccuacuucugcgcccgccagaaguucgagcgcggcggccagggcuggaucuucgaccucuggggccgcggcacccucaucgccgucuccucc

SEQ ID NO: 19195 - RNA, 375 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccggcgacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuucaccgcccacauggacauccgcggccucacccaggacgacaccgccaccuacuucugcgcccgccagaaguucgcccgcggcgaccagggcugguucuucgaccucuggggccgcggcacccucaucgucgucuccucc

SEQ ID NO: 19196 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaucgucuccggcgccgucaacuucggcucccccaacuuccgccagcgcgucucccucacccgcgaccgcgaccucuucaccgcccacaccgacauccgcggccucacccagggcgacaccgccaccuacuucugcgcccgccagaaguucgagcgcggcggccagggcugguacuucgaccucuggggccgcggcacccucaucgucgucuccucc

SEQ ID NO: 19197 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugccucgccuccgaggacaucuucgagcgcaccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccucc

SEQ ID NO: 19198 - RNA, 375 nt, Artificial Sequence
  derived and/or modified sequence opt2 from anti-HIV-1_HeavyChain
caggcccaccucgagcaguccggcgccggcgucaagcgccccggcgccuccguccgcgucuccugcuggaccuccgaggacaucuucgagaccaccgagcucauccacuggguccgccaggcccccggccagggccucgaguggaucggcugggucaagaccgucuccggcgccgucaacuucggcucccucaacuuccgccaccgcgucucccucacccgcgaccgcgaccucuucaccgcccacauggacauccgcggccucacccagggcgacaccgccaccuacuucugcgcccgccagaaguucgcccgcggcgaccagggcugguucuucgaccucuggggccgcggcacccucaucgucgucuccucc

SEQ ID NO: 19199 - RNA, 375 nt, Artificial Sequence
  derived and/or modified sequence opt2 from anti-HIV-1_HeavyChain
cgccacaccuggaacaaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccucc

SEQ ID NO: 19200 - RNA, 375 nt, Artificial Sequence
  derived and/or modified sequence opt2 from anti-HIV-1_HeavyChain
ggcacccccggcuccgaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaucgucuccggcgccgucaacuucggcucccccaacuuccgccagcgcgucucccucacccgcgaccgcgaccucuucaccgcccacauggacauccgcggccucacccagggcgacaccgccaccuacuucugcgcccgccagaaguucgagcgcggcggccagggcuggaucuucgaccucuggggccgcggcacccucaucgccgucuccucc

SEQ ID NO: 19201 - RNA, 378 nt, Artificial Sequence
  derived and/or modified sequence opt2 from anti-HIV-1_HeavyChain
cagguccagcucguccaguccggcaccgagguccagaagcccggcgccuccgucaaggucuccugcaaggccuucggcuacuccuucaccgacuacuacgucuacuggguccgccaggcccccggccagggccucgaguacgucgccuggaucaaccccuccaacggcuacaccaaguacgcccagaaguuccaggacugggucacccucacccgcgacuccuccaucaacaccgccuaccuccagcucgcccgcgucaccuccgacgacaccgccaucuacuacugcgcccgccagaaguucgccucccgcuacuccggcgaccagggcuccuacuucgaccucuggggccgcggcacccucaucgucgucuccucc

SEQ ID NO: 19202 - RNA, 378 nt, Artificial Sequence
  derived and/or modified sequence opt2 from anti-HIV-1_HeavyChain
cagguccagcucguccaguccggcgccgccgucaagaagcccggcuccuccgucaaggucuccugcaaggccuccggcuacaucuucaccggcuacuacauccacuggauccgccaggcccccggccagggccucgaguggaugggcuggaucaaccccuccaccggcgacaccaaguucgcccgccaguuccagggccgcgucuccuucuaccgcacccgcgagcucggcaucgccuacauggaccuccgcgaccucaaguucgacgacaccgccgucuacuucugcgcccgcaagaccaagggcgacgucuccggcgacgaccgcggcuucuucuucgaccucuggggccgcggcacccgcgucaucgucuccucc

SEQ ID NO: 19203 - RNA, 381 nt, Artificial Sequence
  derived and/or modified sequence opt2 from anti-HIV-1_HeavyChain
caggucuacauggagcaggccggcgccggcaugaagaagcccggcgccuccaugaccgucuccugcaagaccgccgacgaggacaucuucgacgccgccuacaugcacuggguccgccaggcccccggccagaccuucgaguggcucggcuggaugaagcccgucaccggcgccgucaacuacgcccgccaguuccagggccgcgucuccuucuaccgcacccgcgagcucggcaucgccuacauggaccuccgcgaccucaaguucgacgacaccgccgucuacuucugcgcccgcaagaccaagggcgacgucuccggcgacgaccgcggcuucuucuucgaccucuggggccgcggcacccgcgucaucgucuccucc

SEQ ID NO: 19204 - RNA, 381 nt, Artificial Sequence
  derived and/or modified sequence opt2 from anti-HIV-1_HeavyChain
caggucuucauggagcaggccggcggcggcaugaagaagcccggcgccuccaugaccgucuccugcaagaccgccgacgaggacgucuucgacgccgccuacaugcacuggguccgccaggcccccggccagaccuucgaguggcucggcuggaugaagcccgucaccggcgccgucaacuacgcccgcaaguuccagggccgcgucuccuucuaccgcacccgcgagcucggcaucgccuacauggaccuccgcgaccucaaguucgacgacaccgccgucuacuucugcgcccgcaagaccaagggcgacgucuccggcgacgaccgcggcuucuucuucgaccucuggggccgcggcacccgcgucaucgucuccucc

SEQ ID NO: 19205 - RNA, 381 nt, Artificial Sequence
  derived and/or modified sequence opt2 from anti-HIV-1_HeavyChain
caggucuucauggagcaggccggcggcggcaugaagaagcccggcgccuccaugaccgucuccugcaagaccgccgacgaggacgucuucgacgccgccuacaugcacuggguccgccaggcccccggccagaccuucgaguggcucggcuggaugaagcccgucaccggcgccgucaacuacgcccgccaguuccagggccgcgucuccuucuaccgcacccgcgagcucggcaucgccuacauggaccuccgcgaccucaaguucgacgacaccgccgucuacuucugcgcccgcaagaccaagggcgacgucuccggcgacgaccgcggcuucuucuucgaccucuggggccgcggcacccgcgucaucgucuccucc

SEQ ID NO: 19206 - RNA, 381 nt, Artificial Sequence
  derived and/or modified sequence opt2 from anti-HIV-1_HeavyChain
cagguccacauggagcaggccggcggcggcgucaagaagcccggcgccuccgucacccucuccugcaagaccgccgacgaggacgucuucgacgccgccuacaugcacuggguccgccaggcccccggccagaccuucgaguggcucggcuggaugaagcccgucaccggcgccgucuccuacgcccgcaaguuccagggccgcgucuccuucuacaugacccgcgagcucggcauggccuacauggaccuccgcaaccuccgcuucgacgacaccgccgucuacuucugcgcccgcaagaccgccggcgacgucuccggcgacaaccgcggcuacuucuucgaccucuggggccgcggcucccgcgucaucgucuccucc

SEQ ID NO: 19207 - RNA, 381 nt, Artificial Sequence
  derived and/or modified sequence opt2 from anti-HIV-1_HeavyChain
caggucuacauggagcaggccggcggcggcaugaagaagcccggcgccuccaugaccgucuccugcaagaccgccgacgaggacaucuucgacgccgccuacaugcacuggguccgccaggcccccggccagaccuucgaguggcucggcuggaugaagcccgucaccggcgccgucaacuacgcccgccaguuccagggccgcgucuccuucuaccgcacccgcgagcucggcauggccuacauggaccuccgcaaccuccgcuucgacgacaccgccgucuacuucugcgcccgcaagaccgccggcgacgucuccggcgacaaccgcggcuacuucuucgaccucuggggccgcggcucccgcgucaucgucuccucc

SEQ ID NO: 19208 - RNA, 381 nt, Artificial Sequence
  derived and/or modified sequence opt2 from anti-HIV-1_HeavyChain
caggucuacauggagcaggccggcggcggcgucaagaagcccggcgccuccgucacccucuccugcaagaccgccgacgaggacgucuucgacgccgccuacaugcacuggguccgccaggcccccggccagaccuucgaguggcucggcuggaugaagcccgucaccggcgccgucuccuacgcccgcaaguuccagggccgcgucuccuucuacaugacccgcgagcucggcauggccuacauggaccuccgcaaccuccgcuucgacgacaccgccgucuacuucugcgcccgcaagaccgccggcgacgucuccggcgacaaccgcggcuacuucuucgaccucuggggccgcggcuccugggucaucgucuccucc

SEQ ID NO: 19209 - RNA, 381 nt, Artificial Sequence
  derived and/or modified sequence opt2 from anti-HIV-1_HeavyChain
cagguccagcucguccaguccggcgccgaggucaagaagcccggcgccuccgucacccucuccugcaagaccgccgacgaggacgucuucgacgccgccuacaugcacuggguccgccaggcccccggccagaccuucgaguggcucggcuggaugaagcccgucaccggcgccgucaacuacgcccgcaaguuccagggccgcgucuccuucuaccgcacccgcgagcucggcaucgccuacauggaccuccgcaaccuccgcuucgacgacaccgccgucuacuucugcgcccgcaagaccgccggcgacgucuccggcgacaagcgcggcuucuucuucgaccucuggggccgcggcucccgcgucaucgucuccucc

SEQ ID NO: 19210 - RNA, 384 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgccucccucgacuuccgcaaccgcaucucccucucccgcgaccgcggccucuccaccgccuacauggacauccgcggccucacccaggacgacaccgccaccuacuucugcgcccgccagaaguucgccucccgcuacuccggcgaccagggcuccuacuucgaccucuggggccgcggcacccucaucgucgucuccucc

SEQ ID NO: 19211 - RNA, 384 nt, Artificial Sequence
  derived and/or modified sequence opt2 from anti-HIV-1_HeavyChain
caggcccaccucgagcaguccgccuccggcguccgccgccccggcgccuccguccgcgucuccugcuggaccuccgaggacaucuucgagcgcuccgagcucaucuacuggguccgccaggcccccggccgcggccucgaguggaucggcuggaucaagcucgucuccggcgccgucaacuucggcuccgucgacuuccgcgaccgcgucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccucc

SEQ ID NO: 19212 - RNA, 384 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuacggcucccucaacuuccgcucccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccucc

SEQ ID NO: 19213 - RNA, 384 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucuccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccucc

SEQ ID NO: 19214 - RNA, 384 nt, Artificial Sequence
  derived and/or modified sequence opt2 from anti-HIV-1_HeavyChain
cagguccaccucgagcaguccggcuccggcgucaagaagcccggcgccuccguccgcgucuccugcugguccuccgaggacaucuucgagcgcaccgagcucauccacuggguccgccaggcccccggccagggccucgaguggaucggcugggucaagaccgucaccggcgccgucaacuucggcucccucgacuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccucc

SEQ ID NO: 19215 - RNA, 384 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgccucccucgacuuccgcaaccgcaucucccucggccgcgaccgcgaccucuccaccgccuacauggacauccgcggccucacccaggacgacaccgccaccuacuucugcgcccgccagaaguucgccucccgcuacuccggcgaccagggcuccuacuucgaccucuggggccgcggcacccucaucgucgucuccucc

SEQ ID NO: 19216 - RNA, 384 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcaccgucaacuucggcucccucaacuuccgccagcgcgucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccucc

SEQ ID NO: 19217 - RNA, 384 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgagggcaucuucgacaccaccgagcucaucuacuggguccgccaggcccccggccagggccucgaguggaucggcugggucaagaucgucuccggcaccgucaacuucgccucccucgacuuccgcaaccgcaucucccucucccgcgaccgcgaccucuccaccgccuacauggacauccgcggccucacccaggacgacaccgccaccuacuucugcgcccgccagaaguucgccucccgcuacuccggcgaccagggcuccuacuucgaccucuggggccgcggcacccucaucgucgucuccucc

SEQ ID NO: 19218 - RNA, 384 nt, Artificial Sequence
  derived and/or modified sequence opt2 from anti-HIV-1_HeavyChain
cagucccgccucgagcaguccggcuccgccaugaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgccucccucgacuuccgcaaccgcaucucccucucccgcgaccgcgaccucuccaccgcccacauggacauccgcggccucacccaggacgacaccgccaccuacuucugcgcccgccagaaguucgccucccgcuacuccggcgaccagggcuccuacuucgaccucuggggccgcggcacccucaucaucgucuccucc

SEQ ID NO: 19219 - RNA, 384 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccucc

SEQ ID NO: 19220 - RNA, 384 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgccuccuccgacuuccgcaaccgcaucucccucucccgcgaccgcgaccucuccaccgccuacauggacauccgcggccucacccaggacgacaccgccaccuacuucugcgcccgccagaaguucgccucccgcuacuccggcgaccagggcuccuacuucgaccucuggggccgcggcacccucaucaucgucuccucc

SEQ ID NO: 19221 - RNA, 384 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaucgucuccggcaccgucaacuucgccucccucgacuuccgcaaccgcaucucccucucccgcgaccgcgaccucuccaccgccuacauggacauccgcggccucacccaggacgacaccgccaccuacuucugcgcccgccagaaguucgccucccgcuacuccggcgaccagggcuccuacuucgaccucuggggccgcggcacccucaucgucgucuccucc

SEQ ID NO: 19222 - RNA, 384 nt, Artificial Sequence
  derived and/or modified sequence opt2 from anti-HIV-1_HeavyChain
cgccacaccugggagcaguccggcuccggcgucaagaagcccggcgccuccguccgcgucuccugcugguccuccgaggacaucuucgagcgcaccgagcucauccacuggguccgccaggcccccggccagggccucgaguggaucggcugggucaagaccgucaccggcgccgucaacuucggcucccucgacuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccucc

SEQ ID NO: 19223 - RNA, 384 nt, Artificial Sequence
  derived and/or modified sequence opt2 from anti-HIV-1_HeavyChain
cgccacaccugggagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccucgacuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccucc

SEQ ID NO: 19224 - RNA, 414 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcuccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguacuacgccggcggccagggcugguacuucgaccucuggggccgcggcacccucaucgucgucuccuccgccuccaccaagggccccuccgucuuccacgaccuccgc

SEQ ID NO: 19225 - RNA, 417 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaucgucuccggcgccgucaacuucggcucccccaacuuccgccagcgcgucucccucacccgcgaccgcgaccucuucaccgcccacauggacauccgcggccucacccagggcgacaccgccaccuacuucugcgcccgccagaaguucgagcgcggcggccagggcuggaucuucgaccucuggggccgcggcacccucaucgccgucuccuccgccuccaccaagggccccuccgucuuccccaccaucugcguc

SEQ ID NO: 19226 - RNA, 417 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaaggccgucuccggcgccgucaacuacggcucccucgacuuccgccaccgcgucucccucacccgcgaccgcgaccucuucaccgcccacauggacauccgcggccucacccaggacgacaccgccaucuacuucugcgcccgccagaaguucgcccgcggcgaccagggcugguucuucgaccucuggggccgcggcacccucaucgucgucuccuccgccuccaccaagggccccuccgucuucccccacgaccuccgc

SEQ ID NO: 19227 - RNA, 417 nt, Artificial Sequence
  derived and/or modified sequence opt2 from anti-HIV-1_HeavyChain
caggcccaccucgagcaguccggcuccggcgucaagaaggucggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuucaccgcccacauggacauccgcggccucacccaggacgacaccgccaucuacuucugcgcccgccagaaguucgcccgcggcgaccagggcugguucuucgaccucuggggccgcggcacccucaucgucgucuccuccgccuccaccaagggccccuccgucuucccccacgaccuccgc

SEQ ID NO: 19228 - RNA, 417 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccuccgccuccaccaagggccccuccgucuucccccacgaccuccgc

SEQ ID NO: 19229 - RNA, 423 nt, Artificial Sequence
  derived and/or modified sequence opt2 from anti-HIV-1_HeavyChain
caggucuacauggagcaggccggcgccggcgucaagaagcccggcgccuccgucacccucuccugcaagaccgccgacgaggacgucuucgacgccgccuacaugcacuggguccgccaggcccccggccagaccuucgaguggcucggcuggaugaagcccgucaccggcgccgucuccuacgcccgcaaguuccagggccgcgucuccuucuacaugacccgcgagcucggcauggccuacauggaccuccgcaaccuccgcuucgacgacaccgccgucuacuucugcgcccgcaagaccgccggcgacgucuccggcgacaaccgcggcuacuucuucgaccucuggggccgcggcucccgcgucaucgucuccuccgccuccaccaagggccccuccgucuucccccacgaccuccgc

SEQ ID NO: 19230 - RNA, 426 nt, Artificial Sequence
  derived and/or modified sequence opt2 from anti-HIV-1_HeavyChain
cagucccaccucgagcaguccggcuccgccaugaagaagcccggcgccuccguccgcgucuccugcuggaccuccgaggacaucuucgacaccaccgagcucaucuacuggguccgccaggcccccggccagggccucgaguggaucggcugggucaagaucgucuccggcaccgucaacuucgccucccucgacuuccgcaaccgcaucucccucucccgcgaccgcgaccucuccaccgccuacauggacauccgcggccucacccaggacgacaccgccaccuacuucugcgcccgccagaaguucgccucccgcuacuccggcgaccagggcuccuacuucgaccucuggggccgcggcacccucaucgucgucuccuccgccuccaccaagggccccuccgucuuccccaccaucuacguc

SEQ ID NO: 19231 - RNA, 372 nt, Artificial Sequence
  derived and/or modified sequence opt2 from anti-HIV-1_HeavyChain
cagguccagcucguccaguccggcgccgaggucaagaagcccggcgccuccgucaaggucuccugcaaggccuccggcggcacccucuccuccuacgccaucuccuggguccgccaggcccccggccagggccucgaguggaucggcugggucaagaccgucaccggcgccgucaacuucggcuccgccugcuuccgccaccgcgucucccucacccgcgaccgcgaccucuucaccgcccacauggacauccgcggccucacccagggcgacaccgccaccuacuucugcgcccgccagaaguucuacaagggcggccagggcugguacuucgaccucuggggccgcggcacccucaucgucgucuccucc

SEQ ID NO: 19232 - RNA, 372 nt, Artificial Sequence
  derived and/or modified sequence opt2 from anti-HIV-1_HeavyChain
cacguccgccucguccaguccggcgccgaggucgagaagcccggcgccuccgucaaggucuccugcgagaccuccaacuaccccuucaacauguacggcaugaccuggguccgccaggcccccggccagggccucgaguggaucggcugggucaagaucgucuccggcgccgucaacuucggcucccccaacuuccgccagcgcgucucccucacccgcgaccgcgaccucuucaccgcccacauggacauccgcggccucacccagggcgacaccgccaccuacuucugcgcccgccagaaguucgagcgcggcggccagggcuggaucuucgaccucuggggccgcggcacccucaucgccgucuccucc

SEQ ID NO: 19233 - RNA, 375 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacgucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuucaccgcccacauggacauccgcggccucacccaggacgacaccgccaccuacuucugcgcccgccagaaguucuacgccggcggccagggcugguacuucgaccucuggggccgcggcacccucaucgucgucuccucc

SEQ ID NO: 19234 - RNA, 375 nt, Artificial Sequence
  derived and/or modified sequence opt2 from anti-HIV-1_HeavyChain
cgccacaccugggagcaguccggcuccggcgucaagaagcccggcgccuccguccgcgucuccugcugguccuccgaggacaucuucgagcgcaccgagcucauccacuggguccgccaggcccccggccagggccucgaguggaucggcugggucaagaccgucaccggcgccgucaacuucggcucccucgacuuccgccaccgcaucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccucc

SEQ ID NO: 19235 - RNA, 375 nt, Artificial Sequence
  derived and/or modified sequence opt2 from anti-HIV-1_HeavyChain
cgccacaccugggagcaguccggcuccggcgucaagcgccccggcgccuccguccgcgucuccugcuggaccuccgaggacaucuucgagaccaccgagcucauccacuggguccgccaggcccccggccagggccucgaguggaucggcugggucaagaccgucuccggcgccgucaacuucggcucccucaacuuccgccaccgcgucucccucacccgcgaccgcgaccucuccaccgcccacauggacauccgcggccucacccaggacgacaccgccaccuacuucugcgcccgccagaaguucgcccgcggcgaccagggcugguucuucgaccucuggggccgcggcacccucaucgucgucuccucc

SEQ ID NO: 19236 - RNA, 381 nt, Artificial Sequence
  derived and/or modified sequence opt2 from anti-HIV-1_HeavyChain
caggucuucauggagcaggccggcgccggcaugaagaagcccggcgccuccaugaccgucuccugcaagaccgccgacgaggacgucuucgacgccgccuacaugcacuggguccgccaggcccccggccagaccuucgaguggcucggcuggaugaagcccgucaccggcgccgucaacuacgcccgccaguuccagggccgcgucuccuucuaccgcacccgcgagcucggcaucgccuacauggaccuccgcgaccucaaguucgacgacaccgccgucuacuucugcgcccgcaagaccaagggcgacgucuccggcgacgaccgcggcuucuucuucgaccucuggggccgcggcacccgcgucaucgucuccucc

SEQ ID NO: 19237 - RNA, 384 nt, Artificial Sequence
  derived and/or modified sequence opt2 from anti-HIV-1_HeavyChain
cagguccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccucgacuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccucc

SEQ ID NO: 19238 - RNA, 417 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuccaccgcccacauggacauccgcggccucacccaggacgacaccgccaccuacuucugcgcccgccagaaguucgcccgcggcgaccagggcugguucuucgaccucuggggccgcggcacccucaucgucgucuccuccgccuccaccaagggccccuccgucuuccccaccaucugcguc

SEQ ID NO: 19239 - RNA, 417 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucgucgucuccuccgccuccaccaagggccccuccgucuuccccaccaucugcguc

SEQ ID NO: 19240 - RNA, 417 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacgucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuucaccgcccacauggacauccgcggccucacccaggacgacaccgccaccuacuucugcgcccgccagaaguucuacgccggcggccagggcugguacuucgaccucuggggccgcggcacccucaucgucgucuccuccgccuccaccaagggccccuccgucuucccccacgaccuccgc

SEQ ID NO: 19241 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaucgucuccggcgccgucaacuucggcucccccaacuuccgccagcgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccucc

SEQ ID NO: 19242 - RNA, 384 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccucgacuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccucc

SEQ ID NO: 19243 - RNA, 426 nt, Artificial Sequence
  derived and/or modified sequence opt2 from anti-HIV-1_HeavyChain
caggcccaccucgagcaguccggcuccggcgucaagaagcccggcgccuccguccgcgucuccugcugguccuccgaggacaucuucgagcgcaccgagcucauccacuggguccgccaggcccccggccagggccucgaguggaucggcugggucaagaccgucaccggcgccgucaacuucggcucccucgacuuccgccaccgcaucucccucacccgcgaccgcgaccucuucaccgcccacauggacauccgcggccucacccagggcgacaccgccaccuacuucugcgcccgccagaaguucgagucccgcuacaccggcggccagggcugguacuucgaccucuggggccgcggcacccacaucgucgucuccuccgccuccaccaagggccccuccgucuuccccaccaucugcguc

SEQ ID NO: 19244 - RNA, 375 nt, Artificial Sequence
  derived and/or modified sequence opt2 from anti-HIV-1_HeavyChain
caggcccaccucgagcaguccggcuccggcgucaagaagcccggcaccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccucc

SEQ ID NO: 19245 - RNA, 381 nt, Artificial Sequence
  derived and/or modified sequence opt2 from anti-HIV-1_HeavyChain
cagguccagcucguccaguccggcgccgaggucaagaagcccggcgccuccgucaaggucuccugcaaggccuccggcuacaccuacaccaccuacggcgucuccuggcuccgccagguccccggccagcgccccgaguggaugggcuggauccgccccaagaccggcgcccgcaaccaggcccgccaguuccagccccgcaucucccucacccgcgaccgcgcccucuccaccgccuaccucgaccucaacucccucaccuccgccgacuccggcaccuacuucugcgcccgccagaccuucaagcccgacuucuacuucgccgaccagggcugguccuucaaccucuggggccgcggcgcccacuucaucgucuccucc

SEQ ID NO: 19246 - RNA, 384 nt, Artificial Sequence
  derived and/or modified sequence opt2 from anti-HIV-1_HeavyChain
cgcgcccaccucgagcaguccggcuccggcgucaagaagcucggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuucaccgcccacauggacauccgcggccucacccaggacgacaccgccaccuacuucugcgcccgccagaaguucgagucccgcuacaccggcggccagggcugguacuucgaccucuggggccgcggcacccacaucaccgucuccucc

SEQ ID NO: 19247 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaucgucuccggcgccgucaacuucggcucccccaacuuccgccagcgcgucucccucacccgcgaccgcgaccucuucaccgcccacauggacauccgcggccucacccagggcgacaccgccaccuacuacugcgcccgccagaaguucgagcgcggcggccagggcuggaucuucgaccucuggggccgcggcacccucaucgccgucuccucc

SEQ ID NO: 19248 - RNA, 375 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuucaccgcccacauggacauccgcggccucacccaggacgacaccgccaccuacuucugcgcccgccagaaguucgcccgcggcgaccagggcugguucuucgaccucuggggccacggcacccucaucgucgucuccucc

SEQ ID NO: 19249 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccacggcacccucaucgucgucuccucc

SEQ ID NO: 19250 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcuccuccgacuuccgccagcgcgucucccucacccgcgacggcgaccucuucaccgcccacauggacauccgcggccucacccagggcgacaccgccaccuacuucugcgcccgccagaaguucuacgccggcggccagggcugguacuucgaccucuggggccgcggcacccucaucaucgucuccucc

SEQ ID NO: 19251 - RNA, 372 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggccaccagaucuccgaccgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccacggcacccucaucgucgucuccucc

SEQ ID NO: 19252 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucuccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccacggcacccucaucgucgucuccucc

SEQ ID NO: 19253 - RNA, 375 nt, Artificial Sequence
  derived and/or modified sequence opt2 from anti-HIV-1_HeavyChain
caggcccaccucgagcaguccggcgccggcgucaagaagcccggcgccuccguccgcgucuccugcuggaccuccgaggacaucuucgagcgcaccgagcucauccacuggguccgccaggcccccggccagggccucgaguggaucggcugggucaagaccgucuccggcgccgucaacuucggcucccccaacuuccgccaccgcgucucccucacccgcgaccgcgaccucuucaccgcccacauggacauccgcggccucacccagggcgacaccgccaccuacuacugcgcccgccagaaguucgagcgcggcggccagggcugguacuucgaccucuggggccgcggcacccucaucgucgucuccucc

SEQ ID NO: 19254 - RNA, 375 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgagcgcaccgagcucauccacuggguccgccaggcccccggccgcggccucgaguggaucggcugggucaaggccgucuccggcgccgucaacuacggcucccucgacuuccgccaccgcgucucccucacccgcgaccgcgaccucuucaccgcccacauggacauccgcggccucacccaggacgacaccgccaccuacuacugcgcccgccagaaguucgagcgcggcggccagggcuggaucuucgaccucuggggccgcggcacccucaucgccgucuccucc

SEQ ID NO: 19255 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuacugcgcccgccagaaguucuacgccggcggccagggcugguacuucgaccucuggggccgcggcacccucaucgucgucuccucc

SEQ ID NO: 19256 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucuacaagggcggccagggcugguacuucgaccucuggggccgcggcacccucaucgucgucuccucc

SEQ ID NO: 19257 - RNA, 372 nt, Artificial Sequence
  derived and/or modified sequence opt2 from anti-HIV-1_HeavyChain
uacgucgagcucggcaccaacaccggccccgagguccgcaagcccggcgccuccgucaagaucuccugcaagaccuccggcuacaucuucaccgacaacuacuuccacuggcuccgccaggcccccgccgucggccucgaguggaugggcuggaucaacucccacaacggcuacaccaaguccgccaagaaguuccagggccgcaucaccaugacccgcgacaccgccgucgacaccgccuacauggagcucaucgaccucaccuccgacgacaccgccaccuacuacugcgcccgccagaaguucuacgccggcggccagggcugguacuucgaccucuggggcugcggcacccucaucgucgucuccucc

SEQ ID NO: 19258 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccgcggcacccucaucugcgucuccucc

SEQ ID NO: 19259 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuacugcgcccgccagaaguucuacgccggcggccagggcugguacuucgaccucuggggccgcggcacccucaucgucgucuccucc

SEQ ID NO: 19260 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagcccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccucc

SEQ ID NO: 19261 - RNA, 375 nt, Artificial Sequence
  derived and/or modified sequence opt2 from anti-HIV-1_HeavyChain
cagguccagcucguccaguccggcgccgaggucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuacugcgcccgccagaaguucgagcgcggcggccagggcugguacuucgaccucuggggccgcggcacccucaucgucgucuccucc

SEQ ID NO: 19262 - RNA, 375 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuccaccgcccacauggacauccgcggccucacccaggacgacaccgccaccuacuccugcgcccgccagaaguucgcccgcggcgaccagggcugguucuucgaccucuggggccgcggcacccucaucgucgucuccucc

SEQ ID NO: 19263 - RNA, 375 nt, Artificial Sequence
  derived and/or modified sequence opt2 from anti-HIV-1_HeavyChain
caggcccaccucgagcaguccggcuccggcgucaagaagcccggcaccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuacugcgcccgccagaaguucgagcgcggcggccagggcugguacuucgaccucuggggccgcggcacccucaucgucgucuccucc

SEQ ID NO: 19264 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcaccgucaacuucggcucccucaacuuccgccagcgcgucucccucacccgcgaccgcgaccucuucaccgcccacauggacauccgcggccucacccagggcgacaccgccaccuacuucugcgcccgccagaaguucgcccgcggcgaccagggcugguucuucgaccucuggggccacggcacccucaucgucgucuccucc

SEQ ID NO: 19265 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgccaccgcgucucccucacccgcgaccgcgaccccuucaccgcccacauggacauccgcggccucacccagggcgacaccgccaccuacuucugcgcccgccagaaguucgagcgcggcggccagggcugguacuucgaccucuggggccacggcacccucaucgucgucuccucc

SEQ ID NO: 19266 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacaucugcggccucacccagggcgacaccgccaccuacuucugcgcccgccagaaguucgagcgcggcggccagggcugguacuucgaccucuggggccacggcacccucaucgucgucuccucc

SEQ ID NO: 19267 - RNA, 375 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccagcgcgucucccucacccgcgaccgcgaccucuucaccgcccacauggacauccgcggccucacccagggcgacaccgccaccuacuacugcgcccgccagaaguucuacgccggcggccagggcugguacuucgaccucuggggccgcggcacccucaucgucgucuccucc

SEQ ID NO: 19268 - RNA, 372 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuucugcgcccgccagaaguucuacgccggcggccagggcugguacuucgaccucuggggccacggcacccucaucgucgucuccucc

SEQ ID NO: 19269 - RNA, 375 nt, Artificial Sequence
  derived and/or modified sequence opt2 from anti-HIV-1_HeavyChain
caggcccaccucgagcaguccggcuccggcgucaagaagcccggcaccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgcccgcggcgaccagggcugguucuucgaccucuggggccacggcacccucaucgucgucuccucc

SEQ ID NO: 19270 - RNA, 375 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuucaccgcccacauggacauccgcggccucacccaggacgacaccgccaccuacuacugcgcccgccagaaguucgcccgcggcgaccagggcugguucuucgaccucuggggccgcggcacccucaucgucgucuccucc

SEQ ID NO: 19271 - RNA, 381 nt, Artificial Sequence
  derived and/or modified sequence opt2 from anti-HIV-1_HeavyChain
cagguccagcucguccaguccggcgccgaggucaagaagcccggcgccuccgucaaggucuccugcaaggccuccggcuacaccuucaccgacuacuaccuccacuggguccgccaggcccccggccagggccucgacugggucggcuggaucaaccccaacuccggcggcaccaacuacgcccagaaguuccagggccgcgucgccaugacccgcgacaccucccucuccuccgucuaccucgaccucaacucccucaccuccgccgacuccggcaccuacuucugcgcccgccagaccuucaagcccgacuucuacuucgccgaccagggcugguccuucaaccucuggggccagggcucccacuucaucgucuccucc

SEQ ID NO: 19272 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaaguccgagcucauccacuggguccgccgcgcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuacugcgcccgccagaaguucuacgccggcggccagggcugguacuucgaccucuggggccgcggcacccucaucgucgucuccucc

SEQ ID NO: 19273 - RNA, 372 nt, Artificial Sequence
  derived and/or modified sequence opt2 from anti-HIV-1_HeavyChain
caggcccaccucgagcaguccggcuccggcgucaagaagcccggcgccuccgucaccgucuccugcuggaccuccgaggacaucuucgagaaguccgagcucauccacuggguccgccaggcccccggccagggccucgaguggaucggcugggucaagaccgucaccggcgccgucaaccucgucuaccagaucuccgaccgcgucucccucacccgcgaccgcggccucuucaccgcccacauggacauccgcggccucacccagggcgacaccgccaccuacuacugcgcccgccagaaguucuacgccggcggccagggcugguacuucgaccucuggggccgcggcacccucaucgucgucuccucc

SEQ ID NO: 19274 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagggcuccgagcucauccacuggguccgccaggcccccggccagggccucgaguggaucggcugggucaagaccgucaccggcgccgucaacuucggcuccgccuacuuccgccaccgcgucucccucacccgcgaccgcgaccucuucaccgcccacauggacauccgcggccucacccagggcgacaccgccaccuacuucugcgcccgccagaaguucuacaagggcggccagggcugguacuucgaccucuggggccacggcacccucaucgucgucuccucc

SEQ ID NO: 19275 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuacggcucccucaacuuccgcucccgcaucucccucacccgcgaccgcgaccucuucaccgcccacauggacauccgcggccucaccgagggcgacaccgccaccuacuucugcgcccgccagaaguucuacgccggcggccagggcugguacuucgaccucuggggccacggcacccucaucgucgucuccucc

SEQ ID NO: 19276 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucuccggcgccgucaacuucggcucccccaacuuccgccaccgcgucucccucacccgcgaccgcgaccucuucaccgcccacauggacauccgcggccucacccagggcgacauggccaccuacuucugcgcccgccagaaguucgagcgcggcggccagggcugguacuucgaccucuggggccacggcacccucaucgucgucuccucc

SEQ ID NO: 19277 - RNA, 375 nt, Artificial Sequence
  derived and/or modified sequence opt2 from anti-HIV-1_HeavyChain
caggcccaccucgagcaguccggcuccggcgucaaggagcccggcaccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcuggaucuucgaccucuggggccgcggcacccucaucgccgucuccucc

SEQ ID NO: 19278 - RNA, 375 nt, Artificial Sequence
  derived and/or modified sequence opt2 from anti-HIV-1_HeavyChain
cagguccagcucgagcaguccggcuccggcgucaagaagcucggcgccuccguccgcgucuccugcuggaccuccgaggacaucuucggccgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuucaccgcccacauggacauccgcggccucacccaggacgacaccgccaccuacuacugcgcccgccagaaguucgcccgcggcgaccagggcugguucuucgaccucuggggccgcggcacccucaucgucgucuccucc

SEQ ID NO: 19279 - RNA, 372 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgacgacaucuucaagaccgagcucauccacuggguccgccaggcccccggccagggccucgaguggaucggcugggucaagaccgucaccggcgccgucaacuucggcucccccaacuuccgccagcgcgucucccucacccgcgaccgcgaccucuucaccgcccacauggacauccgcggccucacccaggacgacaccgccaccuacuucugcgcccgccagaaguucgcccgcggcgaccagggcugguucuucgaccucuggggccgcggcacccucaucgucgucuccucc

SEQ ID NO: 19280 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuacugcguccgccagaaguucgagcgcggcggccagggcugguacuucgaccucuggggccgcggcacccucaucgucgucuccucc

SEQ ID NO: 19281 - RNA, 375 nt, Artificial Sequence
  derived and/or modified sequence opt2 from anti-HIV-1_HeavyChain
cagguccagcucguccaguccggcgccgaggucaagaagcccggcgccuccgucaaggucuccugcuggaccuccgaggacaucuucgagaaguccgagcucauccacuggguccgccaggcccccggccagggccucgaguggaucggcugggucaagaccgucaccggcgccgucaacuucggcuccuccgacuuccgccagcgcgucucccucacccgcgaccgcgaccucuucaccgcccacauggacauccgcggccucacccagggcgacaccgccaccuacuacugcgcccgccagaaguucuacgccggcggccagggcugguacuucgaccucuggggccgcggcacccucaucgucgucuccucc

SEQ ID NO: 19282 - RNA, 375 nt, Artificial Sequence
  derived and/or modified sequence opt2 from anti-HIV-1_HeavyChain
caggcccaccucgagcaguccggcuccggcgucaagaagcucggcgccuccguccgcgucuccugcuggaccuccgaggacaucuucgagcgcaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuucaccgcccacauggacauccgcggccucacccagggcgacaccgccaccuacuucugcgcccgccagaaguucuacaagggcggccagggcugguacuucgaccucuggggccgcggcacccucaucgucgucuccucc

SEQ ID NO: 19283 - RNA, 372 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucgagaaguccgagcucauccacuggguccgccaggcccccggccagggccucgaguggaucggcugggucaagaccgucaccggcgccgucaacuucgcccaccagaucuccgaccgcgucucccucacccgcgaccgcgaccucuucaccgcccacauggacauccgcggccucacccagggcgacaccgccaccuacuacugcgcccgccagaaguucuacgccggcggccagggcugguacuucgaccucuggggccgcggcacccucaucgucgucuccucc

SEQ ID NO: 19284 - RNA, 375 nt, Artificial Sequence
  derived and/or modified sequence opt2 from anti-HIV-1_HeavyChain
caggcccaccucgagcaguccggcuccggcgucaagaagcccggcgccuccguccgcgucuccugcuggaccuccgaggacaucuucggccgcaccgagcucauccacuggguccgccaggcccccggccagggccucgaguggaucggcugggucaagaccgucuccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucugcgucuccucc

SEQ ID NO: 19285 - RNA, 636 nt, Artificial Sequence
  derived and/or modified sequence opt2 from anti-HIV_5CIN_LightChain
gagaucguccucacccagucccccggcacccagucccucucccccggcgagcgcgccacccucuccugccgcgccucccaguccgucggcaacaacaagcucgccugguaccagcagcgccccggccaggccccccgccuccucaucuacggcgccuccucccgccccuccggcgucgccgaccgcuucuccggcuccggcuccggcaccgacuucacccucaccaucucccgccucgagcccgaggacuucgccgucuacuacugccagcaguacggccagucccucuccaccuucggccagggcaccaaggucgaggucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgc

SEQ ID NO: 19286 - RNA, 672 nt, Artificial Sequence
  derived and/or modified sequence opt2 from anti-HIV_5CIN_HeavyChain
guccagcucguccaguccggcgccgaggucaagcgccccggcuccuccgucaccgucuccugcaaggccuccggcggcuccuucuccaccuacgcccucuccuggguccgccaggcccccggccgcggccucgaguggaugggcggcgucaucccccuccucaccaucaccaacuacgccccccgcuuccagggccgcaucaccaucaccgccgaccgcuccaccuccaccgccuaccucgagcucaacucccuccgccccgaggacaccgccgucuacuacugcgcccgcgagggcaccaccggcuccggcggcaagcccaucggcgccuucgcccacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagccc

SEQ ID NO: 19287 - RNA, 678 nt, Artificial Sequence
  derived and/or modified sequence opt2 from anti-HIV_5CIL_HeavyChain
guccagcucguccaguccggcgccgaggucaagcgccccggcuccuccgucaccgucuccugcaaggccuccggcggcuccuucuccaccuacgcccucuccuggguccgccaggcccccggccgcggccucgaguggaugggcggcgucaucccccuccucaccaucaccaacuacgccccccgcuuccagggccgcaucaccaucaccgccgaccgcuccaccuccaccgccuaccucgagcucaacucccuccgccccgaggacaccgccgucuacuacugcgcccgcgagggcaccaccggcgacggcgaccucggcaagcccaucggcgccuucgcccacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagccc

SEQ ID NO: 19288 - RNA, 678 nt, Artificial Sequence
  derived and/or modified sequence opt2 from anti-HIV_5CIP_A-Chain
guccagcucguccaguccggcgccgaggucaagcgccccggcuccuccgucaccgucuccugcaaggccuccggcggcuccuucuccaccuacgcccucuccuggguccgccaggcccccggccgcggccucgaguggaugggcggcgucaucccccuccucaccaucaccaacuacgccccccgcuuccagggccgcaucaccaucaccgccgaccgcuccaccuccaccgccuaccucgagcucaacucccuccgccccgaggacaccgccgucuacuacugcgcccgcgagggcaccaccggcuggggcuggcucggcaagcccaucggcgccuucgcccacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagccc

SEQ ID NO: 19289 - RNA, 681 nt, Artificial Sequence
  derived and/or modified sequence opt2 from anti-HIV_5CIP_HeavyChain
guccagcucguccaguccggcgccgaggucaagcgccccggcuccuccgucaccgucuccugcaaggccuccggcggcuccuucuccaccuacgcccucuccuggguccgccaggcccccggccgcggccucgaguggaugggcggcgucaucccccuccucaccaucaccaacuacgccccccgcuuccagggccgcaucaccaucaccgccgaccgcuccaccuccaccgccuaccucgagcucaacucccuccgccccgaggacaccgccgucuacuacugcgcccgcgagggcaccaccggcuggggcuggcucggcaagcccaucggcgccuucgcccacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaag

SEQ ID NO: 19290 - RNA, 630 nt, Artificial Sequence
  derived and/or modified sequence opt2 from anti-HIV_4JKP_LightChain
gagaucguccucacccagucccccgccacccucucccucucccccggcgagaccgccaucaucuccugccgcaccucccaguacggcucccucgccugguaccagcagcgccccggccaggccccccgccucgucaucuacuccggcuccacccgcgccgccggcauccccgaccgcuucuccggcucccgcuggggcgccgacuacaaccucuccaucuccaaccucgaguccggcgacuucggcgucuacuacugccagcaguacgaguucuucggccagggcaccaagguccaggucgacaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 19291 - RNA, 678 nt, Artificial Sequence
  derived and/or modified sequence opt2 from anti-HIV_3TNN_E-Chain
gagguccagcucgucgaguccggcggcggccucguccagcccggcggcucccuccgccucuccugcgccgccuccggcuucaccuucuccaccuacgccauguccuggguccgccaggcccccggcaagggccucgagugggucuccuccaucaacaacuccggccgcaacaccuucuccgccgacuccgucaagggccgcuucaccaucucccgcgacaacuccaagaacacccucuuccucgucaugaacucccuccgcgccgaggacaccgccgucuacuacugcgccaaggaccuccgccucggcggcggcuccgacuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccac

SEQ ID NO: 19292 - RNA, 705 nt, Artificial Sequence
  derived and/or modified sequence opt2 from anti-HIV_3BQU_B-Chain
cgcaucacccucaaggaguccggccccccccucgucaagcccacccagacccucacccucaccugcuccuucuccggcuucucccucuccgacuucggcgucggcgucggcuggauccgccagccccccggcaaggcccucgaguggcucgccaucaucuacuccgacgacgacaagcgcuacucccccucccucaacacccgccucaccaucaccaaggacaccuccaagaaccaggucguccucgucaugacccgcgucucccccgucgacaccgccaccuacuucugcgcccaccgccgcggccccaccacccucuucggcguccccaucgcccgcggccccgucaacgccauggacgucuggggccagggcaucaccgucaccaucuccuccaccuccaccaagggccccuccgucuucccccucgcccccuccuccaaguccaccgccggcggcgccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaccugcaacgucaaccacaagcccuccaacaccaaggucgacaagcgcgucgagcccaaguccugc

SEQ ID NO: 19293 - RNA, 642 nt, Artificial Sequence
  derived and/or modified sequence opt2 from anti-HIV_3BQU_A-Chain
gcccuccagcucacccagucccccuccucccucuccgccuccgucggcgaccgcaucaccaucaccugccgcgccucccagggcgucaccuccgcccucgccugguaccgccagaagcccggcucccccccccagcuccucaucuacgacgccuccucccucgaguccggcguccccucccgcuucuccggcuccggcuccggcaccgaguucacccucaccaucuccacccuccgccccgaggacuucgccaccuacuacugccagcagcuccacuucuacccccacaccuucggcggcggcacccgcgucgacguccgccgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgagugcgaggucacccaccagggccucuccucccccgucaccaaguccuucaaccgcggcgagugc

SEQ ID NO: 19294 - RNA, 387 nt, Artificial Sequence
  derived and/or modified sequence opt2 from anti-HIV_IgG_VR-Chain
auggagacccccgcccagcuccucuuccuccuccuccucuggcuccccgacaccaccggcgagaucguccucacccagucccccggcacccucucccucuccgccggcgagcgcgccacccucuccugccgcgccucccaguccgucuccucccgcuaccucgccugguaccagcagaagcccggccaggccccccgccuccucaucuacggcgccuccucccgcgccaccggcauccccgaccgcuucuccggcuccggcuccggcaccgacuucacccucaccaucucccgcgucgagcccgaggacuucgccggcuacuacugccagcaguacgacaacuccgucugcaccuucggccagggcaccaagcucgagaucaagcgc

SEQ ID NO: 19295 - RNA, 348 nt, Artificial Sequence
  derived and/or modified sequence opt2 from anti-HIV_IgG_HeavyChain
augaagcaccucugguucuuccuccuccucgucgccgccccccgcuggguccucucccagguccagcuccaggaguccggccccggccucgucaagcccuccgagacccucucccucaccugcaccgucuccggcggcuccaucuccucccacuacugguccuggauccgccagucccccggcaagggccuccaguggaucggcuacaucuacuacuccggcuccaccaacuacucccccucccucaagucccgcgucaccaucuccgucgagaccuccaagaaccaguucucccucaagcucaccuccaugaccgccgccgacaccgccgucuacuacugcgcccgc

SEQ ID NO: 19296 - RNA, 714 nt, Artificial Sequence
  derived and/or modified sequence opt2 from anti-HIV_4P9M_HeavyChain
cagauccaccucguccaguccggcaccgaggucaagaagcccggcuccuccgucaccgucuccugcaaggccuacggcgucaacaccuucggccucuacgccgucaacuggguccgccaggcccccggccagucccucgaguacaucggccagaucuggcgcuggaaguccuccgccucccaccacuuccgcggccgcguccucaucuccgccgucgaccucaccggcuccuccccccccaucuccucccucgagaucaagaaccucaccuccgacgacaccgccgucuacuucugcaccaccaccuccaccuacgacaagugguccggccuccaccacgacggcgucauggccuucuccuccuggggccagggcacccucaucuccgucuccgccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacc

SEQ ID NO: 19297 - RNA, 645 nt, Artificial Sequence
  derived and/or modified sequence opt2 from anti-HIV_4P9M_LightChain
gacauccagaugacccagucccccuccacccucuccgccuccaucggcgacaccguccgcaucuccugccgcgccucccaguccaucaccggcaacugggucgccugguaccagcagcgccccggcaaggccccccgccuccucaucuaccgcggcgccgcccuccucggcggcguccccucccgcuucuccggcuccgccgccggcaccgacuucacccucaccaucggcaaccuccaggccgaggacuucggcaccuucuacugccagcaguacgacaccuaccccggcaccuucggccagggcaccaaggucgaggucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 19298 - RNA, 558 nt, Artificial Sequence
  derived and/or modified sequence opt2 from anti-HIV_4P9H_C-Chain
aagaaggucguccucggcaagaagggcgacaccgucgagcucaccugcaccgccucccagaagaaguccauccaguuccacuggaagaacuccaaccagaucaagauccucggcaaccagggcuccuuccucaccaagggccccuccaagcucaacgaccgcgccgacucccgccgcucccucugggaccagggcaacuucccccucaucaucaagaaccucaccaucgaggacuccgacaccuacaucugcgaggucgaggaccagaaggaggagguccagcuccucgucuucggccucaccgccaacuccgacacccaccuccuccagggccagucccucacccucacccucgaguccccccccggcuccucccccuccguccagugccgcuccccccgcggcaagaacauccagggcggcaagacccucuccgucucccagcucgagcuccaggacuccggcaccuggaccugcaccguccuccagaaccagaagaaggucgaguucaagaucgacaucgucguccucgccuuccagaaggccaucgacggccgc

SEQ ID NO: 19299 - RNA, 462 nt, Artificial Sequence
  derived and/or modified sequence opt2 from anti-HIV_4YBL_A-Chain
guccccgucuggaaggacgccgacaccacccucuucugcgccuccgacgccaaggcccacgagaccgagugccacaacgucugggccacccacgccugcguccccaccgaccccaacccccaggagauccaccucgagaacgucaccgagaacuucaacauguggaagaacaacauggucgagcagaugcaggaggacgucaucucccucugggaccagugccuccagcccggcggcgcccccaagaucuccuucgaccccauccccauccacuacugcacccccgccggcuacgucauccucaagugcaacgacaagaacuucaacggcaccggccccugcaagaacgucuccuccguccagugcacccacggcaucaagcccgucgucuccuccggcggcggcaacaucaaggacaacuggcgcuccgagcucuacaaguacaaggucguccagaucgag

SEQ ID NO: 19300 - RNA, 1056 nt, Artificial Sequence
  derived and/or modified sequence opt2 from anti-HIV_4R4N_V-Chain
aucuggaaggacgccaacaccacccucuucugcgccuccgacgccaaggccuacgacaccgagguccacaacgucugggccacccacgccugcguccccaccgaccccuccccccaggagcucaagauggagaacgucaccgaggaguucaacauguggaagaacaacauggucgagcagaugcacaccgacaucaucucccucugggaccagucccucaagcccugcguccagcucaccggcggcuccgcccucacccaggccugccccaaggucaccuucgagcccauccccauccacuacugcgcccccgccggcuacgccauccucaagugcaacgacaaggaguucaacggcaccggccucugcaagaacgucuccaccguccagugcacccacggcauccgccccgucgucuccacccagcuccuccucaacggcucccucgccgagggcaaggucaugauccgcuccgagaacaucaccaacaacgucaagaacaucaucguccagcucaacgaguccgucaccaucaacugcacccgccccaacaacggcggcuccggcuccggcggcgacauccgccaggcccacugcaacgucuccggcucccaguggaacaagacccuccaccaggucgucgagcagcuccgcaaguacuggaacaacaacaccaucaucuucaacuccuccuccggcggcgaccucgagaucaccacccacuccuucaacugcggcggcgaguucuucuacugcaacaccuccggccucuucaacuccaccugggucaacggcaccgccuccaucgagaacggcaccaucacccuccccugccgcaucaagcagaucaucaacauguggcagcgcgucggccaggccaucuacgccccccccauccagggcgucauccgcugcgucuccaacaucaccggccucauccucacccgcgacggcggcggcaacuccaacgagaacgagaccuuccgccccggcggcggcgacaugcgcgacaacuggcgcuccgagcucuacaaguacaaggucgucaagaucgag

SEQ ID NO: 19301 - RNA, 1065 nt, Artificial Sequence
  derived and/or modified sequence opt2 from anti-HIV_4JKP_G-Chain
gucuggaaggacgccgacaccacccucuucugcgccuccgacgccaaggcccacgagaccgagugccacaacgucugggccacccacgccugcguccccaccgaccccaacccccaggagauccaccucgagaacgucaccgagaacuucaacauguggaagaacaacauggucgagcagaugcaggaggacgucaucucccucugggaccagugccuccagcccugcgucaagcucaccggcggcuccgucaucaagcaggccugccccaagaucuccuucgaccccauccccauccacuacugcacccccgccggcuacgucauccucaagugcaacgacaagaacuucaacggcaccggccccugcaagaacgucuccuccguccagugcacccacggcaucaagcccgucgucuccacccagcuccuccucaacggcucccucgccgaggaggagaucaucauccgcuccgagaaccucaccaacaacgccaagaccaucaucguccaccucaacaaguccgucgagaucaacugcacccgccccuccaacggcggcuccggcuccggcggcgacauccgcaaggccuacugcgagaucaacggcaccaaguggaacaagguccucaagcaggucaccgagaagcucaaggagcacuucaacaacaagaccaucaucuuccagccccccuccggcggcgaccucgagaucaccaugcaccacuucaacugccgcggcgaguucuucuacugcaacaccacccagcucuucaacaacaccugcaucggcaacgagaccaugaagggcugcaacggcaccaucacccuccccugcaagaucaagcagaucaucaacauguggcagggcaccggccaggccauguacgccccccccaucgacggcaagaucaacugcgucuccaacaucaccggcauccuccucacccgcgacggcggcgccaacaacaccuccaacgagaccuuccgccccggcggcggcaacaucaaggacaacuggcgcuccgagcucuacaaguacaaggucguccagaucgagggcucc

SEQ ID NO: 19302 - RNA, 723 nt, Artificial Sequence
  derived and/or modified sequence opt2 from anti-HIV_3BQU_D-Chain
augggcugguccuggaucuuccucuuccuccucuccggcaccgccggcguccacuccggcguccagcuccagcaguccggccccgagcucgucaagcccggcgccuccgucaagauguccugcaaggccuccggcuacuccuucaccgacuacuucaugcacugggucaagcagucccacggcaagucccucgacuggaucggcuacaucaacugcuacaccggcgccaccaacuacucccagaaguucaagggcaaggccaccuucaccgucgacaccuccuccaacaccgccuacaugcaguucaacucccucaccuccgaggacuccgccgucuacuacugcgcccgcaccuccaucggcuacggcuccuccccccccuuccccuacuggggccagggcacccucgucaccgucuccgccgccaagaccaccccccccuccgucuacccccucgcccccggcuccgccgcccagaccaacuccauggucacccucggcugccucgucaagggcuacuuccccgagcccgucaccgucaccuggaacuccggcucccucuccuccggcguccacaccuuccccgccguccuccaguccgaccucuacacccucuccuccuccgucaccguccccuccuccccccgccccuccgagaccgucaccugcaacgucgcccaccccgccuccuccaccaaggucgacaagaagaucgucccccgc

SEQ ID NO: 19303 - RNA, 699 nt, Artificial Sequence
  derived and/or modified sequence opt2 from anti-HIV_3BQU_C-Chain
augaccauguucucccucgcccuccuccucucccuccuccuccucugcgucuccgacuccggcgccgagaccaccgucacccagucccccgccucccucuccauguccaucggcgagaaggucaccauccgcugcaucaccuccaccgacaucgacgacgacaugaacugguaccagcagaagcccggcgagcccccccgccuccucaucuccgacggcaacacccuccgccccggcguccccucccgcuucuccuccuccggcuacggcaccgacuucgucuucaccaucgagaacaugcucuccgaggacgucgccgacuacuacugccuccaguccgacaaccuccccuacaccuucggcggcggcaccaaccucgagaucaagcgcgccgacgccgcccccaccgucuccaucuucccccccuccuccgagcagcucaccuccggcggcgccuccgucgucugcuuccucaacaacuucuaccccaaggacaucaacgucaaguggaagaucgacggcuccgagcgccagaacggcguccucaacuccuggaccgaccaggacuccaaggacuccaccuacuccauguccuccacccucacccucaccaaggacgaguacgagcgccacaacuccuacaccugcgaggccacccacaagaccuccaccucccccaucgucaaguccuucaaccgc

SEQ ID NO: 19304 - RNA, 333 nt, Artificial Sequence
  derived and/or modified sequence opt2 from anti-HIV_Ig_LightChain
gacgucguccucacccagucccccgccucccucgccgucucccucggccagcgcgccaccaucuccugcaaggccucccaguccgucgacuacgacggcgacuccuacaugaacugguaccagcagaagcccggccagccccccaagcuccucauccacgccgccuccaaccucgucuccggcaugcccgcccgcuucuccggcuccggcuccggcaccgacuucacccucaacauccaccccgucgaggaggaggacgccgccaccuacuacugccagcaguccaucgaggacccccccaccuucggcggcggcaccaagcucgagaucaag

SEQ ID NO: 19305 - RNA, 342 nt, Artificial Sequence
  derived and/or modified sequence opt2 from anti-HIV_Ig_HeavyChain
gacguccagcuccagcaguccggccccggccucgucaagcccucccagucccucucccacaccugcaccgucaccggcuacuccaucaccuccgacuacgccuggaacuggauccgccaguuccccggcaacaagcucgaguggaugggcuacaucuccuucuccggcuccaccuccuacaaccccucccucaagucccgcaucuccaucacccgcgacaccuccaagaaccucuucuuccuccagcucaacuccgucaccaccgaggacaccgccaccuacuacugcgcccgcggccuccccgacuacuggggccagggcaccacccucaccgucuccucc

SEQ ID NO: 19306 - RNA, 1083 nt, Artificial Sequence
  derived and/or modified sequence opt2 from anti-HIV_4P9H_G-Chain
gucuggaaggacgccgacaccacccucuucugcgccuccgacgccaaggcccacgagaccgagugccacaacgucugggccacccacgccugcguccccaccgaccccaacccccaggagauccaccucgagcaggucaccgagaacuucaacauguggaagaacaacauggucgagcagaugcaggaggacgucaucucccucugggaccagugccuccagcccugcgucaagcucaccggcggcuccgucaucaagcaggccugccccaagaucuccuucgaccccauccccauccacuacugcacccccgccggcuacgucauccucaagugcaacgacaagaacuucaacggcaccggccccugcaagaacgucuccuccguccagugcacccacggcaucaagcccgucgucuccacccagcuccuccucaacggcucccucgccgaggaggagaucaucauccgcuccgagaaccucaccaacaacgccaagaccaucaucguccaccuccagaaguccgucgagaucaacugcacccgccccuccaacggcggcuccggcuccggcggcgacauccgcaaggccuacugcgagauccagggcaccaaguggaacaagguccucaagcaggucaccgagaagcucaaggagcacuucaacaacaagaccaucaucuuccagccccccuccggcggcgaccucgagaucaccaugcaccacuucaacugccgcggcgaguucuucuacugcaacaccacccagcucuuccagaacaccugcaucggcaacgagaccaugaagggcugcaacggcaccaucacccuccccugcaagaucaagcagaucaucaacauguggcagggcaccggccaggccauguacgccccccccaucgacggcaagaucaacugcgucucccagaucaccggcauccuccucacccgcgacggcggcgccaacaacaccuccaacgagaccuuccgccccggcggcggcaacaucaaggacaacuggcgcuccgagcucuacaaguacaaggucguccagaucgagggcucccaccaccaccaccaccac

SEQ ID NO: 19307 - RNA, 147 nt, Artificial Sequence
  derived and/or modified sequence opt2 from anti-HIV_Chain
cagguccagcucguccaguccggcggccagaugaagaagcccggcgaguccaugcgcaucuccugccgcgccuccggcuacgaguucaucgacugcacccucaacuggauccgccucgcccccggcaagcgccccgaguggaugggc

SEQ ID NO: 19308 - RNA, 180 nt, Artificial Sequence
  derived and/or modified sequence opt2 from anti-HIV_Chain
cccugcugcuucgccuacaucgcccgcccccucccccgcgcccacaucaaggaguacuucuacaccuccggcaagugcuccaaccccgccgucgucuucgucacccgcaagaaccgccaggucugcgccaaccccgagaagaaguggguccgcgaguacaucaacucccucgagaugucc

SEQ ID NO: 19309 - RNA, 249 nt, Artificial Sequence
  derived and/or modified sequence opt2 from anti-HIV_Chain
cucgaguggaugggccgcaucauccccgccaucgacgacgucaccuacgcccagaccuuccgcggccgcgucaccuucuccgccgacaaguucaccaccaccgccuacauggaccucaccggccuccgcuccgaggacaccgccaccuacuucugcgcccgcgacccccaggucaaccgccgcggcaacugcuucgaccacuggggccagggcacccucgucaccgucuccuccgccuccaccaagggc

SEQ ID NO: 19310 - RNA, 270 nt, Artificial Sequence
  derived and/or modified sequence opt2 from anti-HIV_Chain
gacgucgucaugacccaguccccccucucccuccccgucacccucggccagcccgccuccaucuccugccgcuccucccagucccucgucuacucccacggcgacaccuaccucaagugcuuccagcagcgccccggccaguccccccgccgccccaucuacaaggucuccaaccgcgacuccggcguccccgaccgcuucuccggcuccggcuccggcaccgacuucacccucaagaucucccgcgucgaggccgaggacgucggcguc

SEQ ID NO: 19311 - RNA, 294 nt, Artificial Sequence
  derived and/or modified sequence opt2 from anti-HIV_Chain
uccuccuucgccaucuccuggguccgccaggcccccggccagggccucgaguggaugggcggcaucauccccaucuucgaggccaccuccuacgcccagaaguuccaggaccgccucaccaucaccaccgacgaguccaccaccaccgccuacauggaccucuccucccuccgcuccgaggacaccgccgucuacuacugcgcccgcgcccagggcgacauccucaccgagggcuacuucgacuacuggggccagggcacccucgucaccgucuccuccgccuccaccaagggc

SEQ ID NO: 19312 - RNA, 297 nt, Artificial Sequence
  derived and/or modified sequence opt2 from anti-HIV_Chain
aacaccuucaccucccacuacguccacuggguccgccaggcccccggccagggccucgaguggaugggcaugaucaaccccggcggcaccacccgcuacgcccccaaguuccaggaccgcgucacccucacccgcgacaccuccacccgcaccgucuacauggagcuccgcucccuccgcuccgaggacaccgccgucuacuacugcgcccgcccccaguacaaccucggccgcgagccccucaacgucuggggccagggcaccauggucaccgucuccuccgccuccaccaagggc

SEQ ID NO: 19313 - RNA, 297 nt, Artificial Sequence
  derived and/or modified sequence opt2 from anti-HIV_Chain
auccgcuccuucuacuggcacuggauccgccagucccccggcaagggccucgaguggcucggcuccgucuucgacaacggccucaccacccacaaccccucccucaagucccgccucaccaucuccgaggaccccucccgcaaccagaucucccucaagcuccgcuccaugaccgccgccgacaccgccgucuacuacugcgcccgcggcgacuacgacauccucaccuccuccuaccaguucgacuacuggggccagggcacccucgucgccgucuccuccgccuccaccaagggc

SEQ ID NO: 19314 - RNA, 300 nt, Artificial Sequence
  derived and/or modified sequence opt2 from anti-HIV_Chain
caguccgcccucacccagcccgccuucgucuccggcucccccggccaguccaucacccucuccugcacccucggcaccgaggacgucuccugguaccagcagcgccccaacuccgccccccgccucaucaucuucgacgucaagaagcgccccuccgacgucuccgaccgcuucuccggccacaacuccgacaccgccgccuuccucaccaucuccgagcuccgccccgaggacgaggccgacuacuucugcaccuccuggcccuaccgcuucgaccgcggcaccaaggucgacgucgcc

SEQ ID NO: 19315 - RNA, 300 nt, Artificial Sequence
  derived and/or modified sequence opt2 from anti-HIV_Chain
caguccgcccucacccagcccgccuucgucuccggcucccccggccaguccaucacccucuccugcacccucggcaccgaggacgucuccugguaccagcagcgccccaacuccgccccccgccucaucaucuucgacgucaagaagcgccccuccgacgucuccgaccgcuucuccggccacaacuccgacaccgccgccuuccucaccaucuccgagcuccgccccgaggacgaggccgaguacuucugcaccuccuggcccuaccgcuucggccgcggcaccaaggucgacgucgcc

SEQ ID NO: 19316 - RNA, 300 nt, Artificial Sequence
  derived and/or modified sequence opt2 from anti-HIV_Chain
caguccgcccucacccaccccgccuucgucuccggcucccccggccaguccaucacccucuccugcacccucggcaccgaggacgucuccugguaccagcagcgccccaacuccgccccccgccucaucaucuucgacguccgcaagcgccccuccgaggucuccgaccgcuucuccggccacaaguccgacaccgccgccuuccucaccaucuccgaccuccgccccgaggacgaggccgaguacuucugcaccuccuggcccuaccgcuucgaccgcggcacccgccucgacgucgcc

SEQ ID NO: 19317 - RNA, 300 nt, Artificial Sequence
  derived and/or modified sequence opt2 from anti-HIV_Chain
caguccguccucacccagcccgccuucgucuccggcucccccggccaguccaucaccaucuccugcaccgucggcaccaccgacgucuccugguaccagcagcgccccaacuccgccccccgccucaucaucuucgacgucaagaagcgccccuccggcgucuccgaccgcuucuccggcuccuccuccgacaacgccgccuuccucaccaucgccggccuccgccccgaggacgaggccgaguacuacugcaccuccuggcccuaccgcuucggccgcggcaccaaggucgacgucggc

SEQ ID NO: 19318 - RNA, 300 nt, Artificial Sequence
  derived and/or modified sequence opt2 from anti-HIV_Chain
caguccguccucacccagcccgccuucgucuccgccucccccggccaguccaucacccucuccugcaaccucggcaccgacuacgucuccugguaccagcagcgccccuccuccgccccccgccucaucaucuucgacgucaagaaccgccccuccggcgucuccgaccgcuucuccggcuacaacuccgacaccgccgccuuccucaccaucuccggccuccagcccgaggacgaggccgaguacuacugcaccuccuggcccuacaacuucggccccggcaccaaggucgacgucacc

SEQ ID NO: 19319 - RNA, 300 nt, Artificial Sequence
  derived and/or modified sequence opt2 from anti-HIV_Chain
caguccguccucacccagcccgccuccgucuccggcucccccggccaguccaucaacaucuccugcgccggccgcuccgaccgcgucuccugguaccagcagcgccccaacggcguccccaagcuccuccucuucgacgucuaccgccgccccuccggcgucuccgaccgcuucuccggcucccacuccgacgacaccgccuuccucaccaucuccggccuccagaccgacgacgaggccgacuacuacugcaccucccaccccuacgccuucggccccggcaccaaggucaacguccuc

SEQ ID NO: 19320 - RNA, 300 nt, Artificial Sequence
  derived and/or modified sequence opt2 from anti-HIV_Chain
caguccguccucacccagcccgccuucgucuccggcucccccggccaguccaucacccucuccugcacccucggcaccgaggacgucuccugguaccagcagcgccccaacuccgccccccgccucaucaucuucgacgucaagaagcgccccuccgacgucuccgaccgcuucuccggccacaacuccgacaccgccgccuuccucaccaucuccgagcuccgccccgaggacgaggccgaguacuucugcaccuccuggcccuaccgcuucggccgcggcaccaaggucgacgucgcc

SEQ ID NO: 19321 - RNA, 306 nt, Artificial Sequence
  derived and/or modified sequence opt2 from anti-HIV_Chain
caguccgcccucacccagcccgccuccgucuccggcucccccggccaguccaucaccaucuccugcaccgccgacuccgacuacgucuccugguaccagcagcgccccaacuccgcccccaagcucauccucuucgacgucaacucccgccccuccggcgucuccgaccgcuacuccggcucccgcuccggcaacaccgccucccucaccaucuccggccuccagcgcgaggacgaggccgacuacuucugcacccccuggcccuacgacuuccgccccggcacccgcgucuucguccucggccag

SEQ ID NO: 19322 - RNA, 306 nt, Artificial Sequence
  derived and/or modified sequence opt2 from anti-HIV_Chain
caguccgcccucacccagcccgccuucgucuccggcucccccggccaguccaucacccucuccugcucccucggcaccgccgacgucuccugguaccagcagcgccccaacuccgccccccgccucaucaucuucgacgucaagaagcgccccuccgacgucuccgaccgcuucuccggccacaacuccgacaccgccgccuucgucaccaucuccgagcuccgccccgaggacgaggccgaguacuucugcaccuccuggcccuaccgcuucggccccggcaccaaggucgacgucgcccgccag

SEQ ID NO: 19323 - RNA, 306 nt, Artificial Sequence
  derived and/or modified sequence opt2 from anti-HIV_Chain
caguccguccucacccagcccgccuccgucuccggcucccccggccagaccaucuccaucuccugcuccggcaccuucggcuccgacuccgucuccugguaccagcaguuccccaacuccgcccccacccucaucaucuucgacguccaccgccgccccuccggcaucuccacccgcuucuccggcuccaccuccggcgacaccgccucccucaccaucuccacccuccaccgcgaggacgaggccuucuacuacugcaccucccaccccuacgacuucggcggcggcaccuacgucaucguccuc

SEQ ID NO: 19324 - RNA, 306 nt, Artificial Sequence
  derived and/or modified sequence opt2 from anti-HIV_Chain
caguccguccucacccagcccgccuccgucuccggcucccccggccagaccaucuccaucuccugcuccggcaccuucggcuccgacuccgucuccugguaccagcaguaccccaacuccgcccccacccucaucaucuucgacguccaccgccgccccuccggcaucuccacccgcuucuccggcuccaccuccggcgacaccgccucccucaccaucuccacccuccaccgcgaggacgaggccuacuacuacugcaccucccaccccuacgacuucggcggcggcaccuacgucaucguccuc

SEQ ID NO: 19325 - RNA, 306 nt, Artificial Sequence
  derived and/or modified sequence opt2 from anti-HIV_Chain
caguccgcccucacccagcccgccuccgucuccggcucccccggccaguccaucaacaucuccugcgccggccgcuccgaccgcgucuccugguaccagcagcgccccaacggcguccccaagcuccucauguucgacgucuaccgccgccccuccggcgucuccgaccgcuucuccggcucccacuccggcgacaccgccuuccucaccaucuccggccuccagaccgaggacgaggccgacuacuacugcaccucccaccccuacgccuucggcgccggcaccaaggucaacguccuccgccag

SEQ ID NO: 19326 - RNA, 306 nt, Artificial Sequence
  derived and/or modified sequence opt2 from anti-HIV_Chain
gacauccagaugacccagucccccuccucccucuccgccuccgucggcgaccgcgucuccauccacugccaggccggccagggcaucggcuccucccucaacugguaccagcagaagcccggccgcgccccccgccuccucguccacggcgccuccaaccuccagcgcggcguccccucccgcuucuccggcuccggcuuccacaccaccuucacccucaccaucuccucccuccagcccgacgacgucgccaccuacuggugcgccgcccucgaguucuucggccccggcaccaaggucgagauc

SEQ ID NO: 19327 - RNA, 309 nt, Artificial Sequence
  derived and/or modified sequence opt2 from anti-HIV_Chain
gacauccagaugacccagucccccuccucccucuccgccuccgucggcgacaccgucaccaucaccugccaggccaacggcuaccucaacugguaccagcagcgccgcggcaaggcccccaagcuccucaucuacgacggcuccaagcucgagcgcggcguccccucccgcuucuccggccgccgcuggggccaggaguacaaccucaccaucaacaaccuccagcccgaggacaucgccaccuacuucugccaggucuacgaguucgucguccccggcacccgccucgaccucaagcgcaccgucgcc

SEQ ID NO: 19328 - RNA, 309 nt, Artificial Sequence
  derived and/or modified sequence opt2 from anti-HIV_Chain
gacauccagaugacccagucccccuccucccucuccgcccgcgucggcgacaccgucaccaucaccugccaggccaacggcuaccucaacugguaccagcagcgccgcggcaaggcccccaagcuccucaucuacgacggcuccaagcucgagcgcggcguccccgcccgcuucuccggccgccgcuggggccaggaguacaaccucaccaucaacaaccuccagcccgaggacgucgccaccuacuucugccaggucuacgaguucaucguccccggcacccgccucgaccucaagcgcaccgucgcc

SEQ ID NO: 19329 - RNA, 309 nt, Artificial Sequence
  derived and/or modified sequence opt2 from anti-HIV_Chain
gacauccagaugacccagucccccuccucccucuccgcccgcgucggcgacaccgucaccaucaccugccaggccaacggcuaccucaacugguaccagcagcgccgcggcaaggcccccaagcuccucaucuacgacggcuccaagcucgagcgcggcguccccucccgcuucuccggccgccgcuggggccaggaguacaaccucaccaucaacaaccuccagcccgaggacaucgccaccuacuucugccaggucuacgaguucgccguccccggcacccgccucgaccucaagcgcaccgucgcc

SEQ ID NO: 19330 - RNA, 309 nt, Artificial Sequence
  derived and/or modified sequence opt2 from anti-HIV_Chain
gacauccagaugacccagucccccuccucccucuccgccuccgucggcgacaccgucaccaucaccugccaggccaacggcuaccucaacugguaccagcagcgccgcggcaaggcccccaagcuccucaucuacgacggcuccaagcucgagcgcggcguccccucccgcuucuccggccgccgcuggggccaggaguacaaccucaccaucaacaaccuccaggccgaggacaucgccaccuacuucugccaggucuacgaguucgccguccccggcacccgccucgaccucaagcgcaccgucgcc

SEQ ID NO: 19331 - RNA, 309 nt, Artificial Sequence
  derived and/or modified sequence opt2 from anti-HIV_Chain
gacauccagaugacccagucccccuccucccucuccgccuccgucggcgacaccgucaccaucaccugccaggccaacggcuaccucaacugguaccagcagcgccgcggcaaggcccccaagcuccucaucuacgacggcuccaagcucgagcgcggcguccccucccgcuucuccggccgccgcuggggccaggaguacaaccucaccaucaacaaccuccagcccgaggacaucgccaccuacuucugccaggucuacgaguucaucguccccggcacccgccucgaccucaagcgcaccgucgcc

SEQ ID NO: 19332 - RNA, 309 nt, Artificial Sequence
  derived and/or modified sequence opt2 from anti-HIV_Chain
gacauccagaugacccagucccccuccucccucuccgcccgcgucggcgacaccgucaccaucaccugccaggccaacggcuaccucaacugguaccagcagcgccgcggcaaggcccccaagcuccucaucuacgacggcuccaagcucgagaccggcguccccucccgcuucaccggccgccgcuggggccaggaguacaaccucaccaucaacaaccuccagcccgaggacaucgccaccuacuucugccaggucuacgaguucaucguccccggcacccgccucgaccucaagcgcaccgucgcc

SEQ ID NO: 19333 - RNA, 312 nt, Artificial Sequence
  derived and/or modified sequence opt2 from anti-HIV_Chain
gacauccagaugacccagucccccuccucccucuccgccuccgucggcgacaaggucaccaucaccugccagaccuccgccggcuaccucaacugguaccagcagcgccgcggccgcgcccccaagcuccucauguacgacggcucccgccucgucaccggcguccccucccgcuucuccggccgccgcuggggcacccaguacaaccucaccaucggcucccuccagcccgaggacgucgccaccuacuacugccaggucuacgaguucuucggccccggcacccgccucgaccucaagcgcaccgucgcc

SEQ ID NO: 19334 - RNA, 312 nt, Artificial Sequence
  derived and/or modified sequence opt2 from anti-HIV_Chain
gacauccagaugacccagucccccuccucccucuccgccuccgucggcgacaaggucaccaucaccugccagaccuccgccggcuaccucaacugguaccagcagcgccgcggccgcgcccccaagcuccucauguacgacggcucccgccucgucaccggcguccccucccgcuucuccggccgccgcuggggcacccaguacaaccucaccaucggcucccuccagcccgaggacaucgccaccuacuacugccaggucuacgaguucuucggccccggcacccgccucgaccucaaguccaccgucgcc

SEQ ID NO: 19335 - RNA, 312 nt, Artificial Sequence
  derived and/or modified sequence opt2 from anti-HIV_Chain
gacauccagaugacccagucccccuccucccucuccgcccgcgucggcgacaccgucaccaucaccugccaggccaacggcuaccucaacugguaccagcagcgccgcggcaaggcccccaagcuccucaucuacgacggcuccaagcucgagcgcggcguccccgcccgcuucuccggccgccgcuggggccaggaguacaaccucaccaucaacaaccuccagcccgaggacgucgccaccuacuucugccaggucuacgaguucaucguccccggcacccgccucgaccucaagcgcaccgucgccgcc

SEQ ID NO: 19336 - RNA, 312 nt, Artificial Sequence
  derived and/or modified sequence opt2 from anti-HIV_Chain
ugcaccgucuccggcggcuccaucaucuccuacuacuggaacuggauccgccagucccccggcaagggccucgaguggcucggcuacaucuucgacggcggccgcgccaacuacaaccccucccuccgcucccgccucaccauguccgucgacaccuccaagaaccagaucucccucaaggucaaguccgucaccgccgccgacuccgccaucuacuacugcgcccgccucgacggcgaggccuuccgcuacuacuucgacuccuggggccagggcacccucgucaccgucuccuccgccuccaccaagggc

SEQ ID NO: 19337 - RNA, 312 nt, Artificial Sequence
  derived and/or modified sequence opt2 from anti-HIV_Chain
gucuccggcggccgcuucuccaacuacggccucuccuggguccgccaggcccccggccagggccucgaguggaugggccgcaucguccccgccaucaaccgcgccaaguacgcccagaaguuccagggccgcgucauccucaccgccgacaagaucaccgacaccgccuacauggagcuccgcucccuccgcuccgaggacaccgccaucuucuacugcgcccgcgacccccagaucgagauccgcggcaacgccuucgacaucuggggccagggcaccgucgucaccgucuccuccgccuccaccaagggc

SEQ ID NO: 19338 - RNA, 315 nt, Artificial Sequence
  derived and/or modified sequence opt2 from anti-HIV_Chain
uccgacaucuccgucgcccccggcgagaccgcccgcaucuccugcggcgagaagucccucggcucccgcgccguccagugguaccagcaccgcgccggccaggcccccucccucaucaucuacaacaaccaggaccgccccuccggcauccccgagcgcuucuccggcucccccgacucccccuucggcaccaccgccacccucaccaucaccuccgucgaggccggcgacgaggccgacuacuacugccacaucugggacucccgcguccccaccaagugggucuucggcggcggcaccacccucaccguccuc

SEQ ID NO: 19339 - RNA, 315 nt, Artificial Sequence
  derived and/or modified sequence opt2 from anti-HIV_Chain
uccuccauguccgucucccccggcgagaccgccaagaucuccugcggcaaggaguccaucggcucccgcgccguccagugguaccagcagaaguccggccagccccccucccucaucaucuacaacaaccaggaccgccccuccggcguccccgagcgcuucuccgccacccccgacuucggcgccggcaccaccgccacccucaccaucaccaacgucgaggccgacgacgaggccgacuacuacugccacaucuacgacgcccgcggcggcaccaacugggucuucgaccgcggcgccacccucaccguccuc

SEQ ID NO: 19340 - RNA, 315 nt, Artificial Sequence
  derived and/or modified sequence opt2 from anti-HIV_Chain
uccuucgucuccgucgcccccggccagaccgcccgcaucaccugcggcgaggagucccucggcucccgcuccgucaucugguaccagcagcgccccggccaggcccccucccucaucaucuacaacaacaacgaccgccccuccggcauccccgagcgcuucuccggcucccccggcuccaccuucggcaccaccgccacccucaccaucaccuccgucgaggccggcgacgaggccgacuacuacugccacaucugggacucccgccgccccaccaacugggucuucggcgagggcaccacccucaccguccuc

SEQ ID NO: 19341 - RNA, 315 nt, Artificial Sequence
  derived and/or modified sequence opt2 from anti-HIV_Chain
uccuucgucuccgucgcccccggccagaccgcccgcaucaccugcggcgaggagucccucggcucccgcuccgucaucugguaccagcagcgccccggccaggcccccucccucaucauguacaacaaccacgaccgccccuccggcauccccgagcgcuucuccggcucccccggcuccaccuucggcaccaccgccacccucaccaucaccuccgucgaggccggcgacgaggccgacuacuacugccacaucugggacucccgccgccccaccaacugggucuucggcgagggcaccacccucaccguccuc

SEQ ID NO: 19342 - RNA, 315 nt, Artificial Sequence
  derived and/or modified sequence opt2 from anti-HIV_Chain
gacauccagaugacccagucccccuccucccucuccgccuccgucggcgacaaggucaccaucaccugccagaccuccgccggcuaccucaacugguaccagcagcgccgcggccgcgcccccaagcuccucauguacgacggcucccgccucgucaccggcguccccucccgcuucuccggccgccgcuggggcacccaguacaaccucaccaucggcucccuccagcccgaggacaucgccaccuacuacugccaggucuacgaguucuucggccccggcacccgccucgaccucaaguccaccgucgccgcc

SEQ ID NO: 19343 - RNA, 315 nt, Artificial Sequence
  derived and/or modified sequence opt2 from anti-HIV_Chain
gacauccagaugacccagucccccuccucccucuccgccuccgucggcgaccgcgucuccaucaacugccaggccggccagggccucggcuccucccucaacugguaccagcagaagcccggccgcgcccccaagcuccucguccacggcgccuccaaccuccagcgcggcguccccucccgcuucuccggcuccggcuuccacaccaccuucacccucaccaucuccucccuccagcccgacgacgucgccaccuacuucugcgccgccuuccagugguucggccccggcaccaaggucgagaucaagcgcacc

SEQ ID NO: 19344 - RNA, 318 nt, Artificial Sequence
  derived and/or modified sequence opt2 from anti-HIV_Chain
ugcaccgucuccggcggcuccaucuccuccgccggcuacuacuggaccuggauccgccagcaccccggcaagggccucgaguucaucggcuacaucuacuacaucggcaccaccuacuacaaccccucccucaagucccgccucaccaucuccaucgacaccuccaagaaccaguucucccucaagcucuccuccgucaccgccgccgacaccgccaucuacuacugcgcccgcgacuacaccgcccgcggccgccacuucuucgacuacuggggccagggcgcccucgucaccgucuccuccgccuccaccaagggc

SEQ ID NO: 19345 - RNA, 321 nt, Artificial Sequence
  derived and/or modified sequence opt2 from anti-HIV_Chain
uccucccucccccucucccucgcccccggcgccaccgccaagauccccugcggcgagaagucccgcggcucccgcgccguccagugguaccagcagaagcccggccaggcccccacccucaucaucuacaacaaccaggaccgccccgccggcgucuccgagcgcuacuccggcaaccccgacgucgccaucggcgucaccgccacccucaccaucucccgcgucgaggccggcgacgaggccgaguacuacugccacuacugggacucccgcucccccaucuccugggucuucggcggcuggacccagcucaccguccuc

SEQ ID NO: 19346 - RNA, 321 nt, Artificial Sequence
  derived and/or modified sequence opt2 from anti-HIV_Chain
uccucccucccccucuccgucgcccccggcgccaccgccaagaucgccugcggcgagaaguccuucgccucccgcgccguccagugguaccagcagaagcccggccaggcccccguccucaucaucuacaacaaccaggaccgccccgccggcgucuccgagcgcuucuccggcacccccgacgucggcuucggcuccaccgccacccucaccaucucccgcgucgaggccggcgacgaggccgacuacuacugccacaagugggacucccgcuccccccucuccugggucuucggcggcggcacccagcucaccguccuc

SEQ ID NO: 19347 - RNA, 321 nt, Artificial Sequence
  derived and/or modified sequence opt2 from anti-HIV_Chain
gacauccagaugacccagucccccuccucccucuccgccuccaucggcgaccgcgucaccaucaccugccgcgccucccaggacaucgccaacuaccucaacugguaccagaagaaguccggcaccccccccaagcuccucaucuucgccgccaccaaccuccaccgcggcgucuccccccgcuucaccggcuccggccacggcacccacuucucccucaccaucaccaacguccagcacgaggacuucggcaacuacuucugccagcaguccuucgccaccgucggcuccuucggccagggcaccugggucgacauccgc

SEQ ID NO: 19348 - RNA, 321 nt, Artificial Sequence
  derived and/or modified sequence opt2 from anti-HIV_Chain
gacauccagaugacccagucccccuccucccucuccgccuccaucggcgaccgcgucaccaucaccugccgcgccucccaggacaucgccaacuaccucaacugguaccagaagaaguccggcaccccccccaagcuccucaucuucgccgccaccaaccuccaccgcggcgucuccccccgcuucaccggcuccggccacggcacccacuucucccucaccaucaccaacguccagcacgaggacuucggccacuacuucugccagcaguccuucgccaccgucggcuccuucggccagggcaccugggucgacauccgc

SEQ ID NO: 19349 - RNA, 321 nt, Artificial Sequence
  derived and/or modified sequence opt2 from anti-HIV_Chain
gacauccagaugacccagucccccuccucccucuccgccuccgucggcgaccgcgucaccaucaccugccgcgccucccaggacaucgccaacuaccucaacugguaccagaagaaguccggcaccccccccaagcuccucaucuucgccgccaccaaccuccaccgcggcgucuccccccgcuucuccggcuccggcuccggcacccacuucucccucaccaucaccaacguccaguacgaggacuucgccaacuacuucugccagcacuccuucggcaccaucggcaccuucggccagggcaccugggucgacauccgc

SEQ ID NO: 19350 - RNA, 321 nt, Artificial Sequence
  derived and/or modified sequence opt2 from anti-HIV_Chain
gacauccagaugacccagucccccuccucccucuccgccuccaucggcgaccgcgucaccaucaccugccgcgccucccaggacaucgccaacuaccucaacugguaccagaagaaguccggcaccccccccaagcuccucaucuucggcgccaccaaccuccaccacggcgucuccccccgcuucuccggcuccggccacggcacccacuucucccucaccaucaccaacguccagcacgaggacuucgccaacuacuucugccagcaguccuuccagaccgucggcuccuucggccagggcaccugggucgacauccgc

SEQ ID NO: 19351 - RNA, 321 nt, Artificial Sequence
  derived and/or modified sequence opt2 from anti-HIV_Chain
gagaucguccucacccagucccccgccacccucucccucucccccggcgagaccgccaucaucuccugccgcaccucccaguccggcucccucgccugguaccagcagcgccccggccaggccccccgccucgucaucuacuccggcuccacccgcgccgccggcauccccgaccgcuucuccggcucccgcuggggcgccgacuacaaccucuccaucuccaaccucgaguccggcgacuucggcgucuacuacugccagcaguacgaguucuucggccagggcaccaagguccaggucgacaucaagcgcaccgucgcc

SEQ ID NO: 19352 - RNA, 321 nt, Artificial Sequence
  derived and/or modified sequence opt2 from anti-HIV_Chain
gacauccagaugacccagucccccuccucccucuccgccuccaucggcgaccgcgucaacaucaccugccaggccucccgcgacaccggcuccgcccucaacugguaccagcagaaggucggccgccccccccgccuccucaucuccgccgucuccaaccucggcgccggcguccccucccgcuucuccggccgccgcuccggcacccaguccacccucaccaucaacacccuccagcccgaggacaucgccaccuacuucugccagcacuacgaguucuucggccccggcaccaaggucgacaucaagcgcaccgucgcc

SEQ ID NO: 19353 - RNA, 321 nt, Artificial Sequence
  derived and/or modified sequence opt2 from anti-HIV_Chain
gacauccagaugacccagucccccuccucccucuccgccuccgucggcgaccgcgucaccaucaccugccaggccggccagggcaucggcuccucccuccagugguaccagcagaagcccggcaaggcccccaagcuccucguccacggcgccuccaaccuccaccgcggcguccccucccgcuucuccggcuccggcuuccacaccaccuucucccucaccaucuccggccuccagcgcgacgacuucgccaccuacuucugcgccguccucgaguucuucggccccggcaccaaggucgagaucaagcgcaccgucgcc

SEQ ID NO: 19354 - RNA, 324 nt, Artificial Sequence
  derived and/or modified sequence opt2 from anti-HIV_Chain
uccuacguccgcccccucuccgucgcccucggcgagaccgccuccaucuccugcggccgccaggcccucggcucccgcgccguccagugguaccagcaccgccccggccaggcccccauccuccucaucuacaacaaccaggaccgccccuccggcauccccgagcgcuucuccggcacccccgacaucaacuucggcacccgcgccacccucaccaucuccggcgucgaggccggcgacgaggccgacuacuacugccacaugugggacucccgcuccggcuucuccugguccuucggcggcgccacccgccucaccguccuc

SEQ ID NO: 19355 - RNA, 324 nt, Artificial Sequence
  derived and/or modified sequence opt2 from anti-HIV_LightChain
gacauccucaugacccagucccccucccuccucuccgccuccgucggcgaccgcgucaccaucaccugcaaggccucccaggacgucuccaccgccgucgccugguaccagcagaagcccggcaaggcccccaagcuccucaucuacugggccuccacccgccacaccggcguccccucccgcuucaccggcuccggcuccggcaccgacuucacccucaccaucucccgccuccaggccgaggacuucgcccucuacuacugccagcagcacuacaccacccccuggaccuucggcggcggcaccaaggucgagaucaagcgc

SEQ ID NO: 19356 - RNA, 324 nt, Artificial Sequence
  derived and/or modified sequence opt2 from anti-HIV_LightChain
gacaucgucaugacccagucccccucccuccucuccgccuccgucggcgaccgcgucaccaucaccugcaaggccucccaggacgucuccaccgccgucgccugguaccagcagaagcccggcaaggcccccaagcuccucaucuacugggccuccacccgccacaccggcguccccucccgcuucuccggcuccggcuccggcaccgacuucacccucaccaucuccucccuccagcccgaggacuucgcccucuacuacugccagcagcacuacaccacccccuggaccuucggcggcggcaccaaggucgagaucaagcgc

SEQ ID NO: 19357 - RNA, 324 nt, Artificial Sequence
  derived and/or modified sequence opt2 from anti-HIV_Chain
gacauccagaugacccagucccccuccucccucuccgccuccgucggcgacaccgucaccaucaacugccagaccaacaagggcuaccucaacugguaccagcagcgccgcggccgcgcccccaagcuccucauguacgacggcuccaagcucgucaccggcguccccucccgcuucuccggccgccgcuggggcacccaguacaaccucaccaucggcucccuccagcccgaggacaucgccaccuacuacugccaggucuacgaguucuucggccccggcacccgccucgaccucaagcgcaccgucgccgcccccuccgac

SEQ ID NO: 19358 - RNA, 333 nt, Artificial Sequence
  derived and/or modified sequence opt2 from anti-HIV_Chain
cucuccgccuacgucggcgaccgcgucaccaucaccugccgcgccucccagaacaucaacaccuaccucaacugguaccagcagcgccccggcaaggcccccaagcuccucaucuacgccgccuccacccuccaguccggcguccccucccgcuucuccggcuccggcuccggcaccgacuucacccucaccaucuccaaccucgagaccgaggacuucgccgucuacuacugccagcagaccuacuccuccgucaccuucggccagggcaccaagcucgagacccgccgcaccgucgccgcccccuccgucuucaucuucccccccuccgac

SEQ ID NO: 19359 - RNA, 333 nt, Artificial Sequence
  derived and/or modified sequence opt2 from anti-HIV_Chain
gagaucguccucacccagucccccgccacccucucccucucccccggcgagcgcgccacccucuccugccgcgccucccagggcgucaacuucgucgucugguaccagcagaagcgcggccaggccccccgccuccucaucuacggcaacuccgaccgcguccccggcguccccgaccgcuucuccgcccgcggcuccggcaccgaguucucccucgucaucuccuccgucgagcccgacgacuucgcccucuacuacugccaggaguacuccuccacccccuacaacuucggccccggcacccgcgucgaccgcaagcgcaccgucgccgcc

SEQ ID NO: 19360 - RNA, 336 nt, Artificial Sequence
  derived and/or modified sequence opt2 from anti-HIV_HeavyChain
gaggucaagcucgaggaguccggcggcggccucguccagcccggcggcucccgcaagcucuccugcgccgccuccggcuucaccuucuccuccuucggcaugcacuggguccgccaggcccccgagaagggccucgagugggucgccuacaucuccuccggcuccuccacccuccacuacgccgacaccgucaagggccgcuucaccaucucccgcgacaaccccaagaacacccucuuccuccagaugaagcuccccucccucugcuacggccuccucggcucccgcaaccucucccaccgccuccucucccagaacgacacccccaucugccuc

SEQ ID NO: 19361 - RNA, 336 nt, Artificial Sequence
  derived and/or modified sequence opt2 from anti-HIV_Chain
gagaucguccucacccagucccccgccacccucucccucucccccggcgagcgcgccacccucuccugccgcgccucccagggcgucaacuucgucgucugguaccagcagaagcgcggccaggccccccgccuccucaucuacggccccuccgaccgcgcccccggcguccccgaccgcuucuccgcccgcggcuccggcaccgaguucucccucgucaucuccuccgucgagcccgacgacuucgcccucuacuacugccaggaguacuccuccacccccuacaacuucggcaccggcacccgcgucgaccgcaagcgcaccgucgccgccccc

SEQ ID NO: 19362 - RNA, 336 nt, Artificial Sequence
  derived and/or modified sequence opt2 from anti-HIV_Chain
cagacccucucccucaccugcuccgucuccggcggcuccaucuccuccgccggcuacuacuggggcuggauccgccagcaccccggcaagggccucgaguggaucggccacaucuacuacuccggcaacaccaacuacaaccccucccucaagucccgccucuccauguccgucgagaccuccaagaaccaguucucccucaaccucgccuccgucaccgccgccgacaccgccgucuacuucugcgcccgcgacuacuccgccgccggccgccaccucuucgacuccuggggccagggcauccucgucaccgucuccuccgccuccaccaagggc

SEQ ID NO: 19363 - RNA, 336 nt, Artificial Sequence
  derived and/or modified sequence opt2 from anti-HIV_LightChain
gacaucgucaugacccagcagaccccccucacccucuccaucaccaucggccagcccgccuccaucuccugcaaguccucccagucccuccucgacuccgacggcaagaccuaccucaacuggcuccuccagcgccccggccagucccccaagcgccucaucuacuggauguccaagcucgacuccggcguccccgaccgcuucaccggcuccggcuccggcaccgacuucacccucaagaucucccgcgucgaggccgaggaccucggcgucuacuacugcuggcagggcacccacuuccccuggaccuucggcggcggcaccaagcucgagcuc

SEQ ID NO: 19364 - RNA, 339 nt, Artificial Sequence
  derived and/or modified sequence opt2 from anti-HIV_LightChain
gacaucgucaucacccaguccaccaaguucauguccaccuccgucggcgaccgcgucuccaucaccugcaaggccucccaggacgucuccaccgccgucgccugguaccagcagaagcccggccagucccccaagcuccucaucuacugggccuccacccgccacaccggcguccccgaccgcuucaccggcuccggcuccggcaccgacuacacccucaccaucucccgcguccaggccgaggaccucgcccucuacuacugccagcagcacuacaccacccccuggaccuucggcggcggcaccaagcucgagaucaagcgcaccgucgccgccccc

SEQ ID NO: 19365 - RNA, 339 nt, Artificial Sequence
  derived and/or modified sequence opt2 from anti-HIV_Chain
gacauccagaugacccagucccccuccucccucuccgcccgcgucggcgacaccgucaccuucaccugccaggccaacggcuaccucaacugguaccagcagcgccgcggcaaggcccccaagcuccucaucuacgacggcuccaagcucgagcgcggcguccccucccgcuucuccggccgccgcuggggccaggaguacaaccucaccaucaacaaccuccagcccgaggacaucgccaccuacuucugccaggucuacgaguucgccguccccggcacccgccucgaccucaagcgcaccgucgccgcccccuccgucuucaucuuccccuccgac

SEQ ID NO: 19366 - RNA, 339 nt, Artificial Sequence
  derived and/or modified sequence opt2 from anti-HIV_Chain
caguccguccucacccagcccgccuccgucuccggcucccccggccaguccaucaccaucuccugcaccggcaccaacuccgacgucggcuacuccuacgucuccugguuccagcagcaccccggcaagguccccaagcuccucaucuacgacgucucccgccgcuccuccggcgucuccaaccgcuucuccggcucccgcuccggcaacaccgccucccucaccaucuccggccuccgcgccgaggacgaggccgacuacuacugcggcuccuucaccaccucccucacccucgucuucggcggcggcaccaagcucgccguccucgucucccccucc

SEQ ID NO: 19367 - RNA, 339 nt, Artificial Sequence
  derived and/or modified sequence opt2 from anti-HIV_Chain
ucccucuccgccuccgucggcgaccgcgucaccaucaccugccgcgccuccgaguccaucuccuucuaccucaacugguaccagcagaagcccggcaaggcccccgagcuccucaucuucgccaccuccacccuccacuccggcguccccucccgcuucuccggcuccggcuccggcaccgacuucacccucaccaucuccucccuccagcucgaggacuucgccaccuacuacugccagcaguccuccuccacccccuucaccuucggcggcggcaccaaggucgagaucaagcgcaccgucgccgcccccuccgucuucaucuucccccccuccgac

SEQ ID NO: 19368 - RNA, 342 nt, Artificial Sequence
  derived and/or modified sequence opt2 from anti-HIV_Chain
gacauccagaugacccagucccccuccucccucuccgccuccgucggcgacaccgucaccaucaccugccaggccaacggcuaccucaacugguaccagcagcgccgcggcaaggcccccaagcuccucaucuacgacggcuccaagcucgagcgcggcguccccucccgcuucuccggccgccgcuggggccaggaguacaaccucaccaucaacaaccuccagcccgaggacaucgccaccuacuucugccaggucuacgaguucaucguccccggcacccgccucgaccucaagcgcaccgucgccgcccccuccgucuucaucuucccccccuccgac

SEQ ID NO: 19369 - RNA, 342 nt, Artificial Sequence
  derived and/or modified sequence opt2 from anti-HIV_Chain
gacauccagaugacccagucccccuccucccucuccgcccgcgucggcgacaccgucaccaucaccugccaggccaacggcuaccucaacugguaccagcagcgccgcggcaaggcccccaagcuccucaucuacgacggcuccaagcucgagcgcggcguccccucccgcuucuccggccgccgcuggggccaggaguacaaccucaccaucaacaaccuccagcccgaggacaucgccaccuacuucugccaggucuacgaguucgccguccccggcacccgccucgaccucaagcgcaccgucgccgcccccuccgucuucaucuucccccccuccgac

SEQ ID NO: 19370 - RNA, 342 nt, Artificial Sequence
  derived and/or modified sequence opt2 from anti-HIV_Chain
gacauccagaugacccagucccccuccucccucuccgcccgcgucggcgacaccgucaccaucaccugccaggccaacggcuaccucaacugguaccagcagcgccgcggcaaggcccccaagcuccucaucuacgacggcuccaagcucgagcgcggcguccccucccgcuucuccggccgccgcuggggccaggaguacaaccucaccaucaacaaccuccagcccgaggacaucgccaccuacuucugccaggucuacgaguucgucguccccggcacccgccucgaccucaagcgcaccgucgccgcccccuccgucuucaucuucccccccuccgac

SEQ ID NO: 19371 - RNA, 342 nt, Artificial Sequence
  derived and/or modified sequence opt2 from anti-HIV_Chain
gacauccagaugacccagucccccuccucccucuccgcccgcgucggcgacaccgucaccuucaccugccaggccaacggcuaccucaacugguaccagcagcgccgcggcaaggcccccaagcuccucaucuacgacggcuccaagcucgagcgcggcguccccucccgcuucuccggccgccgcuggggccaggaguacaaccucaccaucaacaaccuccagcccgaggacaucgccaccuacuucugccaggucuacgaguucgccguccccggcacccgccucgaccucaagcgcaccgucgccgcccccuccgucuucaucuucccccccuccgac

SEQ ID NO: 19372 - RNA, 342 nt, Artificial Sequence
  derived and/or modified sequence opt2 from anti-HIV_Chain
gacauccagaugacccagucccccuccucccucuccgccuccgucggcgacaccgucaccaucaccugccaggccaacggcuaccucaacugguaccagcagcgccgcggcaaggcccccaagcuccucauguacgacggcuccacccucgagcgcggcguccccgcccgcuucuccggccgccgcuggggccaggaguacaaccucaccaucaacaaccuccagcccgaggacgucgccaccuacuucugccaggucuacgaguucaucguccccggcacccgccucgaccucaagcgcaccgucgccgcccccuccgucuucaucuucccccccuccgac

SEQ ID NO: 19373 - RNA, 342 nt, Artificial Sequence
  derived and/or modified sequence opt2 from anti-HIV_Chain
gacauccagaugacccagucccccuccucccucuccgccuccgucggcgacaccgucaccaucaccugccaggccaacggcuaccucaacugguaccagcagcgccgcggcaaggcccccaagcuccucaucuacgacggcuccaagcucgagcgcggcguccccucccgcuucuccggccgccgcuggggccaggaguacaaccucaccaucaacaaccuccaggccgaggacaucgccaccuacuucugccaggucuacgaguucgccguccccggcacccgccucgaccucaagcgcaccgucgccgcccccuccgucuucaucuucccccccuccgac

SEQ ID NO: 19374 - RNA, 342 nt, Artificial Sequence
  derived and/or modified sequence opt2 from anti-HIV_Chain
gacauccagaugacccagucccccuccucccucuccgccuccgucggcgacaccgucaccuucaccugccaggccaacggcuaccucaacugguaccagcagcgccgcggcaaggcccccaagcuccucaucuacgacggcucccgccucgagcgcggcguccccucccgcuucuccggccgccgcuggggccaggaguacaaccucaccaucaacaaccuccagcccgaggacaucgccaccuacuucugccaggucuacgaguucgccguccccggcacccgccucgaccucaagcgcaccgucgccgcccccuccgucuucaucuucccccccuccgac

SEQ ID NO: 19375 - RNA, 342 nt, Artificial Sequence
  derived and/or modified sequence opt2 from anti-HIV_Chain
gacauccagaugacccacucccccuccucccucuccgccuccgucggcgacaccgucaccaucaccugccaggccaacggcuaccucaacugguaccagcagcgccgcggcaaggcccccaagcuccucaucuacgacggcuccaagcucgagaccggcguccccucccgcuucaccggccgccgcuggggccaggaguacaaccucaccaucaacaaccuccagcccgaggacaucgccaccuacuucugccaggucuacgaguucaucguccccggcacccgccucgaccucaagcgcaccgucgccgcccccuccgucuucaucuucccccccuccgac

SEQ ID NO: 19376 - RNA, 342 nt, Artificial Sequence
  derived and/or modified sequence opt2 from anti-HIV_Chain
gacauccagaugacccagucccccuccucccucuccgcccgcgucggcgacaccgucaccaucaccugccaggccaacggcuaccucaacugguaccagcagcgccgcggcaaggcccccaagcuccucaucuacgacggcuccaagcucgagaccggcguccccucccgcuucaccggccgccgcuggggccaggaguacaaccucaccaucaacaaccuccagcccgaggacaucgccaccuacuucugccaggucuacgaguucaucguccccggcacccgccucgaccucaagcgcaccgucgccgcccccuccgucuucaucuucccccccuccgac

SEQ ID NO: 19377 - RNA, 342 nt, Artificial Sequence
  derived and/or modified sequence opt2 from anti-HIV_Chain
gacauccagaugacccagucccccuccucccucuccgcccgcgucggcgacaccgucaccuucaccugccaggccaacggcuaccucaacugguaccagcagcgccgcggcaaggcccccaagcuccucaucuacgacggcuccaagcucgagcgcggcguccccucccgcuucuccggccgcggcuggggccaggaguacaaccucaccaucaacaaccuccagcccgaggacaucgccaccuacuucugccaggucuacgaguucgccguccccggcacccgccucgaccucaagcgcaccgucgccgcccccuccgucuucaucuucccccccuccgac

SEQ ID NO: 19378 - RNA, 342 nt, Artificial Sequence
  derived and/or modified sequence opt2 from anti-HIV_Chain
gacauccagaugacccagucccccuccucccucuccgccuccgucggcgacaccgucaccaucaccugccaggccaacggcuaccucaacugguaccagcagcgccgcggcaaggcccccaagcuccucaucuacgacggcuccaagcucgagcgcggcguccccucccgcuucuccggccgccgcuggggccaggaguacaaccucaccaucaacaaccuccagcccgaggacaucgccaccuacuucugccaggucuacgaguucgucguccccggcacccgccucgaccucaagcgcaccgucgccgcccccuccgucuucaucuucccccccuccgac

SEQ ID NO: 19379 - RNA, 342 nt, Artificial Sequence
  derived and/or modified sequence opt2 from anti-HIV_Chain
ucccaguccgucgucacccaggagcccucccucaccgucucccccggcggcaccgucacccucaccugcggccccuccaccggcgccgucaccuccggcuucuacccccacugguuccagcagaagcccggccaggccccccgcgcccucaucuacuccaccuccaacaaguacuccuggacccccgcccgcuucuccggcucccuccucggcggcaaggccguccucacccucuccgacguccagcccgacgacgaggccgaguacuacugccuccuccuccucuacuacggcggccccuggaucuucggcggcggcaccaagcucaccguccucgucucc

SEQ ID NO: 19380 - RNA, 345 nt, Artificial Sequence
  derived and/or modified sequence opt2 from anti-HIV_Chain
gacauccagaugacccagucccccuccucccucuccgccuccgucggcgacaaggucaccaucaccugccagaccuccgccggcuaccucaacugguaccagcagcgccgcggccgcgcccccaagcuccucauguacgacggcucccgccucgucaccggcguccccucccgcuucuccggccgccgcuggggcacccaguacaaccucaccaucggcucccuccagcccgaggacgucgccaccuacuacugccaggucuacgaguucuucggccccggcacccgccucgaccucaagcgcaccgucgccgcccccuccgucuucaucuucccccccuccgac

SEQ ID NO: 19381 - RNA, 345 nt, Artificial Sequence
  derived and/or modified sequence opt2 from anti-HIV_Chain
gacauccagaugacccagucccccuccucccucuccgccuccgucggcgacaccgucaccaucaccugccagaccaccaagggcuaccucaacugguaccagcagcgccgcggccgcgcccccaagcuccucauguucgacggcuccaagcucgucaccggcguccccucccgcuucuccggccgccgcuggggcacccaguacaaccucaccaucggcucccuccagcccgaggaccucgccaccuacuacugccaggucuacgaguucuucggccccggcacccgccucgaccucaagcgcaccgucgccgcccccuccgucuucaucuucccccccuccgac

SEQ ID NO: 19382 - RNA, 345 nt, Artificial Sequence
  derived and/or modified sequence opt2 from anti-HIV_Chain
gacauccagaugacccagucccccuccucccucuccgccuccgucggcgacaccgucaccaucaccugccagaccaacaagggcuaccucaacugguaccagcagcgccgcggccgcgcccccaagcuccucaugugcgacggcuccaagcucgucaccggcguccccucccgcuucuccggccgccgcuggggcacccaguacaaccucaccaucggcucccuccagcccgaggacaucgccaccuacuacugccaggucuacgaguucuucggccccggcacccgccucgaccucaagcgcaccgucgccgcccccuccgucuucaucuucccccccuccgac

SEQ ID NO: 19383 - RNA, 345 nt, Artificial Sequence
  derived and/or modified sequence opt2 from anti-HIV_Chain
gacauccagaugacccagucccccuccucccucuccgcccgcgucggcgacaaggucaccaucaccugccagaccuccgccggcuaccucaacugguaccagcagcgccgcggccgcgcccccaagcuccucauguacgacggcucccgccucgucaccggcguccccucccgcuucuccggccgccgcuggggcacccaguacaaccucaccaucggcucccuccagcccgaggacaucgccaccuacuacugccaggucuacgaguucuucggccccggcacccgccucgaccucaagcgcaccgucgccgcccccuccgucuucaucuucccccccuccgac

SEQ ID NO: 19384 - RNA, 345 nt, Artificial Sequence
  derived and/or modified sequence opt2 from anti-HIV_Chain
gacauccagaugacccagucccccuccucccucuccgccuccgucggcgacaccgucaccaucaccugccagaccaacaagggcuaccucaacugguaccagcagaagcgcggccgcgcccccaagcuccucauguacgacggcuccaagcucgucaccggcguccccucccgccucuccggccgccgcuggggcacccaguacaaccucaccaucggcucccuccagcccgaggacaucgccaccuacuacugccaggucuacgaguucuucggccccggcacccgccucgaccucaagcgcaccgucgccgcccccuccgucuucaucuucccccccuccgac

SEQ ID NO: 19385 - RNA, 345 nt, Artificial Sequence
  derived and/or modified sequence opt2 from anti-HIV_Chain
gacauccagaugacccagucccccuccucccucuccgccuccgucggcgacaccgucaccaucaccugccagaccaacaagggcuaccucaacugguaccagcagcgccgcggccgcgcccccaagcuccucauguacgacggcuccaagcucgucaccggcguccccucccgccucuccggccgccgcuggggcacccaguacaaccucaccaucggcucccuccagcccgaggacaucgccaccuacuacugccaggucuacgaguucuucggccccggcacccgccucgaccucaagcgcaccgucgccgcccccuccgucuucaucuucccccccuccgac

SEQ ID NO: 19386 - RNA, 345 nt, Artificial Sequence
  derived and/or modified sequence opt2 from anti-HIV_Chain
gacauccagaugacccagucccccuccucccucuccgccuccgucggcgacaccgucaccaucaccugccacaccaacaagggcuaccucaacugguaccagcagcgccgcggccgcgcccccaagcuccucauguucgacggcuccaagcucgucaccggcguccccucccgcuucuccggccgccgcuggggcacccaguacaaccucaccaucggcucccuccagcccgaggacaucgccaccuacuacugccaggucuacgaggucuucggccccggcacccgccucgaccucaagcgcaccgucgccgcccccuccgucuucaucuucccccccuccgac

SEQ ID NO: 19387 - RNA, 345 nt, Artificial Sequence
  derived and/or modified sequence opt2 from anti-HIV_Chain
gacauccagaugacccagucccccuccucccucuccgccuccgucggcgacaccgucaccaucaacugccagaccaacaagggcuaccucaacugguaccagcagcgccgcggccgcgcccccaagcuccucauguacgacggcuccaagcucgucaccggcguccccucccgcuucuccggccgccgcuggggcacccaguacaaccucaccaucggcucccuccagcccgaggacaucgccaccuacuacugccaggucuacgaguucuucggccccggcacccgccucgaccucaagcgcaccgucgccgcccccuccgucuucaucuucccccccuccgac

SEQ ID NO: 19388 - RNA, 345 nt, Artificial Sequence
  derived and/or modified sequence opt2 from anti-HIV_Chain
gacauccagaugacccagucccccuccucccucuccgcccgcgucggcgacaaggucaccaucaccuaccagaccuccgccggcuaccucaacugguaccagcagcgccgcggccgcgcccccaagcuccucauguacgacggcucccgccucgucaccggcgcccccucccgcuucuccggccgccgcuggggcacccaguacaaccucaccaucggcucccuccagcccgaggacaucgccaccuacuacugccaggucuacgaguucuucggccccggcacccgccucgaccucaagcgcaccgucgccgcccccuccgucuucaucuucccccccuccgac

SEQ ID NO: 19389 - RNA, 345 nt, Artificial Sequence
  derived and/or modified sequence opt2 from anti-HIV_Chain
gacauccagaugacccagucccccuccucccucuccgccuccgucggcgacaccgucaccaucaccugccagaccaacaagggcuaccucaacugguaccagcagcgccgcggccgcgcccccaagcuccucauguacgacggcuccaagcucgucaccggcguccccucccgcuucuccggccgccgcuggggcacccaguacaaccucaccaucggcucccuccagcccgaggacaucgccaccuacuacugccaggucuacgaguucuucggccccggcacccgccucgaccucaagcgcaccgucgccgcccccuccgucuucaucuucccccccuccgac

SEQ ID NO: 19390 - RNA, 345 nt, Artificial Sequence
  derived and/or modified sequence opt2 from anti-HIV_Chain
gucacccucucccucucccccggcgagcgcgccacccucuccugccgcgccucccagaccaucuccaacaacuaccucgccugguaccagcagaagcccggccaggccccccgccuccucaucuacggcgccuccuccggcgccaccggccuccccgaccgcuucuccggcuccggcuccggcaccgacuucacccucaccaucucccgccucgagcccgaggacuucgccgucuacuacugccaccaguacgcccucucccccuggaccuucggccgcggcaccaaggucgagaucaagcgcaccgucgccgcccccuccgucuucaucuucccccccuccgac

SEQ ID NO: 19391 - RNA, 345 nt, Artificial Sequence
  derived and/or modified sequence opt2 from anti-HIV_Chain
acccucuccgccuccgucggcgaccgcgucaccaucaccugccgcgccucccaguccaucaacaacuaccucaacugguaccagcagaagcccggcaaggcccccaagcuccucaucuacgccgccuccucccuccaguccggcguccccucccgcuucuccggcuccggcuccggcaccgacuucacccucaccaucuccucccuccagcccgaggacuucgucaccuacuacugccagcagaccuacuccaacccccgcauguucggccagggcaccaaggucgagaucaagcgcaccgucgccgcccccuccgucuucaucuucccccccuccgacgagcag

SEQ ID NO: 19392 - RNA, 345 nt, Artificial Sequence
  derived and/or modified sequence opt2 from anti-HIV_Chain
caguccgcccucacccaggcccccuccgccuccggcacccccggccagcgcgucaccaucuccugcuccggcggcggcuccaacaucggcggcaaccucgucuccugguaccagcacuuccccggcgccgcccccaagcuccucaucuaccgcaacgaccagcgccccuccggcguccccgaccgcuucuccgccuccaaguccggcaccuccgccucccucgccaucuccggccuccgcuccgacgacgaggccaccuacuucugcgccgccuacgacuccacccucucccuccgccucuucggcggcggcaccacccucgccguccucucccagcccaaggcc

SEQ ID NO: 19393 - RNA, 345 nt, Artificial Sequence
  derived and/or modified sequence opt2 from anti-HIV_Chain
aagcccucccagacccucucccucaccugcaccgucuccggcggcuccaucuccuccgccggcuacuacuggaccuggauccgccaccaccccggcaagggccucgaguucaucggcuacaucuaccacaucggcacccccuacuacaaccccucccucaagucccgccucaccaucuccaucgacaccuccaagaaccaguucucccucaagcucuccuccgucaccgccgccgacaccgccaucuacuacugcgcccgcgacuacaccgcccgcggccgccacuucuucgacuacuggggccagggcgcccucgucaccgucuccuccgccuccaccaagggc

SEQ ID NO: 19394 - RNA, 345 nt, Artificial Sequence
  derived and/or modified sequence opt2 from anti-HIV_Chain
cccuccgagacccucucccucaccugccgcgucuccggcgccuccaucuccaacuucuacuggaccuggauccgccagcccgccggcaagggccucgaguggaucggccgccucuacuccuccgacaagaccaacuacaaccccucccucaacggccgcgucaccaugucccucgacaccuccaagaaccaguucucccuccgccucaccuccaugaccgacgccgacaccgccaucuacuacugcgcccgcgagaagggccagugggucacccucccccccuacuacuucgacuccuggggccagggcauccucgucaccgucuccuccgccuccaccaagggc

SEQ ID NO: 19395 - RNA, 348 nt, Artificial Sequence
  derived and/or modified sequence opt2 from anti-HIV_Chain
ggccccgccacccucuccgucucccccggcgagcgcgccacccucuccugccgcgccucccagucccuccgcaacaaccucgccugguaccagcagaagaccggccaguccccccgccuccucaucuacgccgucuccacccgcgccaccggcauccccccccgcuucuccggcggcggcuccggcaccgaguucacccucaccaucgacucccuccaguccgaggacuucgccgucuacuucugccagcaguacgacuccccccaguggaccuucggccagggcaccaaggucgagaucaagcgcaccgucgccgcccccuccgucuucaucuucccccccuccgac

SEQ ID NO: 19396 - RNA, 348 nt, Artificial Sequence
  derived and/or modified sequence opt2 from anti-HIV_Chain
gcccccgucacccucuccgccuccgucggcgacaccgucaccaucaccugccgcgccucccagcccaucgccaccuuccucaacugguaccagcacaagcccggccaggcccccaagcuccucaucuacgccgccuccaccuuccagcgcggcgcccccucccgcuacuccggcuccggcuccggcaccgacuucacccucaccaucaacucccuccagcccgaggaccucgccaccuacuacugccagcagaccuucaccgaccccgucaccuucggccagggcacccgccucgagaucaagcgcaccgucgccgcccccuccgucuucaucuucccccccuccgac

SEQ ID NO: 19397 - RNA, 351 nt, Artificial Sequence
  derived and/or modified sequence opt2 from anti-HIV_LightChain
gacauccagaugacccagucccccuccacccucuccgccuccaucggcgacaccguccgcaucuccugccgcgccucccaguccaucaccggcggcuggcucgccugguaccaccagcgccccggcaaggccccccgccuccucaucuaccgcggcucccgccuccucggcggcguccccucccgcuucuccggcuccgccgccggcaccgacuucacccucaccaucgccaaccuccaggccgaggacuucggcaccuucuacugccagcaguacgacaccuaccccggcaccuucggccagggcaccaaggucgaggucaagcgcaccgucgccgcccccuccgucuuc

SEQ ID NO: 19398 - RNA, 351 nt, Artificial Sequence
  derived and/or modified sequence opt2 from anti-HIV_LightChain
gacauccagaugacccagucccccuccacccucuccgccuccaucggcgacaccguccgcaucuccugccgcgccucccaguccaucaccggcaacugggucgccugguaccagcagcgccccggcaaggccccccgccuccucaucuaccgcggcgccgcccuccucggcggcguccccucccgcuucuccggcuccgccgccggcaccgacuucacccucaccaucggcaaccuccagaccgaggacuucggcaccuucuacugccagcaguacgacaccuaccccggcaccuucggccagggcaccaaggucgaggucaagcgcaccgucgccgcccccuccgucuuc

SEQ ID NO: 19399 - RNA, 351 nt, Artificial Sequence
  derived and/or modified sequence opt2 from anti-HIV_LightChain
gacauccagaugacccagucccccuccacccucuccgccuccaucggcgacaccguccgcaucuccugccgcgccucccaguccaucaccggcaacugggucgccugguaccagcagcgccccggcaaggccccccgccuccucaucuaccgcggcgccgcccuccucggcggcguccccucccgcuuccgcggcuccgccgccggcaccgacuucacccucaccaucggcaaccuccaggccgaggacuucggcaccuucuacugccagcaguacgacaccuaccccggcaccuucggccagggcaccaaggucgaggucaagcgcaccgucgccgcccccuccgucuuc

SEQ ID NO: 19400 - RNA, 351 nt, Artificial Sequence
  derived and/or modified sequence opt2 from anti-HIV_LightChain
gacauccagaugacccagucccccuccacccucuccgccuccgucggcgacaccguccgcaucuccugccgcgccucccaguccaucaccggcggcuggcucgccugguaccaccagcgccccggcaaggccccccgccuccucaucuaccgcggcucccgccuccucggcggcguccccucccgcuucuccggcuccgccgccggcaccgacuucacccucaccaucgccaaccuccaggccgaggacuucggcaccuucuacugccagcaguacgacaccuaccccggcaccuucggccagggcaccaaggucgaggucaagcgcaccgucgccgcccccuccgucuuc

SEQ ID NO: 19401 - RNA, 351 nt, Artificial Sequence
  derived and/or modified sequence opt2 from anti-HIV_LightChain
gacauccagaugacccagucccccuccacccucuccgccuccaucggcgacaccguccgcaucuccugccgcgccucccaguccaucaccggcaacugggucgccugguaccagcagcgccccggcaaggccccccgccuccucaucuaccgcggcgccgcccuccucggcggcguccccucccgcuucuccggcuccgccgccggcaccgacuucacccucaccaucggcaaccuccaggccgaggacuucggcaccuucuacugccagcaguacgacaccuaccccggcaccuucggccagggcaccaaggucgaggucaagcgcaccgucgccgcccccuccgucuuc

SEQ ID NO: 19402 - RNA, 351 nt, Artificial Sequence
  derived and/or modified sequence opt2 from anti-HIV_LightChain
gacauccagaugacccagucccccuccacccucuccgccuccaucggcgacaccguccgcaucuccugccgcgccucccaguccaucaccggcggcugggucgccugguaccaccagcgccccggcaaggccccccgccuccucaucuaccgcggcucccgccuccucggcggcguccccucccgcuucuccggcuccgccgccggcaccgacuucacccucaccaucggcaaccuccaggccgaggacuucggcaccuucuacugccagcaguacgacaccuaccccggcaccuucggccagggcaccaaggucgaggucaagcgcaccgucgccgcccccuccgucuuc

SEQ ID NO: 19403 - RNA, 351 nt, Artificial Sequence
  derived and/or modified sequence opt2 from anti-HIV_LightChain
gacauccagaugacccagucccccuccacccucuccgccuccgucggcgacaccguccgcaucuccugccgcgccucccaguccaucaccggcggcuggcucgccugguaccaccagcgccccggcaaggccccccgccuccucaucuaccgcggcucccgccuccucggcggcguccccucccgcuucuccggcuccgccgccggcaccggcuucacccucaccaucgccaaccuccaggccgaggacuucggcaccuucuacugccagcaguacgacaccuaccccggcaccuucggccagggcaccaaggucgaggucaagcgcaccgucgccgcccccuccgucuuc

SEQ ID NO: 19404 - RNA, 351 nt, Artificial Sequence
  derived and/or modified sequence opt2 from anti-HIV_LightChain
gacauccagaugacccagucccccuccacccucuccgccuccgucggcggcaccguccgcaucuccugccgcgccucccaguccaucaccggcggcuggcucgccugguaccaccagcgccccggcaaggccccccgccuccucaucuaccgcggcucccgccuccucggcggcguccccucccgcuucuccggcuccgccgccggcaccgacuucacccucaccaucgccaaccuccaggccgaggacuucggcaccuucuacugccagcaguacgacaccuaccccggcaccuucggccagggcaccaaggucgaggucaagcgcaccgucgccgcccccuccgucuuc

SEQ ID NO: 19405 - RNA, 351 nt, Artificial Sequence
  derived and/or modified sequence opt2 from anti-HIV_LightChain
gacauccagaugacccagucccccuccacccucuccgccuccaucggcgacaccguccgcaucuccugccgcgccucccaguccaucaccggcaacugggucgccugguaccaccagcgccccggcaaggccccccgccuccucaucuaccgcggcgccgcccuccucggcggcguccccucccgcuucuccggcuccgccgccggcaccgacuucacccucaccaucggcaaccuccaggccgaggacuucggcaccuucuacugccagcaguacgacaccuaccccggcaccuucggccagggcaccaaggucgaggucaagcgcaccgucgccgcccccuccgucuuc

SEQ ID NO: 19406 - RNA, 351 nt, Artificial Sequence
  derived and/or modified sequence opt2 from anti-HIV_LightChain
gacauccagaugacccagucccccuccacccucuccgccuccaucggcgacaccgucaugaucuccugccgcgccucccaguccaucaccggcggcuggcucgccugguaccaccagcgccccggcaaggccccccgccuccucaucuaccgcggcuccaagcuccucggcggcguccccucccgcuucuccggcuccgccgccggcaccggcuucacccucaccaucggcaaccuccaggccgaggacuucggcaccuucuacugccagcaguacgacaccuaccccggcaccuucggccagggcaccaaggucgaggucaagcgcaccgucgccgcccccuccgucuuc

SEQ ID NO: 19407 - RNA, 351 nt, Artificial Sequence
  derived and/or modified sequence opt2 from anti-HIV_LightChain
gacauccagaugacccagucccccuccacccucuccgccuccgucggcgacaccguccgcaucuccugccgcgccucccaguccaucaccggcggcuggcucgccugguaccaccagcgccccggcaaggccccccgccuccucaucuaccgcggcucccgccuccucggcggcguccccucccgcuucuccggcuccgccgccggcgccgacuucacccucaccaucgccaaccuccaggccgaggacuucggcaccuucuacugccagcaguacgacaccuaccccggcaccuucggccagggcaccaaggucgaggucaagcgcaccgucgccgcccccuccgucuuc

SEQ ID NO: 19408 - RNA, 351 nt, Artificial Sequence
  derived and/or modified sequence opt2 from anti-HIV_LightChain
gacauccagaugacccagucccccuccacccucuccgccuccaucggcgacaccguccgcaucuccugccgcgccucccaguccaucaccggcggcuggcucgccugguaccaccagcgccccggcaaggccccccgccuccucaucuaccgcggcucccgccucgucggcggcguccccucccgcuucuccggcuccgccgccggcaccgacuucacccucaccaucggcaaccuccaggccgaggacuucggcaccuucuacugccagcaguacgacaccuaccccggcaccuucggccagggcaccaaggucgaggucaagcgcaccgucgccgcccccuccgucuuc

SEQ ID NO: 19409 - RNA, 351 nt, Artificial Sequence
  derived and/or modified sequence opt2 from anti-HIV_LightChain
gacauccagaugacccagucccccuccacccucuccgccuccaucggcgacaccguccgcaucuccugccgcgccucccaguccaucaccggcggcuggcucgccugguaccaccagcgccccggcaaggccccccgccuccucaucuaccgcggcucccgccuccucggcggcguccccuccaaguucuccggcuccgccgccggcaccgacuucacccucaccaucgccaaccuccaggccgaggacuucggcaccuucuacugccagcaguacgacaccuaccccggcaccuucggccagggcaccaaggucgaggucaagcgcaccgucgccgcccccuccgucuuc

SEQ ID NO: 19410 - RNA, 351 nt, Artificial Sequence
  derived and/or modified sequence opt2 from anti-HIV_LightChain
gacauccagaugacccagucccccuccacccucuccgccuccaccggcgacaccguccgcaucuccugccgcgccucccaguccaucaccggcaacugggucgccugguaccagcagcgccccggcaaggccccccgccuccucaucuaccgcggcgccgcccuccucggcggcguccccucccgcuuccgcggcuccgccgccggcaccgacuucacccucaccaucggcaaccuccaggccgaggacuucggcaccuucuacugccagcaguacgacaccuaccccggcaccuucggccagggcaccaaggucgaggucaagcgcaccgucgccgcccccuccgucuuc

SEQ ID NO: 19411 - RNA, 351 nt, Artificial Sequence
  derived and/or modified sequence opt2 from anti-HIV_LightChain
gacauccagaugacccagucccccuccacccucuccgccuccaucggcgacaccguccgcaucuccugccgcgccucccaguccaucaccggcaacuggcucgccugguaccaccagcgccccggcaaggccccccgccuccucaucuaccgcggcucccgccuccucggcggcguccccucccgcuucuccggcuccgccgccggcaccgacuucacccucaccaucgccaaccuccaggccgaggacuucggcaccuucuacugccagcaguacgacaccuaccccggcaccuucggccagggcaccaaggucgaggucaagcgcaccgucgccgcccccuccgucuuc

SEQ ID NO: 19412 - RNA, 351 nt, Artificial Sequence
  derived and/or modified sequence opt2 from anti-HIV_Chain
aucauccucuuccucgucgccaccgccaccggcuccugggcccaguccgcccucacccagccccgcuccgucuccggcucccucggccaguccgucaccaucuccugcaccggcuccuccuccgacgucggccgcuacaacuacgucuccugguaccagcaccaccccggcaaggcccccaagcucaugaucuccgacgucaacaagcgccccuccggcguccccgaccgcuucuccggcuccaaguccggcaacaccgccucccucaccaucuccggccuccaggccgaggacgagaccgacuacuacugcugcuccuacgccggcuccuacaucugggucuucggcggc

SEQ ID NO: 19413 - RNA, 351 nt, Artificial Sequence
  derived and/or modified sequence opt2 from anti-HIV_Chain
cccgucacccucuccgccuccgucggcgaccgcgucaccaucaccugccgcgccuccgaggacaucuccaaguaccucaacugguaccagcacaagcccggcaaggcccccaagcuccucaucuacaccgccuccucccucgagaccggcguccccucccgcuucuccggcuccggcuccggcaccgacuucucccucaccaucuccucccuccagcccgacgacuucgccaccuacuacugccagcaguccuacaccuccuccgucaccuucggccagggcacccgcgucgaggucaagcgcaccgucgccgcccccuccgucuucaucuucccccccuccgacgagcag

SEQ ID NO: 19414 - RNA, 351 nt, Artificial Sequence
  derived and/or modified sequence opt2 from anti-HIV_Chain
gucgaggagcccggcuccuccgucaaggucuccugcaaggccuccggcggcuccuccaccgccuacggcuacuccuggguccgccaggcccccggccagggcuucgaguggaugggccgcaucauccccuucuacggcaucaucaccuacgcccccaaguuccagggccgcgucaccaucaccgccgaccgcuccaccuccaccgucuacauggagcucacccgccucaccuucgccgacaccgcccucuucuucugcgcccgcgacuacggcgacccccgcaacggcuacuacuucgacuccugggaccagggccucuggcucaccgucuccuccgccuccaccaagggc

SEQ ID NO: 19415 - RNA, 351 nt, Artificial Sequence
  derived and/or modified sequence opt2 from anti-HIV_Chain
cagguccgccucgagcaguccggcgccgccguccgcacccccggcgccuccgucacccucuccugccaggccuccggcuacaaguucgucaacuacaucauccacuggguccgccagcgccccggccucgccuucgagugggucggcaugaucgaccccuaccgcggccgccccugguccgcccacuccuucgagggccgccucucccucucccgcgacgucuccauggagauccucuacaugacccucaccucccuccgcuccgacgacaccgccaccuacuucugcgcccgcgccgaggccgagucccagucccacucccgccccaucaucuccaccuccggcgcccgc

SEQ ID NO: 19416 - RNA, 351 nt, Artificial Sequence
  derived and/or modified sequence opt2 from anti-HIV_Chain
guccaccucgagguccagcuccagcaguccggccccgagcucaagaagcccggcgagaccgucaagaucuccugcaaggccuccgucuacaccuucaccgaguaccccauccacugggucaagcaggcccccggcaagggcuucaaguggaugggcuggaucaacaccuacuccggcgagcccaccuacgccgacgacuucaagggccgcuucgccuucucccucgagaccuccgccuccaccgccuaccuccagaucaacucccucaagaacgaggacaccgccaccuacuucugcgccucccucggccgcgacuacuggggccagggccagggcaccacccucaccguc

SEQ ID NO: 19417 - RNA, 354 nt, Artificial Sequence
  derived and/or modified sequence opt2 from anti-HIV_Chain
cucuccgucucccucggcgagcgcgccaccaucaacugcaaguccucccaguccauccucuacuccuccgacaagaagaacuaccucgccugguaccagcagaagaucggccagccccccaagcuccuccucuacugggccuccacccgcgaguccggcauccccgaccgcuucuccggcuccggcuccggcuccgacuucacccucaccaucuccucccuccagcccgaggacgucgccgucuacuacugccagcaguacuacaucucccccuucaccuucggccccggcaccaaggucgaccucaagcgcaccgucgccgcccccuccgucuucaucuucccccccuccgac

SEQ ID NO: 19418 - RNA, 354 nt, Artificial Sequence
  derived and/or modified sequence opt2 from anti-HIV_Chain
caguccguccucacccagccccccuccgccuccggcgcccccggccagcgcgucaccaucuccugcuccggcggccccuccaacgucggcggcaacuacgucuacugguaccgccaguuccccggcaccgcccccaagcuccucauccuccgcgacgaccagcgccccuccggcguccccgaccgcuucuccgccuccaaguccggcaacuccgccucccucgccaucuccggccuccgccccgacgacgaggccuucuacuucugcgccaccuacgacuccgacggcuccauccgccucuucggcggcggcaccgcccucaccguccucucccagcccaaggccgcccccucc

SEQ ID NO: 19419 - RNA, 354 nt, Artificial Sequence
  derived and/or modified sequence opt2 from anti-HIV_Chain
aaggcccccgccacccucucccucucccccggcgagcgcgccacccucuccugccgcgccucccaguccgucggcuccgaccucgccugguaccagcagaagcccggccaggccccccgccuccucaucuacgacgccuccaaccgcgccaccgccauccccgcccgcuucuccggcuccggcuccggcaccgacuucacccucuccaucuccucccucgagcccgaggacuucgccgucuacuucugccagcagcgcuacgacaagaucaccuucggccagggcacccgccucgagauccagcgcaccgucgccgcccccuccgucuucaucuucccccccuccgacgagcag

SEQ ID NO: 19420 - RNA, 354 nt, Artificial Sequence
  derived and/or modified sequence opt2 from anti-HIV_Chain
cagguccagcucguccaguccggcgccgaggccaagcgccccggcgacuccgucaaggucuccugcaaggccuccggcuacaccuucaccgaguacuacauccacuggguccgccagacccccggccagggcuucgaguggaugggcaucaucacccccggcgccggcaacaccaccuacgcccagaaguuccagggccgcaucaccgucacccgcgacaccuccgccgccaccgucuacauggagcucuccaaccucaccuccgaggacaccgccgucuacuucugcucccgcggcgucuccuucuggggccagggcacccucgucaccgucuccuccgccuccaccaagggc

SEQ ID NO: 19421 - RNA, 354 nt, Artificial Sequence
  derived and/or modified sequence opt2 from anti-HIV_HeavyChain
gaggucaagcuccagcaguccggcgccgagcucguccgccccggcgccuccgucaagauguccugcaaggccuccggcuaccgcuucaccuccuacaacaugcacugggucaagcagaccccccgccagggccucgaguggaucggcgccaucuaccccggcaacggcgacaccuccuacaaccagaaguucaagggcaaggccacccucaccgucgacaaguccuccuccaccgccuacaugcagcucuccucccucaccuccgaggacuccgccgucuacuucugcgcccgcggccgccucucccucggcuucgacuacuggggccagggcuccacccucaccgucuccucc

SEQ ID NO: 19422 - RNA, 357 nt, Artificial Sequence
  derived and/or modified sequence opt2 from anti-HIV_Chain
cagguccagcucguccaguccggcaccgccgucaagcgccccggcgccuccguccgcgucuccugccaggccuccggcuacaccuucaucgaccacuucaucuacugguggcgccaggcccccggccagggccucgaguggcucggcuggaucaacccccucaccucccagcccuccuaccccucccgcuuccagggccgccucacccucacccgcgacaccuucgacgagaugcucuacauggaccuccgcggccuccgcuccgacgacaccggcaucuacuucugcgcccgccgccacuccgacuacugcgacuucgacaucuggggcuccggcacccagaucaucgucuccucc

SEQ ID NO: 19423 - RNA, 357 nt, Artificial Sequence
  derived and/or modified sequence opt2 from anti-HIV_Chain
cagguccagcucguccaguccggcaccgccgucaagcgccccggcgccuccguccgcgucuccugccaggccuccggcuacaccuucaccgacuacuucaucuacugguggcgccaggcccccggccagggccucgaguggcucggcuggaucaacccccucaccucccagcccuccuaccccucccgcuuccagggccgccucacccucacccgcgacaccuucgacgagaugcucuacauggaccuccgcggccuccgcuccgacgacaccggcaucuacuucugcgcccgccgccacuccgacuacugcgacuucgacaucuggggcuccggcacccagaucaucgucuccucc

SEQ ID NO: 19424 - RNA, 357 nt, Artificial Sequence
  derived and/or modified sequence opt2 from anti-HIV_Chain
caguccguccucacccagccccgcuccgucuccggcucccccggccaguccgucaccaucuccugcaccggcaccuccuccgacgucggcggcuacaacuacgucuccugguaccagcagcaccccggcaaggcccccaagaccaugaucuucgacgucaccaagcgccccuccggcguccccgaccgcuucuccggcuccaaguccggcaacaccgccucccucaccaucuccggccuccaggccgaggacgaggccgacuacuacugcuccuccuacgccggccgcaacaccuucuacgucuucggcaccggcaccaccgucaccguccaggucucccccucccagccccccccc

SEQ ID NO: 19425 - RNA, 357 nt, Artificial Sequence
  derived and/or modified sequence opt2 from anti-HIV_Chain
gagaucguccucacccagucccccggcacccucucccucucccccggcgagcgcgccacccucuccugccgcgccucccaguccgucuccuccaacuaccucgccugguaccagcagaagcccggccaggccccccgccuccucaucuacggcgccuccucccgcgccaccggcauccccgaccgcuucuccggcuccggcuccggcaccgacuucacccucuccaucucccgccucgagcccgaggacuucgccgucuacuacugccagcaguacggcaccuccuccugcaccuucggccagggcaccaagcucgagaucaagcgcaccgucgccgcccccuccgucuucaucuuc

SEQ ID NO: 19426 - RNA, 357 nt, Artificial Sequence
  derived and/or modified sequence opt2 from anti-HIV_Chain
cucuccgccuccgucggcgaccgcgucaccaucaccugccgcgccucccaguccaucgaccgcuaccucaacugguaccagcagaagcccggcaaggcccccaagcuccucaucuacgccgccuccucccuccacaccgacguccccucccgcuucuccggcuccggcgccggcaccuacuucacccucaccaucaccucccuccagcccgaggacuucgccaccuacuacugccagcagucccacucccccuccuucggccaggaguccuacuccaucaccuucggccagggcacccgccucgagaucaagcgcaccgucgccgcccccuccgucuucaucuucccccccuccgac

SEQ ID NO: 19427 - RNA, 357 nt, Artificial Sequence
  derived and/or modified sequence opt2 from anti-HIV_Chain
aacuucaugcucacccaggcccccuccgccuccggcgcccccggccagcgcgucaccaucuccugcuccggcggccccuccaacgucggcggcaacuacgucuacugguaccgccaguaccccggcaccgcccccaagcuccucauccuccgcgacgaccagcgccccuccggcguccccgaccgcuucuccgccuccaaguccggcaacuccgccucccucgccaucuccgagcuccgccccgacgacgaggccuucuacuucugcgccaccuacgacuccgacggcuccauccgccucuucggcggcggcaccgcccucaccguccucucccagcccaaggccgcccccuccguc

SEQ ID NO: 19428 - RNA, 360 nt, Artificial Sequence
  derived and/or modified sequence opt2 from anti-HIV_Chain
gacauccagaugacccagucccccuccucccucuccgccuccaucggcgaccgcgucaacaucaccugccaggccucccgcgacaccggcuccgcccucaacugguaccagcagaaggucggccgccccccccgccuccucaucuccgccgucuccaaccucggcgccggcguccccucccgcuucuccggccgccgcuccggcacccaguccacccucaccaucaacacccuccagcccgaggacaucgccaccuacuucugccagcacuacgaguucuucggccccggcaccaaggucgacaucaagcgcaccgucgccgcccccuccgucuucaucuucccccccuccgacgagcag

SEQ ID NO: 19429 - RNA, 360 nt, Artificial Sequence
  derived and/or modified sequence opt2 from anti-HIV_Chain
caguccguccucacccagcccgccuccgucuccggcucccccggccaguccaucaccaucuccugcaccggcaccuccaacgacgucggcggccagaacuucgucuccugguaccagcagcaccccggcaccgccccccagcuccucaucuacgacgucaccaaccgccccgccggcgucuccucccgcuucuccggcuccaaguccggcaacaccgccucccucaccaucuccggccuccgcaccgaggacgaggccgacuacuacugcgccuccuucaccauccucaacggcgucgacuacgucuucggcaccggcaccaaggucaccguccuccucucccccucccagcccuaccuc

SEQ ID NO: 19430 - RNA, 360 nt, Artificial Sequence
  derived and/or modified sequence opt2 from anti-HIV_Chain
aacuucaugcucacccagcccgccuccgucuccggcucccccggccaguccaucacccucuccugcaccggcaccaccuccgacguccgcgacuccaacuucgucuccugguaccagcagguccccggcaaggcccccaagcucaucaucuacgacgucuccgcccgccccuccggcgucuccuuccgcuucuccggcuccaaguccggcaacaccgccucccucaccaucuccggccuccaggccgaggacgaggcccucuacuacugcuccuccuucacccccaccaacacccucgucuucggcggcggcaccaagcucaccguccucggccagcccaaggccgcccccuccgucacc

SEQ ID NO: 19431 - RNA, 360 nt, Artificial Sequence
  derived and/or modified sequence opt2 from anti-HIV_Chain
caguccgcccucacccagccccccgccgccuccggcgcccccggccagcgcgucaccaucuccugcuccggcggcggcuccaacgucggcggcaaccucgucuccugguaccagcaguuccccggcgccgcccccaagcucauccuccaccgcgacggccagcgccccuccggcguccccgaccgcuucuccgccuccaaguccggcaccuccgccucccucaccaucuccggccuccgcuccgacgacgaggccaccuacuucugcgccgccuacgacuccgccgucucccuccccgucuucggcggcggcaccaagcucaccguccucucccagcccaaggccgccccccucgucacc

SEQ ID NO: 19432 - RNA, 360 nt, Artificial Sequence
  derived and/or modified sequence opt2 from anti-HIV_Chain
cagcucguccucacccagccccccuccgucuccggcacccccggccagaacgucaccaucuccugcuccggcggcggcucccacgucggcggcaaccucgucuccugguaccagcacuuccccggcgccgcccccaagcuccucauccaccgcgacaaccagcgccccuccggcguccccgaccgcuucuccgcccucaaguccggcaacuccgccucccucgccaucuccggccuccgcuccgacgacgaggccuucuacuucugcgccgucuacgacuccucccucucccucggccucuucggcggcggcaccaagcucaccguccucucccagcccaaggccgcccccuccgucacc

SEQ ID NO: 19433 - RNA, 360 nt, Artificial Sequence
  derived and/or modified sequence opt2 from anti-HIV_Chain
gacauccagaugacccagucccccuccucccucuccgccuccgucggcgaccgcgucuccauccacugccaggccggccagggcaucggcuccucccucaagugguaccagcagaaguccggccgcgccccccgccuccucguccacggcgccuccaaccuccagcgcggcguccccucccgcuucuccggcuccggcuuccacaccaccuucacccucaccaucuccucccuccagcccgacgacgucgccaccuacuggugcgccguccucgaguucuucggccccggcaccaaggucgagaucaagcgcaccgucgccgcccccuccgucuucaucuucccccccuccgacgagcag

SEQ ID NO: 19434 - RNA, 360 nt, Artificial Sequence
  derived and/or modified sequence opt2 from anti-HIV_Chain
gacauccagaugacccagucccccuccucccucuccgccuccgucggcgaccgcgucaccaucaccugccaggccucccagggcaucggcuccucccuccagugguaccagcagaagcccggccgcgcccccaagcuccucguccacggcgccuccaaccuccaccgcggcguccccucccgcuucuccggcuccggcuuccacaccuccuucacccucaccaucuccucccuccagcccgacgacgucgccaccuacuucugcgccguccucgaguucuucggccccggcaccaaggucgagaucaagcgcaccgucgccgcccccuccgucuucaucuucccccccuccgacgagcag

SEQ ID NO: 19435 - RNA, 360 nt, Artificial Sequence
  derived and/or modified sequence opt2 from anti-HIV_Chain
gacauccagaugacccagucccccuccucccucuccgccuccgucggcgaccgcgucuccaucaacugccaggccggccagggcaucggcuccucccucaacugguaccagcagaagcgcggcaaggcccccaagcuccucguccacggcgccuccacccuccagcgcggcguccccucccgcuucuccggcuccggcuuccacaccaccuucacccucaccaucuccucccuccagcccgacgacgucgccaccuacuucugcgaguccuuccagugguucggccccggcaccaaggucgagaucaagcgcaccgucgccgcccccuccgucuucaucuucccccccuccgacgagcag

SEQ ID NO: 19436 - RNA, 360 nt, Artificial Sequence
  derived and/or modified sequence opt2 from anti-HIV_Chain
uacauccagaugacccagucccccuccucccucuccgccuccaucggcgaccgcgucaccaucaccugccaggccggccagggcaucggcuccucccucaacugguaccagcagaagcccggcaaggcccccaagcuccucguccacggcgccuccaaccuccagcgcggcgucuccucccgcuucuccggcuccggcuuccacaccaccuucacccucaccaucuccucccuccgccccgaggacgucggcaccuacuucugcgaggucuacgaguucaucggccccggcaccaaggucgacaucaagcgcaccgucgccgcccccuccgucuucaucuucccccccuccgacgagcag

SEQ ID NO: 19437 - RNA, 360 nt, Artificial Sequence
  derived and/or modified sequence opt2 from anti-HIV_Chain
gacauccagaugacccagucccccuccucccuccccgccuccgucggcgacaccgucaccaucaccugccaggccggccagggcaucggcuccucccuccagugguaccagcagcgccccggccgcgcccccaaccuccucgucuacgacgccuccaaccuccagcgcggcguccccucccgcuucaccggcaccggcuuccacaccaccuucacccucaccauccgcggccuccgccccgaggacuucggcaccuacuucugcgccucccucgaguucuucggccccggcaccaaggucgacaucaagcgcaccgucgccgcccccuccgucuucaucuucccccccuccgacgagcag

SEQ ID NO: 19438 - RNA, 360 nt, Artificial Sequence
  derived and/or modified sequence opt2 from anti-HIV_Chain
gacauccagaugacccagucccccuccucccucuccgccuccgucggcgaccgcgucaccaucaccugccaggccucccagggcaucggcuccucccuccagugguaccagcagaagcccggccgcgcccccaaccuccucguccacggcgccuccaaccuccaccgcggcguccccucccgcuucuccggcuccggcuuccacaccaccuucucccucaccaucuccggccuccagcgcgacgacuucgccaccuacuucugcgccguccucgaguucuucggccccggcaccaaggucgacaucaagcgcaccgucgccgcccccuccgucuucaucuucccccccuccgacgagcag

SEQ ID NO: 19439 - RNA, 360 nt, Artificial Sequence
  derived and/or modified sequence opt2 from anti-HIV_Chain
gacauccagaugacccagucccccuccucccucuccgucuccgucggcgaccgcgucuccaucaccugccgcgccacccagggcaucggcaacucccucaacugguaccagcagaagcccggcaaggcccccaagguccucaucuacggcaccaccaagcuccacggcggcguccccucccgcuucuccggcggcggcuccggcuccaccggcacccucaccaucgacucccuccagcccgaggacaucgccaccuacuucugccagcucuucgaguucuucggccccggcaccaaggucgagaucaagcgcaccgucgccgcccccuccgucuucaucuucccccccuccgacgagcag

SEQ ID NO: 19440 - RNA, 360 nt, Artificial Sequence
  derived and/or modified sequence opt2 from anti-HIV_Chain
gacauccagaugacccagucccccuccucccucuccgccuccgucggcgaccgcgucaccaucaccugccaggccggccagggcaucggcuccucccucaacugguaccagcagaagcccggccgcgcccccaagcuccucgucuacggcgccuccaaccuccagcgcggcguccccucccgcuucuccggcuccggcuuccacaccaccuucacccucaccaucuccucccuccagcccgaggacuucgccaccuacuucugcuccgucuacgaguuccucggccccggcaccaaggucgagaucaagcgcaccgucgccgcccccuccgucuucaucuucccccccuccgacgagcag

SEQ ID NO: 19441 - RNA, 360 nt, Artificial Sequence
  derived and/or modified sequence opt2 from anti-HIV_Chain
cccauguuccagcccggccaguccggcggcgucgucguccaguccggcgagucccuccaccucuccugcgaggccuccggcuucaaguucgccucccagaugaugcacuggguccgccacguccccggccgcggccucgagugggucgcccucaucuccugggacggcuccggcaagcucuucgccgacuccguccgcggccgcuucaccauccaccgcuggaacgaccgcaacucccucuaccucgacgucaagaacguccgccccgaggacgccgccaucuacuacugcacccgcaacggcuucgacgucuggggccagggcauccucgucaccgucuccuccgccuccaccaagggc

SEQ ID NO: 19442 - RNA, 363 nt, Artificial Sequence
  derived and/or modified sequence opt2 from anti-HIV_HeavyChain
gaggucaagcucgucgaguccggcggcggccucguccagcccggcggcucccuccgccucuccugcgccgccuccggcuucaccuucuccuccuucggcaugcacuggguccgccaggcccccgagaagggccucgagugggucgccuacaucuccuccggcuccuccacccuccacuacgccgacaccgucaagggccgcuucaccaucucccgcgacaacuccaagaacucccucuaccuccagaugaaccuccuccgcgccgaggacaccgccgucuacuacugcgcccgcggcucccgcaaccucucccaccgccuccucuccuacuggggccagggcacccucgucaccgucuccucc

SEQ ID NO: 19443 - RNA, 363 nt, Artificial Sequence
  derived and/or modified sequence opt2 from anti-HIV_HeavyChain
gagguccagcucgucgaguccggcggcggccucguccagcccggcggcucccuccgccucuccugcgccgccuccggcuucaccuucuccuccuucggcaugcacuggguccgccaggcccccggcaagggccucgagugggucuccuacaucuccuccggcuccuccacccuccacuacgccgacaccgucaagggccgcuucaccaucucccgcgacaacuccaagaacucccucuaccuccagaugaacucccuccgcgccgaggacaccgccgucuacuacugcgcccgcggcucccgcaaccucucccaccgccuccucuccuacuggggccagggcacccucgucaccgucuccucc

SEQ ID NO: 19444 - RNA, 363 nt, Artificial Sequence
  derived and/or modified sequence opt2 from anti-HIV_Chain
gacauccagaugacccagucccccuccucccucuccgccuccgucggcgaccgcgucaccaucaccugccaggccucccagggcaucuccaacucccucaacugguaccagcagaagcccggcaaggccccccgccuccucaucuacggcaccuccacccuccagcgcggcguccccucccgcuucuccggcuccggcuccggcacccgcuucaccgucaccaucaacucccuccagcccgaggacaucgccaccuacuucugccagcacaacgaguucuucggccgcggcaccaaggucgacaucaagcgcaccgucgccgcccccuccgucuucaucuucccccccuccgacgagcagcuc

SEQ ID NO: 19445 - RNA, 363 nt, Artificial Sequence
  derived and/or modified sequence opt2 from anti-HIV_Chain
gacauccagaugacccagucccccuccuccgucuccgccuccgucggcgaccgcgucaccaucaccugccaggccucccgcgacaccgacaacucccucaccugguaccagcagaagcccggccgcccccccaagcuccucaucuaccacgucgucaaccucggccccggcguccccucccgcuucuccggcuccgccuccuccgccacccaguccacccucaucaucuccgacuuccagcccgacgacgucgccaccuacuucugccagaacuacgaguucuucggccccggcaccaaggucgagaucaagcgcaccgucgccgcccccuccgucuucaucuucccccccuccgacgagcag

SEQ ID NO: 19446 - RNA, 363 nt, Artificial Sequence
  derived and/or modified sequence opt2 from anti-HIV_Chain
gagaucguccucacccagucccccggcacccucucccucucccccggcgagcgcgccacccucuccugccgcgccucccaguccgucuccuccaacaaccucgccugguaccagcagaagcccggccaggccccccgccuccucauguccggcgccuccucccgcgccaccggcauccccgaccgcuucuccggcuccggcuccggcaccgacuucacccucaccaucucccgccucgagcccgaggacuucgccgucuaccacugccagcaguacggcuccuccccccccaccuucggccagggcaccaaggucgagaucaagcgcaccgucgccgcccccuccgucuucaucuuccccccc

SEQ ID NO: 19447 - RNA, 363 nt, Artificial Sequence
  derived and/or modified sequence opt2 from anti-HIV_Chain
gacauccagaugacccagucccccuccucccucuccgccuacgucggcgaccgcgucaccaucaccugccgcgccucccagaacaucaacaccuaccucaacugguaccagcagcgccccggcaaggcccccaagcuccucaucuacgccgccuccacccuccaguccggcguccccucccgcuucuccggcuccggcuccggcaccgacuucacccucaccaucuccaaccucgagaccgaggacuucgccgucuacuacugccagcagaccuaccgcuccgucaccuucggccagggcaccaagcucgagaucaagcgcaccgucgccgcccccuccgucuucaucuucccccccuccgac

SEQ ID NO: 19448 - RNA, 363 nt, Artificial Sequence
  derived and/or modified sequence opt2 from anti-HIV_Chain
gacauccagaugacccagucccccuccucccucuccgccuccgucggcgaccgcgucaccaucaccugccaggccggccagggcaucggcuccucccuccagugguaccagcagaagcccggcaaggcccccaagcuccucguccacggcgccuccaaccuccaccgcggcguccccucccgcuucuccggcuccggcuuccacaccaccuucucccucaccaucuccggccuccagcgcgacgacuucgccaccuacuucugcgccgucgucgaguucuucggccccggcaccaaggucgacaucaagcgcaccgucgccgcccccuccgucuucaucuucccccccuccgacgagcagcuc

SEQ ID NO: 19449 - RNA, 363 nt, Artificial Sequence
  derived and/or modified sequence opt2 from anti-HIV_Chain
cagguccagcucgucgaguccggcgccgagcuccgcaagcccggcgagucccucgagaucuccugcaaggccuccggcuacuccuucuccucccacuggaucggcugggcccgccagaugcccggcaagggccucgaguggaugggcaucaucuaccccggcgacuccaacaccaucuacucccccuccuuccagggccaggucaccaucuccgccgacaaguccaucaacaccgccuaccuccagugguccucccucaaggccuccgacaccgccauguacuucugcgccuccaacuaccacgacuacuucuacuggggccagggcacccucgucaccgucuccuccgccuccaccaagggc

SEQ ID NO: 19450 - RNA, 363 nt, Artificial Sequence
  derived and/or modified sequence opt2 from anti-HIV_Chain
uucguccagcucgucgaguccggcggcggcgucguccagcccggcaccucccuccgccucuccugcaccaccuccggcuucaucuucuccgacuacggcaugcacuggguccgccaggccgccggcaagggccucgagugggucgccgucaucuggcacgacggcuccaaccgcuucuacgccgacuccgucaagggccgcuucaccaucucccgcgacaacuccaagaacgccgucuaccucgagaugaacaaccuccgcgucgaggacaccgcccucuacuacugcgcccgcaccuccauggacaucgacuacuggggccagggcacccccgucaccgucuccuccgccuccaccaagggc

SEQ ID NO: 19451 - RNA, 363 nt, Artificial Sequence
  derived and/or modified sequence opt2 from anti-HIV_Chain
gagcccauguuccagcccggccaguccggcggcgucgucguccaguccggcgagucccuccaccucuccugcgaggccuccggcuucaaguucgccucccagaugaugcacuggguccgccacguccccggccgcggccucgagugggucgcccucaucuccugggacggcuccggcaagcucuucgccgacuccguccgcggccgcuucaccauccaccgcuggaacgaccgcaacucccucuaccucgacgucaagaacguccgccccgaggacgccgccaucuacuacugcacccgcaacggcuucgacgucuggggccagggcauccucgucaccgucuccuccgccuccaccaagggc

SEQ ID NO: 19452 - RNA, 366 nt, Artificial Sequence
  derived and/or modified sequence opt2 from anti-HIV_Chain
ucccagcaccucguccaguccggcacccaggucaagaagcccggcgccuccguccgcaucuccugccaggccuccggcuacuccuucaccgacuacguccuccacugguggcgccaggcccccggccagggccucgaguggaugggcuggaucaagcccgucuacggcgcccgcaacuacgcccgccgcuuccagggccgcaucaacuucgaccgcgacaucuaccgcgagaucgccuucauggaccucuccggccuccgcuccgacgacaccgcccucuacuucugcgcccgcgacggcuccggcgacgacaccuccuggcaccucgaccccuggggccagggcacccucgucaucgucuccgcc

SEQ ID NO: 19453 - RNA, 366 nt, Artificial Sequence
  derived and/or modified sequence opt2 from anti-HIV_Chain
gacauccagaugacccagucccccuccucccucuccgccuccgucggcgaccgcgucaccaucaccugccgcgccucccaguccaucucccgcuaccucaacugguaccagcagaagcccggcaaggcccccaagcuccucaucuacgccgccuccucccuccagggcggcguccccucccgcuucuccggcuccggcuccggcaccgacuucacccucaccaucuccucccuccagcccgaggacuucgccaccuacuacugccagcaguccuccuccaagcccuucaccuucggcggcggcaccaaggucgagaucaagcgcaccgucgccgcccccuccgucuucaucuucccccccuccgac

SEQ ID NO: 19454 - RNA, 366 nt, Artificial Sequence
  derived and/or modified sequence opt2 from anti-HIV_Chain
gagaucguccucacccagucccccggcacccucucccucucccccggcgagcgcgccacccucuccugccgcgccucccaguccaucuccuccaacuaccucgccugguaccagcagaagcccggccaggccccccgccuccucaucuacggcgccuccacccgcgccaccggcauccccgaccgcuucuccggcuccggcuccggcaccgacuucacccucuccaucucccgccucgagcccgaggacaucgccgucuacuacugccaccaguacggcuccucccagcgcuucggccagggcaccaaggucgagaucaagcgcaccgucgccgcccccuccgucuucaucuucccccccuccgac

SEQ ID NO: 19455 - RNA, 366 nt, Artificial Sequence
  derived and/or modified sequence opt2 from anti-HIV_Chain
gagaucgucaugacccagucccccgccacccucuccgucucccccggcgaccgcgccacccucuccugccgcgccucccaguccgucuccaccaaccucgccugguaccagcagaagcccggccaggccccccgccuccucaucuacggcgccuccacccgcgccaccggcauccccgccaccuucuccggcuccggcuucgccaccgaguucacccucaccaucuccucccuccaguccgaggacuucgccgucuacuacugccagcaguacaacaacuggccccccgccuucggccagggcaccaaggucgagaucaagcgcaccgucgccgcccccuccgucuucaucuucccccccuccgac

SEQ ID NO: 19456 - RNA, 366 nt, Artificial Sequence
  derived and/or modified sequence opt2 from anti-HIV_Chain
gacauccagaugacccagucccccgccucccucuccgccuccgucggcgaccgcgucaccaucaccugccgcgccucccagggcaucucccacuaccucgccugguaccagcagaagcccggcaaggucccccgccuccucaucuacgccgccucccgccuccaguccggcgucaccucccgcuucuccggcuccggcuccggcaccgaguucacccucaccaucuccucccuccuccccgaggacgccgccgucuacuucugccagaaguacgacaccgaccccaugaccuucggccagggcacccgccucgagaucaagcgcaccgucgccgcccccuccgucuucaucuucccccccuccgac

SEQ ID NO: 19457 - RNA, 366 nt, Artificial Sequence
  derived and/or modified sequence opt2 from anti-HIV_Chain
caguccgcccucacccagccccccuccgccuccggcgcccccggccagcgcgucaccaucuccugcuccggcggccccuccaacgucggcggcaacuacgucuacugguaccgccaguuccccggcaccgcccccaaccuccucauccuccgcgacgaccagcgccccuccggcguccccgaccgcuucuccgccuccaaguccggcaacuccgccucccucgccaucuccggccuccgccccgacgacgaggccuucuacuucugcgccaccuacgacuccgacggcuccauccgccucuucggcggcggcaccacccucaccguccucucccagcccaaggccgcccccuccgucacccucuuc

SEQ ID NO: 19458 - RNA, 366 nt, Artificial Sequence
  derived and/or modified sequence opt2 from anti-HIV_Chain
gacauccagaugacccagucccccuccucccucuccgccuccgucggcgaccgcgucaccaucaacugccaggccggccagggcaucggcuccucccucaacugguaccagaagaagcccggccgcgcccccaagcuccucguccacggcgccuccaaccuccagcgcggcguccccucccgcuucuccggcuccggcuuccacaccaccuucacccucaccaucuccucccuccagcccgacgacgucgccaccuacuucugcgccgucuuccagugguucggccccggcaccaaggucgacaucaagcgcaccgucgccgcccccuccgucuucaucuucccccccuccgacgagcagcucaag

SEQ ID NO: 19459 - RNA, 366 nt, Artificial Sequence
  derived and/or modified sequence opt2 from anti-HIV_Chain
gacauccagaugacccagucccccuccucccucuccgccuccgucggcgaccgcgucaccaucaccugccaggccucccagggcaucggcuccucccuccagugguaccagcagaagcccggccgcgcccccaaccuccucguccacggcgccuccaagcuccaccgcggcguccccucccgcuucuccggcuccggcuuccacaccaccuucucccucaccaucuccggccuccagcgcgacgacuucgccaccuacuucugcgccguccucgaguucuucggccccggcaccaaggucgagaucaagcgcaccgucgccgcccccuccgucuucaucuucccccccuccgacgagcagcucaag

SEQ ID NO: 19460 - RNA, 366 nt, Artificial Sequence
  derived and/or modified sequence opt2 from anti-HIV_Chain
cagguccaccucguccaguccggcgccgaggucaagaagcccggcgccuccgucaaggucuccugcaaggucuccggcuacacccucuccgagcucuccauccacuggguccgccagggccccggccgcggccucgaguggauggccaacuucgaccccgaggacggcgagaccaucuacgccccccaguuccagggccgcgucacccucaccgaggacaccuccaccgacaccgccuacaugcagcucaccucccuccgcuccgaggacaccgccgucuacuacugcgccaccgaccgcuacaccgacaccggccgcuggggccccggcacccucgucaccgucuccuccgccuccaccaagggc

SEQ ID NO: 19461 - RNA, 366 nt, Artificial Sequence
  derived and/or modified sequence opt2 from anti-HIV_Chain
cagguccagcucgucgaguccggcggcggccucauccagcccggcggcucccuccgccucuccugcgaggccuccggcuucgccgucggcgacaucaacuacauguccuggguccgccaggcccccggcaagggccucgagugggucuccguccucuacuccggcggcuccucccaguacgccgacuccgucaagggccgcuucaccaucucccgcgacaacucccgcaacacccucuaccuccagauggacaaccuccgcgccgaggacaccgccgucuacuacugcgcccgcggccuccgcgucuacuucgaccucuggggccagggcauccucgucaccgucuccuccgccuccaccaagggc

SEQ ID NO: 19462 - RNA, 366 nt, Artificial Sequence
  derived and/or modified sequence opt2 from anti-HIV_Chain
cagguccagauggucgccuccggcggcggccucgucaagcccggcggcucccuccgccucuccugcgaggccuccggcuucaccuucuccgacuacuacauguccuggguccgccaggcccccggcaagggccucgaguggaucuccuacaucaccuccggcggcaacgcccucuacuacgccgacuccgucaagggccgcuucaccaucucccgcgacaacgccaagaacucccucuaccuccagaugaacucccuccgcgccgaggacaccgccgucuacuacugcgcccgcgaccuccuccacgcccacgacuucggccgccagggcacccucgucaccgucuccuccgccuccaccaagggc

SEQ ID NO: 19463 - RNA, 366 nt, Artificial Sequence
  derived and/or modified sequence opt2 from anti-HIV_Chain
cagcuccagcucgucgaguccggcggcggcgucguccagcccggccgcucccuccgccucuccugcgccgccuccggcuucaccuucuccaccuacaccaugcacuggguccgccaggcccccggcaagggccucgagugggucgccgucaucuccuacgacggcaccaacaaguacuacgccgacuccgucaagggccgcuucaccaucucccgcgacaacuccaagaacacccucuaccuccagaugaacucccuccgcggcgaggacaccgccgucuacuacugcgcccgcucccccuccuacuacuucgacuacuggggccagggcacccucgucaccgucuccgccgccuccaccaagggc

SEQ ID NO: 19464 - RNA, 369 nt, Artificial Sequence
  derived and/or modified sequence opt2 from anti-HIV_Chain
cagguccaccucucccaguccggcgccgccgucaccaagcccggcgccuccguccgcgucuccugcgaggccuccggcuacaagaucuccgaccacuucauccacugguggcgccaggcccccggccagggccuccagugggucggcuggaucaaccccaagaccggccagcccaacaacccccgccaguuccagggccgcgucucccucacccgccaggccuccugggacuucgacaccuacuccuucuacauggaccucaaggccguccgcuccgacgacaccgccaucuacuucugcgcccgccagcgcuccgacuucugggacuucgacgucuggggcuccggcacccaggucaccgucuccucc

SEQ ID NO: 19465 - RNA, 369 nt, Artificial Sequence
  derived and/or modified sequence opt2 from anti-HIV_Chain
cagguccagcuccuccaguccggcgccgucgucaccaagcccggcgccuccguccgcgucuccugcgaggccuccggcuacaagauccgcgacuacuucauccacugguggcgccaggcccccggccagggccuccagugggucggcuggaucaacccccagaccggccagcccaacaucccccgccccuuccagggccgcgucacccucacccgccacgccuccugggacuucgacaccuucuccuucuacauggaccucaaggcccuccgcuccgacgacaccgccaucuacuucugcgcccgccgccgcuccgacuacugcgacuucgacgucuggggcuccggcacccacgucaccgucuccucc

SEQ ID NO: 19466 - RNA, 369 nt, Artificial Sequence
  derived and/or modified sequence opt2 from anti-HIV_Chain
cagguccagcuccuccaguccggcgccgccgucaccaagcccggcgccuccguccgcgucuccugcgaggccuccggcuacaacauccgcgacuacuucauccacugguggcgccaggcccccggccagggccuccagugggucggcuggaucaaccccaagaccggccagcccaacaacccccgccaguuccagggccgcgucucccucacccgccacgccuccugggacuucgacaccuucuccuucuacauggaccucaagggccuccgcuccgacgacaccgccaucuacuucugcgcccgccagcgcuccgacuacugggacuucgacgucuggggcuccggcacccaggucaccgucuccucc

SEQ ID NO: 19467 - RNA, 369 nt, Artificial Sequence
  derived and/or modified sequence opt2 from anti-HIV_Chain
cagguccagcuccuccaguccggcgccgccgucaccaagcccggcgccuccguccgcgucuccugcgaggccuccggcuacaacauccgcgacuacuucauccacugguggcgccaggcccccggccagggccuccagugggucggcuggaucaaccccaagaccggccagcccaacaacccccgccucuuccagggccgcgucucccucacccgccacgccuccugggacuucgacaccuucuccuucuacauggaccucaaggccguccgcuccgacgacaccgccgucuacuucugcgcccgccagcgcuccgacuacugggacuucgacgucuggggcuccggcacccaggucaccgucuccucc

SEQ ID NO: 19468 - RNA, 369 nt, Artificial Sequence
  derived and/or modified sequence opt2 from anti-HIV_Chain
cagguccgccuccuccaguccggcgccgccgucaccaagcccggcgccuccguccgcgucuccugcgaggccuccggcuacgagauccgcgacuacuucauccacugguggcgccaggcccccggccagggccuccagugggucggcuggaucaaccccaagaccggccagcccaacaacccccgccaguuccagggccgcgucucccucacccgccaggccuccugggacuucgacuccuacuccuucuacauggaccucaaggcccuccgcuccgacgacaccggcgucuacuucugcgcccgccagcgcuccgacuacugggacuucgacgucuggggcuccggcacccaggucaccgucuccucc

SEQ ID NO: 19469 - RNA, 369 nt, Artificial Sequence
  derived and/or modified sequence opt2 from anti-HIV_Chain
cagguccagcuccuccaguccggcgccgccgucaccaagcccggcgccuccguccgcgucuccugcgaggccuccggcuacaacauccgcgacuacuucauccacugguggcgccaggcccccggccagggccuccagugggucggcuggaucaaccccaagaccggccagcccaacaacccccgccaguuccagggccgcgucucccucacccgccacgccuccugggacuucgacaccuucuccuucuacauggaccucaaggcccuccgcuccgacgacaccgccgucuacuucugcgcccgccagcgcuccgacuacugggacuucgacgucuggggcuccggcacccaggucaccgucuccucc

SEQ ID NO: 19470 - RNA, 369 nt, Artificial Sequence
  derived and/or modified sequence opt2 from anti-HIV_Chain
gagguccagcucgucgaguccggcggcggccucauccagcgcggcggcucccuccgccucuccugcgucgccuccggcuuccccgucuccgacaaccacauguccuggguccgccaggcccccggcaagggccucgagugggucuccaucaucuacuccgacggcggcaccuacuacgccgacuccgucaagggccgcuucaccaucucccgcgacaacuccaagaacaccgucuaccuccagaugaacucccuccgcgccaccgacaccgccgucuacuacugcgcccgcgaccccggcuuccacuacggccucgacgucuggggccagggcaccaccgucaccgucuccuccgccuccaccaagggc

SEQ ID NO: 19471 - RNA, 369 nt, Artificial Sequence
  derived and/or modified sequence opt2 from anti-HIV_Chain
cagguccagcuccaggaguccggccccggccuccuccgcccccucgagacccucucccucaccugcuccgucuccggcggcuccauccgcggcuacuucugguccuggguccgccagcccgccggccgcggccucgaguggaucggccgcaucuacuccuccggcaccacccgcuucaaccccucccucaagucccgcguccgccucuccaucgacaccgccaaguccgaggucucccucaacaucaccuccgucaccgccgccgacuccgccuccuacuucugcgccggcaccucccccguccacggcggccucgaccucuggggccucggccuccgcgucaccgucuccuccgccuccaccaagggc

SEQ ID NO: 19472 - RNA, 369 nt, Artificial Sequence
  derived and/or modified sequence opt2 from anti-HIV_Chain
gagaucguccucacccagucccccggcacccucucccucucccccggcgagcgcgccacccucuccugccgcgccucccaguccgucuccuccaaccucgccugguacgcccagaagcccggccaggccccccgccucaucaucuacggcgccuccucccgcgccuccgccauccccgaccgcuuccgcggcuccggcuccggcaccgacuucacccucaccaucucccgccucgagcccgaggacuucgccgucuacuacugccagcaguacgacgacgcccccaucaccuucggccacggcacccgccucgagaucaagcgcaccgucgccgcccccuccgucuucaucuucccccccuccgacgag

SEQ ID NO: 19473 - RNA, 369 nt, Artificial Sequence
  derived and/or modified sequence opt2 from anti-HIV_Chain
gagaucguccucacccagucccccggcacccucucccucucccccggcgaccgcgccgcccucuccugccgcgccuccgagacccucuccggcaacucccucgccugguaccagcagaagcgcggccagcccccccgccuccucaucuucgccgccuccucccgcgccaccggcauccccgagcgcuucuccggcggcggcuccggcaccgacuucacccucaccaucacccgccucgagcccgaggacuucgccgucuacuucugccagcaguacgucgacgcccccaucaccuucggccagggcacccgccucgagaucaagcgcaccgucgccgcccccuccgucuucaucuucccccccuccgac

SEQ ID NO: 19474 - RNA, 369 nt, Artificial Sequence
  derived and/or modified sequence opt2 from anti-HIV_Chain
gacauccagaugacccagucccccuccucccucuccgccuccgucggcgaccgcgucaccaucaccugccgcgccucccaggacaucaccaccuaccucgccuggcuccagcagaagcccggcaaggcccccaagucccucaucuacuccgccuccaccguccaguccggcguccccucccgcuucuccggcuccggcuccggcaccgaguucacccucaccaucuccggccuccagcccgaggacuucgccaccuacuacugccagcaguacaacuacuaccccaucaccuucggccucggcacccgccucgagaucaagcgcaccgucgccgcccccuccgucuucaucuucccccccuccgacgag

SEQ ID NO: 19475 - RNA, 369 nt, Artificial Sequence
  derived and/or modified sequence opt2 from anti-HIV_Chain
gacauccagaugacccagucccccuccucccucuccgccuccaucggcgaccgcgucaccaucaccugccgcgccaaccagcacauccgcuccuuccucaacugguaccagcagacccccggcaaggcccccaagcuccucaucuacgccgccuccacccuccagcgcggcguccccucccgcuucuccggcuccggcuccggcaccgacuucacccucaccaucaccucccucgagcgcgaggaccucgccaccuacuacugccagcagaccuacaccucccccaucaccuucggccagggcacccgccucgagaucaagcgcaccgucgccgcccccuccgucuucaucuucccccccuccgacgag

SEQ ID NO: 19476 - RNA, 369 nt, Artificial Sequence
  derived and/or modified sequence opt2 from anti-HIV_Chain
uccgagaucguccucacccagucccccgccacccucucccucucccccggcgaguccgccacccucuccugccgcgccucccagucccucuccuccucccucgccugguaccagcagaagcccggccaggccccccgccuccucaucuacgacaccuccgaccgcgccaccggcauccccgcccgcuucuccggccgcggcuccggcaccgacuucacccucaccaucuccucccucgagcccgaggacuucgccgucuacuacugccagcagcgcuccaacugggccaucaccuucggccagggcacccgccucgagaucaagcgcaccgucgccgcccccuccgucuucaucuucccccccuccgac

SEQ ID NO: 19477 - RNA, 369 nt, Artificial Sequence
  derived and/or modified sequence opt2 from anti-HIV_Chain
cagguccucuccgucuccggcacccccggccagcgcgucaucaucuccugcuccggcaccuccuccaacgucggcggcaaccucgucuccugguaccagcaccuccccggcgccgccccccgccuccucauccaccgcgacgaccagcgccccuccggcguccccgaccgcuucuccggcuccaaguccggcaacuccgccucccucgucaucuccggccuccgcuccgacgacgaggccgacuacuucugcgccgccuacgacuccaccuucucccuccccgucuucggcggcggcacccgccucaccguccucucccagcccaaggccgcccccuccgucacccucuacgcccccuccuccgaggag

SEQ ID NO: 19478 - RNA, 369 nt, Artificial Sequence
  derived and/or modified sequence opt2 from anti-HIV_Chain
gacauccagaugacccagucccccuccucccucuccgccuccgucggcgaccgcgucaccaucaccugccaggccggccagggcaucggcuccucccuccagugguaccagcagaagcccggcaaggcccccaagcuccucguccacggcgccuccaaccuccaccgcggcguccccucccgcuucuccggcuccggcuuccacaccaccuucucccucaccaucuccggccuccagcgcgacgacuucgccaccuacuucugcgccguccucgaguucuucggccccggcaccaaggucgagaucaagcgcaccgucgccgcccccuccgucuucaucuucccccccuccgacgagcagcucaagucc

SEQ ID NO: 19479 - RNA, 369 nt, Artificial Sequence
  derived and/or modified sequence opt2 from anti-HIV_Chain
gagaucguccucacccagucccccgccacccucucccucucccccggcgagcgcgccacccucuccugccgcgccucccagggccucaacuucgucgucugguaccagcagaagcgcggccaggccccccgccuccucauccacgcccccuccgaccgcgcccccggcguccccgaccgcuucuccgcccgcggcuccggcaccgacuucucccucgucaucuccuccgucgagcccgacgacuucgccaucuacuacugccaggaguacuccuccacccccuacaacuucggccccggcacccgcgucgaccgcaagcgcaccgucgccgcccccuccgucuucaucuucccccccuccgacgagcag

SEQ ID NO: 19480 - RNA, 369 nt, Artificial Sequence
  derived and/or modified sequence opt2 from anti-HIV_Chain
gagaucguccucacccagucccccaccacccucucccucucccccggcgagcgcgccacccucuccugccgcgccucccagggcgucaaccucgucgucugguaccagcagaagcgcggccaggccccccgccuccucaucuacggccccuccgaccgcgcccccggcguccccgaccgcuucuccgcccgcggcuccggcaccgaguucucccucgucaucuccuccgucgagcccgacgacuucgcccucuacuacugccaggaguacuccuccacccccuacaacuucggcaccggcacccgcgucgaccgcaagcgcaccgucgccgcccccuccgucuucaucuucccccccuccgacgagcag

SEQ ID NO: 19481 - RNA, 369 nt, Artificial Sequence
  derived and/or modified sequence opt2 from anti-HIV_Chain
gagaucguccucacccagucccccgccacccucucccucucccccggcgagcgcgccacccucuccugccgcgccucccagggcgucaacuucgucgucugguaccagcagaagcgcggccaggccccccgccuccucaucuacggccccuccaaccgcgcccccggcguccccgaccgcuucuccgcccgcggcuccggcaccgaguucucccucgucaucuccuccgucgagcccgacgacuucgcccucuacuacugccaggaguacuccuccacccccuacaacuucggccccggcacccgcgucgaccgcaagcgcaccgucgccgcccccuccgucuucaucuucccccccuccgacgagcag

SEQ ID NO: 19482 - RNA, 369 nt, Artificial Sequence
  derived and/or modified sequence opt2 from anti-HIV_Chain
gagaucguccucacccagucccccgccacccucucccucucccccggcgagcgcgccacccucuccugccgcgccucccagggccucaacuucgucgucugguaccagcagaagcgcggccaggccccccgccuccucauccacggccccucccaccgcgcccccggcguccccgaccgcuucuccgcccgcggcuccggcaccgaguucucccucgucaucuccuccgucgagcccgacgacuucgccaucuacuacugccaggaguacuccuccacccccuacaacuucggccccggcacccgcgucgaccgcaagcgcaccgucgccgcccccuccgucuucaucuucccccccuccgacgagcag

SEQ ID NO: 19483 - RNA, 369 nt, Artificial Sequence
  derived and/or modified sequence opt2 from anti-HIV_Chain
gagaucguccucacccagucccccgccacccucucccucucccccggcgagcgcgccacccucuccugccgcgccucccagggccucaacuucgucgucugguaccagcagaagggcggccaggccccccgccuccucauccacggccccaccgaccgcgcccccggcguccccgaccgcuucuccgcccgcggcuccggcaccgaguucucccucgucaucuccuccgucgagcccgacgacuucgcccucuacuacugccaggaguacuccuccacccccuacaacuucggccccggcacccgcgucgaccgcaagcgcaccgucgccgcccccuccgucuucaucuucccccccuccgacgagcag

SEQ ID NO: 19484 - RNA, 369 nt, Artificial Sequence
  derived and/or modified sequence opt2 from anti-HIV_Chain
gagaucguccucacccagucccccgccacccucucccucucccccggcgagcgcgccacccucuccugccgcgccucccagggccucaacuucgucgucugguaccagcagaagcgcggccaggccccccgccuccucauccacgcccccuccggccgcgcccccggcguccccgaccgcuucuccgcccgcggcuccggcaccgaguucucccucgucaucuccuccgucgagcccgacgacuucgccaucuacuacugccaggaguacuccuccacccccuacaacuucggccccggcacccgcgucgaccgcaagcgcaccgucgccgcccccuccgucuucaucuucccccccuccgacgagcag

SEQ ID NO: 19485 - RNA, 369 nt, Artificial Sequence
  derived and/or modified sequence opt2 from anti-HIV_Chain
cagguccagcucguccaguccggcgccgaggucaagaagcccggcuccuccgucaaggucuccugcaagaccuccggcggcuccuucuccaacuacgccuucuccuggguccgccaggcccccggcgagggccucgaguggaugggccgcaucauccccaucuucggcaccgccaaguacacccagaagcuccagggccgcgucaccaucaccgccgacaaguucaccuccaccgucuacauggagcucuccucccuccgcuccgaggacaccgccaucuacuacugcgccucccuccaccagggccccaucggcuacacccccuggcacccccccccccgcgccccccucggccaguccgucugcggc

SEQ ID NO: 19486 - RNA, 369 nt, Artificial Sequence
  derived and/or modified sequence opt2 from anti-HIV_Chain
cagguccagcucgucgaguccggcggcggccucguccagcccggcggcucccuccgcaucuccugcuccgccaccggcuucaccuucuccacccacgccaugcacuggguccgccaggcccccggcaagggccucgaguacgucuccgccaucaacuccaacggccgcuccgccuucuacgccgacuccgucaagggccgcgucaccaucucccgcgacaacuccaagaacacccucuuccuccagaugaccucccuccgcgccgaggacaccgccgucuacuacugcgucaagggcccccuccuccgcuaccucgacuccuggggccagggcacccucgucaccgucuccuccgccuccaccaagggc

SEQ ID NO: 19487 - RNA, 369 nt, Artificial Sequence
  derived and/or modified sequence opt2 from anti-HIV_Chain
gagguccagcucgucgaguccggcggcggccucguccagcccggcggcucccuccgcaucuccugcuccgccaccggcuucaccuucuccacccacgccaugcacuggguccgccaggcccccggcaagggccucgaguacgucuccgccaucaacuccaacggccgcuccgccuucuacgccgacuccgucaagggccgcgucaccaucucccgcgacaacuccaagaacacccucuuccuccagaugaccucccuccgcgccgaggacaccgccgucuacuacugcgucaagggcccccuccuccgcuaccucgacuccuggggccagggcacccucgucaccgucuccuccgccuccaccaagggc

SEQ ID NO: 19488 - RNA, 369 nt, Artificial Sequence
  derived and/or modified sequence opt2 from anti-HIV_Chain
gaggaguccggccccggccucgucaagcccucccagacccucucccucaccugcuccgucuccggcgacuccgucuccuccggcggcuacuucugguccuggauccgccagcaccccaccaagggccucgagugccucggcuacgucuacuacaccggcaacaccuacuacaaccccucccucaaguccccccccaccaucgaggucgccauggccaacaaccaggucucccucaagcucggcuccgucaccgccgccgacaccgccgucuacuacugcgcccgcaucaagcgcuuccgcggcggcaacuacuucgacaccuggggccacggccuccucgucaccgucuccuccgccuccaccaagggc

SEQ ID NO: 19489 - RNA, 369 nt, Artificial Sequence
  derived and/or modified sequence opt2 from anti-HIV_Chain
cagguccagcuccaggaguccggcuccggccucgucaagcccuccggcacccucucccucaccugcgccgucuccaacggccccaucuccuccggcaacuggugguccuggguccgccagacccccgagaagggccucgaguggaucggcgaggucuaccacuccggcuccaccaaccacaaccccucccucaagucccgcgccaccauccucgucgacaaguccaagaaccaguucucccucaaccuccgcuccgucaccgccgccgacaccgccgucuacuacugcgcccgcguccgcggcuccuggaacuucgacuacuggggccagggcauccucgucaccgucuccuccgccuccaccaagggc

SEQ ID NO: 19490 - RNA, 369 nt, Artificial Sequence
  derived and/or modified sequence opt2 from anti-HIV_HeavyChain
gagguccagcuccagcaguccggcaccguccucgcccgccccggcgccuccgucaagauguccugcaaggccuccggcuacaccuucaccuccuacuggaugcacugggucaagcagcgccccggccagggccucgaguggaucggcgccaucuaccccggcaacuccgacaccuccuacaaccagaaguucaagggcaaggccaagcucaccgccgucaccuccgccuccaccgccuacauggagcucuccucccucaccaacgaggacuccgccgucuacuacugcacccgcuggccccacuacuacggcggcucccgcuacuacuucgacuacuggggccagggcaccacccucaccgucuccucc

SEQ ID NO: 19491 - RNA, 372 nt, Artificial Sequence
  derived and/or modified sequence opt2 from anti-HIV_Chain
gucguccagcucgucgaguccggcggcggccucguccagcccggcggcucccuccgccucuccugcgccgccuccggcuucgccuuccgcuccuacuggauguccuggguccgccaggcccccggccgcggccucgagugggucgccaacaucaagcaggacggcuccgagaaguacuacgccgacuccgucaagggccgcuucaccaucucccgcgacaacaccaagaacucccucuaccuccagaugaacucccuccgcgccgaggacaccgccgucuucuacugcgccucccgcggcgaccgcuacggccccaucgacuacuggggccagggcacccucgucaccgucuccuccgccuccaccaagggc

SEQ ID NO: 19492 - RNA, 372 nt, Artificial Sequence
  derived and/or modified sequence opt2 from anti-HIV_Chain
cagguccagcucguccaguccggcgccgagaucaagaagcccggcgagucccucaagaucuccugcaaggccuccggcuacaccuucaacgacuacuggaucggcuggguccgccagaugcccggcaagggccucgaguggaugggcaucuucuaccccgacgacuccgacuccaacuacucccccuccuuccagggccgcgucaccaucuccgccgacaaguccaucaccaccgccuaccuccagugguccacccucaaggccuccgacuccgccauguacuucugcgcccgccuccucggcgacuccggcgccuucgacaucuggggccagggcaccauggucaucgucuccuccgccuccaccaagggc

SEQ ID NO: 19493 - RNA, 372 nt, Artificial Sequence
  derived and/or modified sequence opt2 from anti-HIV_Chain
cagguccagcucguccaguccggcggcggccucgucaagcccggcggcucccuccgccucuccugcgccgccuccggcuucaccuucuccuccuacuccaugaacuggguccgccaggcccccggcaagggccucgagugggucuccuccaucuccuccuccuccuccuacaucuacuacgccgacuccgucaagggccgcuucaccaucucccgcgacaacgccaagaacucccucuaccuccagaugaacucccuccgcgccgaggacaccgccgucuacuacugcgcccgcgagggcuccuacuacuacggcauggacgucuggggccagggcaccaccgucaccgucuccuccgccuccaccaagggc

SEQ ID NO: 19494 - RNA, 372 nt, Artificial Sequence
  derived and/or modified sequence opt2 from anti-HIV_Chain
gagaucguccucacccagucccccgccacccucuccgucucccccggcgagcgcgccacccucuccugccgcgccggccaguccgucuccuccgaccucgccugguaccagcacaagcccggccaggccccccgccuccucaucuacgacgccuccaagcgcgccaccggcauccccgcccgcuucuccggcuccggcuccggcaccgacuucacccucaccaucuccucccucgagcccgaggacuucgccgucuacuacugccagcaccgcaccaacuggccccccuccaucaccuucggccagggcacccgccucgagaucaagcgcaccgucgccgcccccuccgucuucaucuucccccccuccgac

SEQ ID NO: 19495 - RNA, 372 nt, Artificial Sequence
  derived and/or modified sequence opt2 from anti-HIV_Chain
gagaucguccucacccagucccccggcacccucucccucucccccggcgagcgcgccacccucuccugccgcgccucccaguccgucuccucccgcuaccucgccugguaccagcagaagcccggccaggccccccgccucaucaucuacgacgccuccucccgcgccuccggcauccccgaccgcuucuccggcuccggcuccgagaccgacuucacccucaccaucacccgccucgagcccgaggacuucgccgucuacuacugccagcucuacggcaccucccccaaguucaccuucggccagggcaccaagcucgagaucaagcgcaccgucgccgcccccuccgucuucaucuucccccccuccgac

SEQ ID NO: 19496 - RNA, 372 nt, Artificial Sequence
  derived and/or modified sequence opt2 from anti-HIV_Chain
gagaucguccucacccagucccccggcacccucucccucucccccggcgagcgcgccacccucuccugccgcgccucccaguccgucuccaacaacuaccucgccugguaccagcagaagcccggccaggccccccgccuccucaucuacggcgccuccucccgcgccaccggcauccccgaccgcuucuccggcuccggcuccggcaccgacuucacccucaccaucucccgccucgagcccgaggacuucgccgucuacuacugccagcaguacgccaccuccucccucuacaccuucggccagggcaccaagcucgagaucaagcgcaccgucgccgcccccuccgucuucaucuucccccccuccgac

SEQ ID NO: 19497 - RNA, 372 nt, Artificial Sequence
  derived and/or modified sequence opt2 from anti-HIV_Chain
cccgccacccucgccgucucccccggcgagcgcgccaccaucuccugcaaguccucccagaaccuccucuacuccgccaacaaccagcacucccucgccugguaccagcagcgccccggccagccccccaagcuccuccucuacugggccuccacccgccucuccggcguccccgaccgcuucuccggcuccggcuccggcaccgacuucacccucaccaucuccaaccuccaggccgaggacgucgccgucuacuacugccagcaguacuacucccccccccccaccuucggccagggcaccaaggucgagauccgccgcaccgucgccgcccccuccgucuucaucuucccccccuccgacgagcagcuc

SEQ ID NO: 19498 - RNA, 372 nt, Artificial Sequence
  derived and/or modified sequence opt2 from anti-HIV_Chain
cagcccguccucacccagccccccuccgccuccggcgcccccggccagcgcgucaccaucuccugcuccggcggccccuccaacgucggcggcaacuacgucuacugguaccgccaguuccccggcaccgcccccaaccuccucauccuccgcgacgaccagcgccccuccggcguccccgaccgcuucuccgccuccaaguccggcaacuccgccucccucgccaucaccggccuccgccccgacgacgaggccuucuacuucugcgccaccuacgacuccgacggcuccauccgccucuucggcggcggcaccgcccucaccguccucucccagcccaaggccgcccccuccgucacccucuuccccccc

SEQ ID NO: 19499 - RNA, 372 nt, Artificial Sequence
  derived and/or modified sequence opt2 from anti-HIV_Chain
aacuucaugcucacccagccccccuccgccuccggcgcccccggccagcgcgucaccaucuccugcuccggcggccccuccaacgucggcggcaacuacgucuacugguaccgccaguuccccggcaccgcccccaaccuccucauccuccgcgacgaccagcgccccuccggcguccccgaccgcuucuccgccuccaaguccggcaacuccgccucccucgccaucuccggccuccgccccgacgacgaggccuucuacuucugcgccaccuacgacuccgacggcuccauccgccucuucggcggcggcaccacccucaccguccucucccagcccaaggccgcccccuccgucacccucuuccccccc

SEQ ID NO: 19500 - RNA, 372 nt, Artificial Sequence
  derived and/or modified sequence opt2 from anti-HIV_Chain
gacauccagaugacccaguccccccccucccucuccgccuccgucggcgaccgcgucaccaucaccugccaggccucccaggacaucaacaacuuccucaacugguaccagcagaagcccggcaaggccccccgccuccucaucuacgacgccuccaaccucgaguccggcgucuccucccgcuucuccggcucccgcuccggcaccgacuucacccucaccaucuccucccuccuccccgaggacaucgccaccuacuccugccagcaguacuccaaccuccccuacaccuucucccagggcaccaagcucgagaucaagcgcaccgucgccgcccccuccgucuucaucuucccccccuccgacgagcag

SEQ ID NO: 19501 - RNA, 372 nt, Artificial Sequence
  derived and/or modified sequence opt2 from anti-HIV_Chain
cagguccagcucguccaguccggcaccgccgucaagcgccccggcgccuccguccgcgucuccugccaggccuccggcuacaccuucaucgaccacuucaucuacugguggcgccaggcccccggccagggccucgaguggcucggcuggaucaacccccucaccucccagcccuccuaccccucccgcuuccagggccgccucacccucacccgcgacaccuucgacgagaugcucuacauggaccuccgcggccuccgcuccgacgacaccggcaucuacuucugcgcccgccgccacuccgacuacugcgacuucgacaucuggggcuccggcacccagaucaucgucuccuccgccuccaccaagggc

SEQ ID NO: 19502 - RNA, 372 nt, Artificial Sequence
  derived and/or modified sequence opt2 from anti-HIV_Chain
cagguccagcucguccaguccggcgccgcccucaagaagcccggcgccucccuccgcaucuccugccaggccuacggcuacaaguucaccgaccaccucaucuacugguggcgccaggcccccggccagggccucgaguggaucggcuggaucaagcccgagaccggccagcccuccuacuccuacaaguuccagggccgcgucucccucacccgcgacaccuuccaggagauccucuucauggaccuccgcggccuccgcuccgacgacaccgccaucuacuucugcgcccgccgccacuccgacuacugcgacuucgacgucuggggcuccggcucccaggucaucgucuccuccgccuccaccaagggc

SEQ ID NO: 19503 - RNA, 372 nt, Artificial Sequence
  derived and/or modified sequence opt2 from anti-HIV_Chain
cagguccagcucguccaguccggcgccgcccucaagaagcccggcgccucccuccgcaucuccugccagaccuacggcuacaaguucaccgaccaccucaucuacugguggcgccaggcccccggccagggccucgaguggaugggcuggaucaagcccgagaccggccagcccuccuacuccuaccgcuuccagggccgcgucucccucacccgcgacaccuucgaggagaucgucuucauggaccuccgcggccuccgcuccgacgacaccgccaucuacuucugcgcccgccgccacuccgacuacugcgacuucgacgucuggggcuccggcucccaggucaucgucuccuccgccuccaccaagggc

SEQ ID NO: 19504 - RNA, 372 nt, Artificial Sequence
  derived and/or modified sequence opt2 from anti-HIV_Chain
cagguccagcucguccaguccggcgccgcccucaagaagcccggcgccucccuccgcaucuccugccagaccuacggcuacaaguucaccgaccaccucaucuacugguggcgccaggcccccggccagggccucgaguggaucggcuggaucaagcccgagaccggccagcccuccuacuccuaccgcuuccagggccgcgucucccucacccgcgacaccuucgaggagaucgccuucauggaccuccgcggccuccgcuccgacgacaccgccaucuacuucugcgcccgccgccacaccgacuacugcgucuucgacgucuggggcuccggcucccagaucaucgucuccuccgccuccaccaagggc

SEQ ID NO: 19505 - RNA, 372 nt, Artificial Sequence
  derived and/or modified sequence opt2 from anti-HIV_Chain
cagguccagcucguccaguccggcaccgccgucaagcgccccggcgccuccguccgcgucuccugccaggccuccggcuacaccuucaccgacuacuucaucuacugguggcgccaggcccccggccagggccucgaguggcucggcuggaucaacccccucaccucccagcccuccuaccccucccgcuuccagggccgccucacccucacccgcgacaccuucgacgagaugcucuacauggaccuccgcggccuccgcuccgacgacaccggcaucuacuucugcgcccgccgccacuccgacuacugcgacuucgacaucuggggcuccggcacccagaucaucgucuccuccgccuccaccaagggc

SEQ ID NO: 19506 - RNA, 372 nt, Artificial Sequence
  derived and/or modified sequence opt2 from anti-HIV_Chain
cagguccagcucguccaguccggcgccgcccucaagaagcccggcgccuccguccgcaucuccugccaggccuacggcuacaaguucaccgaccaccucaucuacugguggcgccaggcccccggccagggccucgaguggaucggcuggaucaagcccgagaccggccagcccuccuacgccuacaaguuccagggccgcgucacccucacccgcgacaccuucgaggagauccacuucauggaccuccgcggcguccgcaacgacgacaccgccaccuacuucugcgcccgccgccacuccgacuacugcgacuucgacgucuggggcuccggcucccaggucaucgucuccuccgccuccaccaagggc

SEQ ID NO: 19507 - RNA, 372 nt, Artificial Sequence
  derived and/or modified sequence opt2 from anti-HIV_Chain
cagguccagcucguccaguccggcgccgcccucaagaagcccggcgccuccguccgcaucuccugccagaccuacggcuacaaguucaccgaccaccucaucuacugguggcgccaggcccccggccagggccucgaguggaucggcuggaucaagcccgagaccggccagcccuccuacuccuaccgcuuccagggccgcgucucccucacccgcgacaccuucgaggagaucgucuucauggaccuccgcggccuccgcuccgacgacaccgccaucuacuucugcgcccgccgccacuccgacuacugcgacuucgacgucuggggcuccggcucccagguccucgucuccuccgccuccaccaagggc

SEQ ID NO: 19508 - RNA, 372 nt, Artificial Sequence
  derived and/or modified sequence opt2 from anti-HIV_Chain
cagguccagcucguccaguccggcgccgcccucaagaagcccggcgccucccuccgcaucuccugccagaccuacggcuacaaguucaccgaccaccucaucuacugguggcgccaggcccccggccagggccucgaguggaucggcuggaucaagcccgagaccggccagcccuccuacuccuaccgcuuccagggccgcgucucccucacccgcgacaccuucgaggagaucgucuucauggaccuccgcggccuccgcuccgacgacaccgccaucuacuucugcgcccgccgccacuccgacuacugcgacuucgacgucuggggcuccggcucccagguccucgucuccuccgccuccaccaagggc

SEQ ID NO: 19509 - RNA, 372 nt, Artificial Sequence
  derived and/or modified sequence opt2 from anti-HIV_Chain
cagguccagcucguccaguccggcgccgcccucaagaagcccggcgccuccguccgcaucuccugccagaccuacggcuacaaguucaccgaccaccucauccacugguggcgccaggcccccggccagggccucgaguggaucggcuggaucaagcccgacaccggccagcccuccuacuccucccgcuuccagggccgcgucucccucacccgcgacaccuucgaggagaucgucuucauggaccuccgcggccuccgcuccgacgacaccgccaucuacuucugcgcccgccgccacuccgacuacugcgacuucgacgucuggggcuccggcucccagguccucgucuccuccgccuccaccaagggc

SEQ ID NO: 19510 - RNA, 372 nt, Artificial Sequence
  derived and/or modified sequence opt2 from anti-HIV_Chain
cagguccagcucguccaguccggcgccgcccucaagaagcccggcgccucccuccgcaucuccugccagaccuacggcuacaaguucaccgaccaccucaucuacugguggcgccaggcccccggccagggccucgaguggaucggcuggaucaagcccgagaccggccagcccuccuacuccuaccgcuuccagggccgcgucucccucacccgcgacaccuucgaggagaucgucuucauggaccuccgcggccuccgcuccgacgacaccgccaucuacuucugcgcccgccgccacuccgacuacugcgacuucgacgucuggggcuccggcucccaggucaucgucuccuccgccuccaccaagggc

SEQ ID NO: 19511 - RNA, 372 nt, Artificial Sequence
  derived and/or modified sequence opt2 from anti-HIV_Chain
cagguccagcucguccaguccggcgccgcccucaagaagcccggcgccucccuccgcaucuccugccagaccuacggcuacaaguucaccgaccaccucaucuacugguggcgccaggcccccggccagggccucgaguggaucggcuggaucaagcccgagaccggccagcccuccuacuccuaccgcuuccagggccgcgucucccucacccgcgacaccuucgaggagaucgucuucauggaccuccgcggccuccgcuccgacgacaccgccaucuacuucugcgcccgccgccacuccgacuacugcgacuucgacgucuggggcggcggcucccaggucaucgucuccuccgccuccaccaagggc

SEQ ID NO: 19512 - RNA, 372 nt, Artificial Sequence
  derived and/or modified sequence opt2 from anti-HIV_Chain
cagguccagcucguccaguccggcgccgcccucaagaagcccggcgccucccuccgcaucuccugccucaccuacggcuacaaguucaccgaccaccucaucuacugguggcgccaggcccccggccagggccucgaguggaucggcuggaucaagcccgagaccggccagcccuccuacuccuaccgcuuccagggccgcgucucccucacccgcgacaccuucgaggagaucgucuucauggaccuccgcggccuccgcuccgacgacaccgccaucuacuucugcgcccgccgccacuccgacuacugcgacuucgacgucuggggcuccggcucccaggucaucgucuccuccgccuccaccaagggc

SEQ ID NO: 19513 - RNA, 372 nt, Artificial Sequence
  derived and/or modified sequence opt2 from anti-HIV_Chain
cagguccagcucguccaguccggcgccacccucaagaagcccggcgccuccguccgcaucuccugccaggccuacggcuacaaguucaccgaccaccucauccacugguggcgccaggcccccggccagggccucgaguggaucggcuggaucaagcccgagaccggccagcccuccuacgccuacaaguuccagggccgcgucucccucacccgcgacaccuucgaggagauccucuucauggaccuccgcggccuccgcuccgacgacaccgccaucuacuucugcgcccgccgccacuccgacuacugcgaccucgacgucuggggcggcggcacccagcuccucgucuccuccgccuccaccaagggc

SEQ ID NO: 19514 - RNA, 372 nt, Artificial Sequence
  derived and/or modified sequence opt2 from anti-HIV_Chain
cagguccagcucguccaguccggcgccgcccucaagaagcccggcgccuccguccgcaucuccugccaggccuacggcuacaaguucaccgaccaccucaucuacugguggcgccaggcccccggccagggccucgaguggaucggcuggaucaagcccgagaccggccagcccuccuacuccuacaaguuccagggccgcgucacccucacccgcgacaccuucgaggagauccacuucauggaccuccgcggccuccgcuacgacgacaccgccaccuacuucugcgcccgccgccacuccgacuacugcgacuucgacgucuggggcuccggcucccaggucuccgucuccuccgccuccaccaagggc

SEQ ID NO: 19515 - RNA, 372 nt, Artificial Sequence
  derived and/or modified sequence opt2 from anti-HIV_Chain
cagguccagcucguccaguccggcgccgcccucaagaagcccggcgccucccuccgcaucuccugccaggccuacggcuacaaguucaccgaccaccucaucuacugguggcgccaggcccccggccagggccucgaguggaucggcuggaucaagcccgagaccggccagcccuccuacuccuacaaguuccagggccgcgucucccucacccgcgacaccuuccaggagauccucuucaugaaccuccgcggccuccgcuccgacgacaccgccaucuacuucugcgcccgccgccacuccgacuacugcgacuucgacgucuggggcuccggcucccagauccucgucuccuccgccuccaccaagggc

SEQ ID NO: 19516 - RNA, 372 nt, Artificial Sequence
  derived and/or modified sequence opt2 from anti-HIV_Chain
cagguccagcucguccaguccggcaccgccgucaagaagcccggcgccuccguccgcgucuccugccaggccuccggcuacaccuucaccgacuacuucaucuacugguggcgccaggcccccggccagggccucgaguggcucggcuggaucaacccccgcaccucccagcccuccuaccccuaccgcuuccagggccgcgucacccucacccgcgacaucuucgaggagaugcucuacauggaccuccgcggccuccgcuccgacgacaccggcaucuacuucugcgcccgccgccacuccgacuacugcgacuucgacaucuggggcuccggcacccagaucaucgucuccuccgccuccaccaagggc

SEQ ID NO: 19517 - RNA, 372 nt, Artificial Sequence
  derived and/or modified sequence opt2 from anti-HIV_Chain
cagguccagcucguccaguccggcgccgcccucaagaagcccggcgccucccuccgcaucuccugccaggccuacggcuacaaguucaccgacuaccucauccacugguggcgccaggcccccggccagggccucgaguggaucggcuggaucaagcccgagaccggccagcccuccuacuccuacaaguuccagggccgcgucucccucacccgcgacaccuucgaggagauccucuucauggaccuccgcggccuccgcuccgacgacaccgccaucuacuucugcgcccgccgccacuccgacuacugcgacuucgacgucuggggcggcggcucccagguccucgucuccuccgccuccaccaagggc

SEQ ID NO: 19518 - RNA, 372 nt, Artificial Sequence
  derived and/or modified sequence opt2 from anti-HIV_Chain
gagguccagcuccucgaguccggcggcgcccucguccagcccggcggcucccuccgccucuccugcgccgccuccggcuucaccuucuccaccuccuccauguccuggguccgccaggcccccggcaagggccucgagugggucuccgccaucggcuccggccgcggcuccaccuucuacgccgacuccgucaagggccgcuucaccaucucccgcgacaacuccaagaacacccucucccuccagaugaacucccucaccgccgaggacaccgccaccuacuacugcaccaagaccggcggccuccuccgcuuccccgaggucuggggcaagggcaccaccgucaccgucuccuccgccuccaccaagggc

SEQ ID NO: 19519 - RNA, 372 nt, Artificial Sequence
  derived and/or modified sequence opt2 from anti-HIV_Chain
gagguccagcucgucgaguccggcggcggccucgucaagcccggcggcucccuccgccucuccugcgccgacuccggcuucaccuuccgcuccuacuccaugcacuggguccgccaggcccccggcaagggccucgccugggucuccuccaucuccuccaccuccaacuacaucuacuacgccgacuccgucaagggccgcuucaccaucucccgcgacaacgccaagaacucccucuaccuccagaugaacucccuccgcgccgaggacaccgccgucuacuacugcgcccgcaccuucaucaccgccuccugguucgacuccuggggccagggcacccucgucaccgucuccuccgccuccaccaagggc

SEQ ID NO: 19520 - RNA, 372 nt, Artificial Sequence
  derived and/or modified sequence opt2 from anti-HIV_Chain
cagguccagcucguccaguccggcgccgaggucaagaagcccggcgccuccgucaaggucuccugcaaggccuccggcuacaccuucaccaacuacggcgucuccuggguccgccaggcccccggccagggccucgaguggaugggcuggaucucccccuacuccggcaacaccaacuacgcccagcgccuccaggaccgcgucaccaugaccaccgacaccuccaccaacaccgccuacauggagcuccgcucccuccgcuccgacgacaccgccgucuacuacugcgccgcccgcuccuacuacuacuacuccauggacgucuggggccagggcaccaccgucaccgucuccuccgccuccaccaagggc

SEQ ID NO: 19521 - RNA, 372 nt, Artificial Sequence
  derived and/or modified sequence opt2 from anti-HIV_Chain
cagguccagcucguccaguccggcgccgagcucaagaagcccggcuccuccgucaaggucuccugcaaggccuccggcggcaccuucuccaacuacgccaucaacuggguccgccaggcccccggccagggcuucgaguggaugggcggcaucaucccccucuucgccacccccaccuacgcccagaaguuccagggccgcguccgcaucaccgccgacgacuccaccuccaccgccuacauggagcucuccucccuccgcuccgacgacaccgccgucuacuucugcgcccgccccaacgucguccgcuccgcccucgacuacuggggccagggcacccucgucaccgucuccuccgccuccaccaagggc

SEQ ID NO: 19522 - RNA, 372 nt, Artificial Sequence
  derived and/or modified sequence opt2 from anti-HIV_Chain
cagguccagcucgucgaguccggcggcggcgucguccagcccggcaagucccuccgccucuccugcgccgccuccggcuucaccuucuccacccacgccaugcacuggguccgccaggcccccggcaagggccucgacugggucgccgucaucucccacgacggcgacaaccaguacuacgccgacgccgucaagggccgcuucaccaucucccgcgacgacucccgcgacaccgucuuccuccagaugaacucccuccgcaccgaggacaccggcgucuacuacugcgccgccgacuccuccggcuccaacugguucgacuacuggggccagggcauccucgucaccgucuccuccgccuccaccaagggc

SEQ ID NO: 19523 - RNA, 375 nt, Artificial Sequence
  derived and/or modified sequence opt2 from anti-HIV_Chain
cagguccgccucucccaguccggcggccagaugaagaagcccggcgaguccaugcgccucuccugccgcgccuccggcuacgaguuccucaacugccccaucaacuggauccgccucgcccccggccgccgccccgaguggaugggcuggcucaagccccgcggcggcgccgucaacuacgcccgcaaguuccagggccgcgucaccaugacccgcgacgucuacuccgacaccgccuuccucgagcuccgcucccucaccuccgacgacaccgccgucuacuucugcacccgcggcaaguacugcaccgcccgcgacuacuacaacugggacuucgagcacuggggccgcggcgcccccgucaccgucuccucc

SEQ ID NO: 19524 - RNA, 375 nt, Artificial Sequence
  derived and/or modified sequence opt2 from anti-HIV_Chain
gagguccagcucguccaguccggcuccgacguccgcaagcccggcgccaccgucaccgucuccugcaaggccgacgaggacgaggacgacuucaccgccuacaacuacuucaugcacuggguccgccaggcccccggccacggccucgaguggaucggcuggaucaacccccgcaccggccagcccaaccacgccaagcaguuccagggccgcgucacccucacccgcgagcgcuccaccuccaccgucuucaugaagcucaccaaccuccgccucgacgacaccgccgucuacuucugcgcccgcccccuccgcggcggcgacaccuggcacuaccacuccuggggccgcggcaccucccucaccgucuccucc

SEQ ID NO: 19525 - RNA, 375 nt, Artificial Sequence
  derived and/or modified sequence opt2 from anti-HIV_Chain
cagguccagcucguccaguccggcggcggccucguccagcccggcgagucccuccgccucuccugcaccgccuccggcuucaccuucuccuccuacaacaugaacuggguccgccaggcccccggcaagggccucgaguggaucuccuacaucuccgacaaguccaagaacaaguacuacgccgacuccguccgcggccgcuucaccaucucccgcgacaacgcccagaacucccucuuccuccagauguccucccuccgcgacgaggacaccgccgucuacuacugcacccgcgagggcccccagcgcuccuucuacuucgacuacuggggccagggcauccaggucaccgucuccuccgccuccaccaagggc

SEQ ID NO: 19526 - RNA, 375 nt, Artificial Sequence
  derived and/or modified sequence opt2 from anti-HIV_Chain
gagguccagcucgucgaguccggcgccgaggucaagaagcccggcuccuccgucaaggucuccugcaaggccuccggcggcaccuucuccuccuacuccaucuccuggguccgccaggcccccggccagggccucgaguggaugggcggcaucauccccaucuucgccaccacccacuacggccagaaguuccagggccgcaucaagaucaccgccgacaaguccaccuccaccgccuacauggagcucucccgccuccgcuccgaggacaccgccgucuacuacugcgcccgcgaccgcgaguucuacuucuacggcauggacgucuggggccagggcaccaccgucaccgucuccuccgccuccaccaagggc

SEQ ID NO: 19527 - RNA, 375 nt, Artificial Sequence
  derived and/or modified sequence opt2 from anti-HIV_Chain
cagcuccagcuccaggaguccggccccggccucgucaagcccugggagacccucguccucaccugcuccgucuccggcggcuccaucuccuccggcgacuacuacuggggcuggauccgccagucccccggcaagggccccgaguggaucggcaacaucuucuacuccuccggcaacaccuacuacaacaccucccucaagucccgcgucaccaucuccgucgacgucuccaagaaccgcuucucccucaagcucaccuccaugaccgccgccgacaccgccgucuacuacugcggccgccucuccaacaagggcugguucgaccccuggggccagggcacccucgucuccgucuccuccgccuccaccaagggc

SEQ ID NO: 19528 - RNA, 375 nt, Artificial Sequence
  derived and/or modified sequence opt2 from anti-HIV_Chain
gagaucguccucacccagucccccgccacccucucccucucccccggcgagcgcgccacccucuccugccgcgccucccaguccgucuccuccuaccucgccugguaccagcagaagcccggccaggccccccgccuccucaucuacgacgccuccaaccgcgccaccggcauccccgcccgcuucuccggcuccggcuccgacaccgacuucacccucaccaucuccucccucgagcccgaggacuucgccgucuacuacugccagcagcgcggcaucuggccccuccagaucaccuucggccagggcacccgccucgagaucaagcgcaccgucgccgcccccuccgucuucaucuucccccccuccgacgag

SEQ ID NO: 19529 - RNA, 375 nt, Artificial Sequence
  derived and/or modified sequence opt2 from anti-HIV_Chain
uccgagaucguccucacccagucccccggcacccucucccucucccccggcgagcgcgccacccucuccugccgcgccucccaguccgucuccuccuccuaccucgccugguaccagcagaagcccguccaggccccccgccuccucaucuacggcgccuccucccgcgccaccggcauccccgaccgcuucuccggcuccggcuccggcaccgacuucacccucaccaucucccgccucgagcccgaggacuucgccgucuacuacugccagcaguacggcacccuccacccccgcaccuucggccagggcaccaaggucgagaucaagcgcaccgucgccgcccccuccgucuucaucuucccccccuccgac

SEQ ID NO: 19530 - RNA, 375 nt, Artificial Sequence
  derived and/or modified sequence opt2 from anti-HIV_Chain
ucccaggccgucgucacccagccccccuccgucuccggcgcccccggccagcgcgucaccaucuccugcuccggcggccccuccaacgucggcggcaaccucgucuacugguacaagcaguuccccggcaccgcccccaagcuccucauccgccgcgacgaccagcgccccuccggcguccccgaccgcuucuccggcuccaaguccggcaacuccgccucccucgccaucuccggccuccgccccgacgacgaggccuucuacuucugcgccaccuacgacucccacggcuccauccgccucuucggcggcggcacccuccucaccguccucucccagcccaaggccgcccccuccgucacccucuuccccccc

SEQ ID NO: 19531 - RNA, 375 nt, Artificial Sequence
  derived and/or modified sequence opt2 from anti-HIV_Chain
gacauccagaugacccagucccccuccacccucgccgccuccaucggcggcaccguccgcgucuccugccgcgccucccaguccaucaccggcaacugggucgccugguaccagcagcgccccggcaaggccccccgccuccucaucuaccgcggcgccgcccuccucggcggcguccccucccgcuucuccggcuccgccgccggcaccgacuucacccucaccaucggcaaccuccaggccgaggacuucggcaccuucuacugccagcaguacgacaccuaccccggcaccuucggccagggcaccaaggucgaggucaagcgcaccgucgccgcccccuccgucuucaucuucccccccuccgacgagcag

SEQ ID NO: 19532 - RNA, 375 nt, Artificial Sequence
  derived and/or modified sequence opt2 from anti-HIV_Chain
gagaucgucaugacccagucccccgacacccucuccgucucccccggcgagcgcgccacccucuccugccgcgccucccaguccgucaacuccaaccucgccugguaccagcagaagcccggccaggccccccgccuccucaucuacggcgccuccacccgcgccaccgccguccccgcccgcuucuccggcuccggcuccggcaccgaguucacccucaccaucuccucccuccaguccgaggacuccgccgucuacuacugccagcaguacuaccaguggcucuccuacaccuucggccagggcaccaagcucgagaucaagcgcaccgucgccgcccccuccgucuucaucuucccccccuccgacgagcag

SEQ ID NO: 19533 - RNA, 375 nt, Artificial Sequence
  derived and/or modified sequence opt2 from anti-HIV_Chain
cgccagguccagcucguccaguccggcgccgcccucaagaagcccggcgccucccuccgcaucuccugccaggccuacggcuacaaguucaccgaccaccucaucuacugguggcgccaggcccccggccagggccucgaguggaucggcuggaucaagcccgagaccggccagcccuccuacuccuacaaguuccagggccgcgucucccucacccgcgacaccuuccaggagauccucuucauggaccuccgcggccuccgcuccgacgacaccgccaucuacuucugcgcccgccgccacuccgacuacugcgacuucgacgucuggggcuccggcucccagauccucgucuccuccgccuccaccaagggc

SEQ ID NO: 19534 - RNA, 375 nt, Artificial Sequence
  derived and/or modified sequence opt2 from anti-HIV_Chain
cagguccagcucguccaguccggcgccgcccucaagaagcccggcgccuccguccgcaucuccugccaggccuacggcuacaaguucaccgacuaccucauccacugguggcgccaggcccccggccagggccucgaguggaucggcuggaucaagcccgagaccggccagcccuccuacuccuacaaguuccagggccgcgucacccucacccgcgacaccuucgaggagauccucuucauggaccuccgcggccuccgcuccgacgacaccgccaucuacuucugcgcccgccgccacuccgacuacugcgacuucgacgucuggggcuccggcucccaggucaucgucuccuccgccuccaccaagggcgcc

SEQ ID NO: 19535 - RNA, 375 nt, Artificial Sequence
  derived and/or modified sequence opt2 from anti-HIV_Chain
gagguccagcucgucgaguccggcggcggccucgucaagcccggcggcucccuccgccucuccugcgccgccuccggcuucuccuucuccgagcacuacauguccuggauccgccucgcccccggcaagggccucgaguggcucuccuacaucuccuccuccacccgcaccaccuacuccgccgacuccguccgcggccgcuucaccaucucccgcgacaccgccaagcagcuccucuuccuccacauguccucccuccgcgccgaggacaccgccgucuacuacugcguccgccucuacggcggcaucaacggcugguucgaccaguggggccagggcacccucgucuccgucuccuccgccuccaccaagggc

SEQ ID NO: 19536 - RNA, 375 nt, Artificial Sequence
  derived and/or modified sequence opt2 from anti-HIV_Chain
cagguccagcucguccaguccggccccggccucgucaagcccuccgagacccucucccucaccugcuccgucuccaacggcuccaucuccuccggcggcuacuacugguccuggcuccgccaguuccccggcaagggccucgaguggaucggcuccauccacuacaccggccgcaccuucuacaaccccucccucaugggccgcaccgcccucuccauggacaccuccaacaaccaguucucccucaaggucuccuccgucaccgccgccgacaccgcccucuacuacugcgcccgcgagcuccaguggauguucgucgucgaccccuggggccagggcacccucgucaccgucuccuccgccuccaccaagggc

SEQ ID NO: 19537 - RNA, 375 nt, Artificial Sequence
  derived and/or modified sequence opt2 from anti-HIV_Chain
cagguccagcuccaggaguccggccccggccucgucaagcccuccgagacccucucccucaccugcuccgucuccaacggcuccaucuccuccggcggcuacuacugguccuggcuccgccaguuccccggcaagggccucgaguggaucggcuccauccacuacaccggccgcaccauguacaaccccucccucaugggccgccccgcccucuccauggacaccuccaacaaccaguucucccucaagcuccgcuccgucaccgccgccgacaccgcccucuacuucugcgcccgcgaccuccaguggaucuucgucgucgaccccuggggccagggcacccucgucaccgucuccuccgccuccaccaagggc

SEQ ID NO: 19538 - RNA, 375 nt, Artificial Sequence
  derived and/or modified sequence opt2 from anti-HIV_Chain
gagguccagcuccucgaguccggcggcggccucguccagcccggcggcucccuccgccucuccugcgccgucuccggcuucaccuucggcggccacgccgucuccuggguccgccaggcccccggcaagggccucgaguggcucucccagaucuccggcaccggcucccgcaccgacuacgccgacgccgucaagggccgcuucaccgucucccgcgacaacuccaagaagaccgucuaccuccagaugaacucccuccgcgucgaggacaccgcccucuucuacugcgccacccgcucccccggcggcggcuacgccuucgacaucuggggccagggcgccauggucaccgucuccuccgccuccaccaagggc

SEQ ID NO: 19539 - RNA, 375 nt, Artificial Sequence
  derived and/or modified sequence opt2 from anti-HIV_Chain
cagguccagcucguccaguccggcgccgaggucaagaagcccggcuccuccgucaaggucuccugcaaggucuccuucuucuccaacuacggcaucuccuggguccgccagcgccccggccagggccucgaguggaugggccgcaucauccccgccaucgacgacaugaccuacgcccagaccuuccgcggccgcgucaccuucuccgccgacaaguucaccaccaccgccuacauggagcucaccggccucaccuucgaggacaccgccaccuacuucugcgcccgcgacccccaggucaaccgccgcggcaacugcuucgaccacuggggccagggcacccucgucaccgucuccuccgccuccaccaagggc

SEQ ID NO: 19540 - RNA, 375 nt, Artificial Sequence
  derived and/or modified sequence opt2 from anti-HIV_Chain
cagguccagcuccaggaguccggccccggccucgucaagcccuccgagacccucucccucaccugcaccgucuccggcggcuccaucuccuacuacuacugguccuggauccgccagccccccggcaagggccucgaguggaucggcgacaucuacuacuccggcaccaccgacuacaaccccucccucaagucccgcgucaccaucuccgucgacaccuccaagaaccaguucucccucaagcucuccuccgucaccgccgccgacaccgccgucuacuacugcgcccgccgccgcggccagcgccuccucgccuacuucgacuacuggggccagggcucccucgucaccgucuccuccgccuccaccaagggc

SEQ ID NO: 19541 - RNA, 375 nt, Artificial Sequence
  derived and/or modified sequence opt2 from anti-HIV_Chain
cagguccagcuccaggaguccggccccggccccgucaagcccuccgagacccucucccucaccugcaccgucuccggcggcuccaugaucuccuacuacugguccuggauccgccagccccccggcaagggccucgaguggaucggcuacaucuucaccaacggccgcaccaccuacucccccucccuccgcucccgcgucaccaucucccucgacaccuccaccaaccacuucucccuccgccucaaguccgucaccgccgccgacaccgccaucuacuacugcgcccgccucgacggcgaggccuuccgcuacuaccucgaccucuggggccagggcaaccucgucaccgucuccuccgccuccaccaagggc

SEQ ID NO: 19542 - RNA, 375 nt, Artificial Sequence
  derived and/or modified sequence opt2 from anti-HIV_Chain
cagguccagcucguccaguccggcgccgaggucaagaagcccggcgccuccgucaaggucuccugcaagcccuccuccaacaccuucaccucccacuacauccacuggguccgccaggcccccggccagggccucgaguggaugggcaugaucaaccccggcggcuccacccgcuacgcccccaaguuccagggccgcgucacccucacccgcgacaccuccacccgcaccgucuacauggagcucuccucccuccgcuccgaggacaccgccgucuacuacugcgcccgcccccaguacaaccucggccgcgacccccucgacgucuggggccucggcaccauggucaccgucuccuccgccuccaccaagggc

SEQ ID NO: 19543 - RNA, 375 nt, Artificial Sequence
  derived and/or modified sequence opt2 from anti-HIV_Chain
cagguccagcuccagcaguggggcgccggccuccucaagcccuccgagacccucucccucaccugcgccgucuacggcggcuccuucuccggcuacuacugguccuggauccgccagccccccggcaagggccucgaguggaucggcgagaucaaccacuccggcuccaccaacuacaaccccucccucaagucccgcgucaccaucuccgucgacaccuccaagaaccaguucucccucaagcucuccuccgucaccgccgccgacaccgccgucuacuacugcgcccgccuccccaucggcuccggcugguacggccgcgacuacuggggccagggcacccucgucaccgucuccuccgccuccaccaagggc

SEQ ID NO: 19544 - RNA, 375 nt, Artificial Sequence
  derived and/or modified sequence opt2 from anti-HIV_Chain
cagguccagcucguccaguccggcgccgaggucaagaagcccggcgccuccgucaaggucuccugcaaggccuccggcaacaccuucaccuccuacggcaucaccuggguccgccaggcccccggccagggccucgaguggaugggcuggaucuccgccuacaacggcaacaccaacuacgcccagaagcuccaggaccgccucaccaugaccaccgacaccuccaccuccaccgccuacauggagcuccgcucccuccgcuccgacgacaccgccgucuacuacugcgccuucucccgccacuacggcuccggcaacuacgacuacuggggccagggcacccucgucaccgucuccuccgccuccaccaagggc

SEQ ID NO: 19545 - RNA, 375 nt, Artificial Sequence
  derived and/or modified sequence opt2 from anti-HIV_Chain
caguuccgccucguccaguccggccccgaggucaagaaccccggcuccuccgucaccgucuccugcaaggccuccggcggcaccuucuccggccucggcaucaacuggguccgccaggcccccggccagggccucgaguggcucggcgacaucaagaccauguacggcaccaccaacuacgcccccaaguuccagggccgcgucaccaucaccgccgacgaguccaccuccaccuccuacauggagcucuccggccuccgcuccgaggacaccgccgucuucuacugcguccgcgagcucuucggccaccaccccgccuucggcgucuggggccagggcaccuccgucaucgucuccuccgccuccaccaagggc

SEQ ID NO: 19546 - RNA, 375 nt, Artificial Sequence
  derived and/or modified sequence opt2 from anti-HIV_Chain
cgcguccagcucguccaguccggcgccgaggucaagaagcccggcuccuccgucaccgucuccugcaaggccuccggcggcuccuucuccuccuacgccaucuccuggguccgccaggcccccggccagggccucgagugggucggcggcgucaaggucauguucggcaccguccacuacucccagaagguccagggccgcgucaccaucaccgccgacgacuccaccggcaccuccuaccucgagcucuccggccuccgcuccgccgacaccgccgucuacuacugcgcccgcaacgccggcgccuacuucuaccccuucgacaucuggggccagggcacccucaucaucgucuccuccgccuccaccaagggc

SEQ ID NO: 19547 - RNA, 375 nt, Artificial Sequence
  derived and/or modified sequence opt2 from anti-HIV_Chain
cagguccagcuccaggaguccggccccggccucgucaagcccuccgagacccucucccucaccugcaccgucuccggcggcuccaucuccucccgcuccuacuacuggggcuggauccgccagccccccggcaagggccucgagugggucggcuccaucuacuacaccggcuccaccuacuacucccccucccucaagucccgcgucaccaucuccgucgacaccucccagaaccaguucucccucaagcucaacuccgucaccgccgccgacaccgccgucuacuacugcgcccgccagaagggcuccggcaccucccuccucuacuggggccagggcacccucgucaccgucuccuccgccuccaccaagggc

SEQ ID NO: 19548 - RNA, 375 nt, Artificial Sequence
  derived and/or modified sequence opt2 from anti-HIV_Chain
cagguccagcucguccaguccggcaccgaggucaagaagcccggcuccuccgucaaggucuccugcaaggccuccggcggcaccuucuccgacuccgacaucgccuggguccgccaggcccccggccagggccucgaguggaugggcggcaucacccccauguucgacauggccaaguccgcccagaaguuccgcggccgccucaucaucaccgccgacaaguccaccggcaccgccuacauggagcucuccucccuccgcuacgaggacgccgccgucuacuucugcgcccgcuccuccggcaacuucgaguucgccuucgagaucuggggccagggcaccaagaucaucgucucccucgccuccaccaagggc

SEQ ID NO: 19549 - RNA, 375 nt, Artificial Sequence
  derived and/or modified sequence opt2 from anti-HIV_Chain
gucguccagcucguccaguccggcaccgaggucaagaagcccggcuccuccgucaaggucuccugcaaggccuccggcggcaccuucuccggcuccgacaucuccuggguccgccaggcccccggccagggccucgaguggaugggcggcaucauccccauguucgacaucgaggaccacgcccagaaguuccgcggccgccucaccaucaccgccgacaaguccaccggcgccgccuacauggagcucuccucccuccgcuccgaggacgccgccgucuacuacugcgcccgcuccuccggcaacuacgacuucgccuucgacaucuggggccagggcacccgccucaucgucuccuccgccuccaccaagggc

SEQ ID NO: 19550 - RNA, 375 nt, Artificial Sequence
  derived and/or modified sequence opt2 from anti-HIV_Chain
gucguccagcucgucgaguccggcaccgaggucaagaagcccggcuccuccgucaaggucuccugcaaggccuccggcggcaccuucuccggcuccgacaucuccuggguccgccaggcccccggccagggccucgaguggaugggcggcaucauccccauguucgacaucgagaaccacgccgagaaguuccgcggccgccucaccaucaccgccgucaaguccaccggcgccgccuacauggagcucuccucccuccgcuccgaggacgccgccgucuacuacugcgcccgcuccuccggcaacuacgacuucgccuacgacaucuggggccagggcacccgcgucaucgucuccuccgccuccaccaagggc

SEQ ID NO: 19551 - RNA, 378 nt, Artificial Sequence
  derived and/or modified sequence opt2 from anti-HIV_Chain
cagguccagcucguccaguccggcuccgccaugaagaagcccggcgccuccguccgcgucuccugcuggaccuccgaggacaucuucgacaccaccgagcucauccacuggguccgccaggcccccggccagggccucgaguggaucggcugggucaaggccgucuccggcgccgucaacuacggcucccucgacuuccgccaccgcgucucccucacccgcgaccgcgaccucuccaccgcccacauggacauccgcggccucacccaggacgacaccgccaccuacuucugcgcccgccagaaguucgcccgcggcgaccagggcugguucuucgaccucuggggccgcggcacccucaucgucgucuccuccgcc

SEQ ID NO: 19552 - RNA, 378 nt, Artificial Sequence
  derived and/or modified sequence opt2 from anti-HIV_Chain
cagguccagcuccaggaguccggccccggccucgucaagcccuccgagacccucucccucaccugcaccgucuccggcggcuccaucuccaaccacuacugguccuggauccgccagccccccggcaagggccucgaguggaucggcuacaucuaccacuccggcaacaucaacuacaaguccucccucaagucccgcgccaccaucuccaucgacaccuccaacaaccaguucucccucaagcucuccuccgucaucgccgccgacaccgccgucuacuacugcgcccgcaacuucggccccggcucccccaacuacggcauggacgucuggggccagggcaccaccgucaccgucuccuccgccuccaccaagggc

SEQ ID NO: 19553 - RNA, 378 nt, Artificial Sequence
  derived and/or modified sequence opt2 from anti-HIV_Chain
cagguccagcucguccaguccggcggcggcgucguccagcccggccgcucccuccgccucuccugcgccgccuccggcuucaccuucucccaccacggcauccacuggguccgccaggcccccggcgagggccucgagugggucgccgucaucuccgaggacggcaccaacauccacuacgaggacuccguccgcggccgcuucaccaucucccgcgacaacuccaagaacaccgucgaccuccagaugaacucccuccgcgccgaggacaccgccgucuacuacugcgccucccucaucuccaugcgcgacggcgacgccuucgaccucuggggccagggcacccgcgucaccgucuccuccgccuccaccaagggc

SEQ ID NO: 19554 - RNA, 378 nt, Artificial Sequence
  derived and/or modified sequence opt2 from anti-HIV_Chain
cagguccagcucgucgaguccggcggcggccucggccagcccggcggcucccuccgccucuccugcgccgccuccggcuucaccuuccgcaacuacgccauguccuggguccgccaggccgccggcaagggccucgagugggucuccggcgucuccggcggcggcgacaccaccuacuacggcgacuccgucaagggccgcuucaccaucucccgcgacaacuccaagaacacccucuaccuccagaugaacaaccuccgcgccgaggacaccgccgucuacuacugcgccaaggacaagggcgucuggggcuccuccgacuucgacuacuggggccagggcacccucgucaccgucuccuccgccuccaccaagggc

SEQ ID NO: 19555 - RNA, 378 nt, Artificial Sequence
  derived and/or modified sequence opt2 from anti-HIV_Chain
gagguccagcucgucgaguccggcggcggcgucguccagcccggccgcucccuccgccucuccugcgccgccuccggcuucaccuucucccaccacggcauccacuggguccgccaggcccccggcgagggccucgagugggucgccgucaucuccgaggacggcaccaacauccacuacgaggacuccguccgcggccgcuucaccaucucccgcgacaacuccaagaacaccgucgaccuccagaugaacucccuccgcgccgaggacaccgccgucuacuacugcgccucccucaucuccaugcgcgacggcgacgccuucgaccucuggggccagggcacccgcgucaccgucuccuccgccuccaccaagggc

SEQ ID NO: 19556 - RNA, 378 nt, Artificial Sequence
  derived and/or modified sequence opt2 from anti-HIV_Chain
cgcggccccgucacccucgccgucucccucggcgagcgcgccaccaucaccugcaaguccucccaguccguccucguccacuccaacaacaagaacuaccucuccugguaccagcagaagcccggccagccccccaagcuccucaucuacugggccuccacccgcgaguccggcguccccgagcgcuucuccggcuccggcuccggcaccgacuucacccucuccaucuccucccuccaggccgaggacgucgccgucuacuacugccaccaguacuucuccaccccccgcaccuucggccagggcaccaaggucgagaucaagggcaccgucgccgcccccuccgucuucaucuucccccccuccgacgagcagcuc

SEQ ID NO: 19557 - RNA, 378 nt, Artificial Sequence
  derived and/or modified sequence opt2 from anti-HIV_Chain
uccgagaucgucaugacccagucccccgccacccucuccaugucccccggcgagcgcgccacccucuccugccgcgccucccucuccgucaacaccaaccucgccugguaccagcagaagcccggccaggccccccgccuccucaucuacggcgccuccacccgcgccaccggcauccccgcccgcuucuccggcuccggcuccggcaccgaguucacccucaccaucuccucccuccaguccgaggacuucgcccucuacuacugccagcaguacaaccacuggccccagaccuucggccagggcaccaaggucgagaucaagcgcaccgucgccgcccccuccgucuucaucuucccccccuccgacgagcagaag

SEQ ID NO: 19558 - RNA, 378 nt, Artificial Sequence
  derived and/or modified sequence opt2 from anti-HIV_Chain
uccgagaucguccucacccagucccccgccacccucucccucucccccggcgagcgcgccacccucuccugccgcgccucccaguccaucaacaacuaccucgccugguaccagcagaagcccggccaggccccccgccuccucaucuacgacgccuccaaccgcgccaccggcauccccgcccgcuucuccggcggcggcuccggcaccgacuucacccucaccaucuccucccucgagcccgaggacuucgccgucuacuacugccagcagcgcgccaacuggcgccuccucaccuucggcggcggcaccaaggucgagaucaagcgcaccgucgccgcccccuccgucuucaucuucccccccuccgacgagcag

SEQ ID NO: 19559 - RNA, 378 nt, Artificial Sequence
  derived and/or modified sequence opt2 from anti-HIV_Chain
cagguccagcucguccaguccggcggcgccgucaagaagcccggcgccuccgucaaggucuccugcgagaccuacggcuacaccuucaccgaccacuucaugcacugguggcgccaggcccccggccagggccucgaguggaugggcuggaucaaccccuacuccuccgccgucuccuacuccccccgcuaccagggccgcgucaccaugacccgcgacaccuuccucgagaccgucuacauggagcuccgcggccucaaguucgacgacaccgccaucuacuacugcgccacccccaaguccggccgcgacuacugguccuucgaccucuggggccagggcacccucgucaccgucuccuccgccuccaccaagggc

SEQ ID NO: 19560 - RNA, 378 nt, Artificial Sequence
  derived and/or modified sequence opt2 from anti-HIV_Chain
ucccagguccagcucgucgaguccggccccggccucgucaagcccuccgagacccucucccucaccugcuccgucuccaacggcuccaucuccuccggcggcuacuacugguccuggcuccgccaguuccccggcaagggccucgaguggaucggcuccauccacuacaccggccgcaccauguacaaccccucccucaugggccgccccgcccucuccauggacaccuccaacaaccaguucucccucaagcucuccuccgucaccgccgccgacaccgcccucuacuucugcgcccgcgaccuccaguggaucuucgucgucgaccccuggggccagggcacccucgucaccgucuccuccgccuccaccaagggc

SEQ ID NO: 19561 - RNA, 378 nt, Artificial Sequence
  derived and/or modified sequence opt2 from anti-HIV_Chain
uccgucguccagcucgucgaguccggccccggccucgucaagcccuccgagacccucucccucaccugcuccgucuccaacggcuccaucuccuccggcggcuacuacugguccuggcuccgccaguuccccggcaagggccucgaguggaucggcuccauccacuacaccggccgcaccauguacaaccccucccucaugggccgccccgcccucuccauggacaccuccaacaaccaguucucccucaagcuccgcuccgucaccgccgccgacaccgcccucuacuucugcgcccgcgaccuccaguggaucuucgucgucgaccccuggggccagggcacccucgucaccgucuccuccgccuccaccaagggc

SEQ ID NO: 19562 - RNA, 378 nt, Artificial Sequence
  derived and/or modified sequence opt2 from anti-HIV_Chain
uccggcggccgccucguccagcccggcggcucccuccgccucuccugcuccgccuccggcuucacccucuccaacuccgccauguccuggguccgccaggcccccggcaagggccucgagugggucuccuccauccucuccuccggcgucggcaccuucuacgccgacuccgucaagggccgcuucaccgucucccgcgacaacucccgcaacacccucuaccuccagaugaagucccuccgcgccgaggacaccgcccucuacuacugcgccaagguccagauccagcagcucaacuucggcgucaucaccgacgccggccucgacgucuggggcaagggcaccacccucaucgucuccuccgccuccaccaagggc

SEQ ID NO: 19563 - RNA, 378 nt, Artificial Sequence
  derived and/or modified sequence opt2 from anti-HIV_Chain
cagguccagcucguccaguccggcgccgccgucaagaagcccggcgccuccgucaaggucuccugcgaggccuacggcuacaaguucaccgaccacuucaugcacugguggcgccaggcccccggccagggccucgaguggaugggcuggaucaaccccuacaccuccgccgucaacuacucccccaaguaccagggccgcgucaccaugacccgcgacaccuuccucgagaccgucuacauggagcuccgcggccuccgcgucgacgacaccgccaucuacuacugcgccacccccaaguccggccgcgacuacugguccuucgaccucuggggccagggcacccucgucaccgucuccuccgccuccaccaagggc

SEQ ID NO: 19564 - RNA, 378 nt, Artificial Sequence
  derived and/or modified sequence opt2 from anti-HIV_Chain
cagguccagcucguccaguccggcgccgccgucaagaagcccggcgccuccgucaaggucuccugcgagaccuacggcuacaaguucaccgaccacuucaugcacugguggcgccaggcccccggccagggccucgaguggaugggcuggaucaaccccuacuccuccgccgucuccuacuccccccgcuaccagggccgcgucaccaugacccgcgacaccuuccucgagaccgucuacauggagcuccgcggccuccgcuucgacgacaccgccaucuacuacugcgccacccccaaguccggccgcgacuacugguccuucgaccucuggggccagggcacccucgucaccgucuccuccgccuccaccaagggc

SEQ ID NO: 19565 - RNA, 378 nt, Artificial Sequence
  derived and/or modified sequence opt2 from anti-HIV_Chain
cagguccagcucguccaguccggcgccgccgucaagaagcccggcgccuccgucaaggucuccugcgagaccuacggcuacaccuucaccgaccacuucaugcacugguggcgccaggcccccggccagggccucgaguggaugggcuggaucaaccccuacuccuccgccgucuccuacuccccccgcuaccagggccgcgucaccaugacccgcgacaccuuccucgagaccgucuacauggagcuccgcggccucaaguucgacgacaccgccaucuacuacugcgccacccccaaguccggccgcgacuacugguccuucgaccucuggggccagggcacccucgucaccgucuccuccgccuccaccaagggc

SEQ ID NO: 19566 - RNA, 378 nt, Artificial Sequence
  derived and/or modified sequence opt2 from anti-HIV_Chain
cagguccagcucguccaguccggcgccgaggucaagaagcccggcuccuccgucaaggucuccugcaagaccuccggcguccgcuucuccuccaacgccaucuccuggguccgccaggcccccggccagggccucgaguggaugggccgcaccacccccaugcucggcggcgccaaccacgcccccuccuucaagggccgcgucaccaucuccgccgacgaguccacccgcaccgucuacauggagauguccucccuccgcuacgaggacaccgccgucuacuacugcgccuccggccgccgcgagggccucaacuuccuccucgacuacuggggccagggcacccucgucaccgucuccuccgccuccaccaagggc

SEQ ID NO: 19567 - RNA, 378 nt, Artificial Sequence
  derived and/or modified sequence opt2 from anti-HIV_Chain
cagguccagcuccaggaguccggccccggccucgucaagcccuccgagacccucucccucaccugcaccgucuccggcggcuccaucuccaccuacuacugguccuggauccgccagccccccggcaagggccucgaguggaucggcuacaucuccuacuccggcuccaccaacuacaaccccucccucaagucccgcgucaccaucuccgucgacaccuccaagaaccaguucucccucaagcucuccuccgucaccgccgccgacaccgccgucuacuacugcgcccgccacaaguccguccuccucugguuccgcgagcucgacuacuggggccagggcacccucgucaccgucuccuccgccuccaccaagggc

SEQ ID NO: 19568 - RNA, 378 nt, Artificial Sequence
  derived and/or modified sequence opt2 from anti-HIV_Chain
cagguccagcucguccaguccggcgccgaggucaagaagcccggcgccgccgucaagaucuccugcaaggccucccgcuucaccuucuccuccuacuacauccacuggguccgccaggcccccggccagggccucgaguggaugggcaucaucaaccccuccggcggcuccaccuccaacgcccagaaguuccaggaccgcgucacccucacccgcgacauguccaccggcaccgucuacauggagcucucccgccucaccuccgaggacaccgccgucuacuacugcgccacccccgagcccuccuccaucgucgccccccucuacuacuggggccagggcacccucgucaccgucuccuccgccuccaccaagggc

SEQ ID NO: 19569 - RNA, 378 nt, Artificial Sequence
  derived and/or modified sequence opt2 from anti-HIV_Chain
cagguccagcucguccaguccggcgccgagaugaagaagcccggcgccuccgucaaggucuccugcaaggccuccggccacaccuucaccaacuacuacaugcacuggguccgccaggcccccggccagggccucgaguggaugggcaugaucaaccccaccggcgacuccacccgcuacgcccagcgcuuccagggccgcgucaccaugacccgcgacaccuccacccgcaccgucuacauggagcucuccucccuccgcuccgacgacaccgccgucuacuacugcgcccgcgcccaccacgacuucuggcgcgcccccgucgacgucuggggcaagggcaccaccgucaccgucuccuccgccuccaccaagggc

SEQ ID NO: 19570 - RNA, 378 nt, Artificial Sequence
  derived and/or modified sequence opt2 from anti-HIV_Chain
caggucguccucauccaguccggcgccgaggucaagcgccccggcuccuccgucaaggucuccugcaaggccuccggcggcuccuuccccaucaccuggguccgccaggcccccggccacggccucgaguggaugggcggcaucaaccccuucuucggcaccaccaacuacgcccagaaguuccagggccgcgucuccaucaccgccgacgaguccaccuccaccaccuaccuccaccucuccgaccuccgcuccgaggacaccgccgucuacuucugcgcccgcgagaaccgcgagaaguggcucguccuccgcuccugguucgcccccuggggccagggcacccucgucaccgucuccuccgccuccaccaagggc

SEQ ID NO: 19571 - RNA, 378 nt, Artificial Sequence
  derived and/or modified sequence opt2 from anti-HIV_Chain
ucccagcagcucguccaguccggcgcccaggucaagaagcccggcgccuccguccgcgucuccugccaggccuccggcuacaccuucaccaaccacuuccuccacugguggcgccaggccccccgccagggccucgaguggaugggcuggaucaaccccguccacggcggccgcaacuacgcccgccgcuuccagggccgcaucaacuucggccgcgacgucuaccaggagaccgccuacauggagcucuccggccuccgcaacgacgacaccgccaccuacuucugcgcccgcggcggcggcgacggccgcaacuggcaccuccaccccuggggccagggcacccucgucaucgucuccgccgccuccaccaagggc

SEQ ID NO: 19572 - RNA, 378 nt, Artificial Sequence
  derived and/or modified sequence opt2 from anti-HIV_Chain
gagguccaggucgucgaguccggcggcggccucguccagcccggcggcucccuccgccucuccugcgucgccuccggcuucaccuucuccgaguacuggauguccuggguccgccaggcccccggcaagggccucgagugggucgccaccaucaagcgcgacggcuccgaggaguccuacgucgacuccgucaagggccgcuucaccaucucccgcgacaacgccaagaacucccucuaccuccagaugaacucccuccgcgccgaggacaccgccgucuacuacugcgcccgcguccgcgaccccaacuacaaccuccacuucgacuccuggggccagggcacccucgucaccgucuccuccgccuccaccaagggc

SEQ ID NO: 19573 - RNA, 378 nt, Artificial Sequence
  derived and/or modified sequence opt2 from anti-HIV_Chain
cucguccagcucgucgaguccggcggcggcgucguccagcccggcaagucccuccgccucuccugcgccaccuccggcuucaccuucuccaccuacggcaugcacuggguccgccaggcccccggcaagggccucgagugggucgccgucaucugguacgacggcuccuacaaguacuacgccgacuccgucaagggccgcuucaccaucucccgcgacaacuccaagaacacccucuuccuccagaugaacucccuccgcgccgaggacaccgccauguacuacugcggccgcgagauggccgucggcggcaccaaggcccucgaccacuggggccagggcacccucgucaccgucuccuccgccuccaccaagggc

SEQ ID NO: 19574 - RNA, 378 nt, Artificial Sequence
  derived and/or modified sequence opt2 from anti-HIV_Chain
gaguuccagcucguccaguccggcggcggccucgucaagcccggcggcucccuccgccucuccugcaccggcuccaccuucuccuucuccuccgacgacaugaacuggguccgccaggcccccggcaagggccucgagugggucuccuccauguccgacuccggcucccacaucuacuacgccgacuucgucaagggccgcuucaccaucucccgcgacaacgccaagaagucccucuaccuccagaugaacucccuccgcgccgaggacaccgccgucuacuacugcgcccagucccgccccccccagcgccucuacggcauggacgucuggggccagggcaccaccgucaccgucuccuccgccuccaccaagggc

SEQ ID NO: 19575 - RNA, 381 nt, Artificial Sequence
  derived and/or modified sequence opt2 from anti-HIV_Chain
gagguccagcucgucgaguccggcggcggcgucguccagcccggcggcucccuccgccucuccugcgccgccuccggcuucauguucaagaacuacgccaugcacuggguccgccagccccccggcaagggccucgagugggucgccgucaucugguacggcggccgcgaccagaacuacgccgacuccgucaagggccgcuucaccaucucccgcgacgacuccgacaacacccucuaccuccagaugaacucccuccgcgccggcgacaccgccgucuacuucugcgcccgcaacucccaggucggccgccucaugcccgccgccggcgucuggggccagggcacccucgucaccgucuccuccgccuccaccaagggc

SEQ ID NO: 19576 - RNA, 381 nt, Artificial Sequence
  derived and/or modified sequence opt2 from anti-HIV_Chain
cagggccaccucguccaguccggcggcggcgucaagaagcucggcaccuccgucaccaucuccugccucgccuccgaguacaccuucaacgaguucgucauccacuggauccgccaggcccccggccagggcccccucuggcucggccucaucaagcgcuccggccgccucaugaccuccuaccaguuccaggaccgccucucccuccgccgcgaccgcuccaccggcaccgucuucauggagcuccgcggccuccgcgucgacgacaccgccgucuacuacugcgcccgcgacggccucggcgaggucgcccccgccuaccucuacggcaucgacgccuggggccagggcaccaccgucaucgucaccuccgccuccacc

SEQ ID NO: 19577 - RNA, 381 nt, Artificial Sequence
  derived and/or modified sequence opt2 from anti-HIV_Chain
cagguccagcuccucgaguccggcggcggccucguccagcgcggcggcucccuccgccucuccugcaccgccuccggcuucgucuucaacaacuacuggaugaccuggguccgccaggcccccggcaacggccucgagugggucgccaacaucgaccaggacggcuccgagaagcacuaccucgacuccgucaagggccgcuucaccaucucccgcgacaacgccaagaacucccucuaccuccagaugaacucccuccgcgccgaggacaccgccaucuacuacugcgcccgcguccgcuucaaggucaccgccuggcaccgcuucgacuccuggggccagggcgaccucgucaccgucuccuccaccuccaccaagggc

SEQ ID NO: 19578 - RNA, 381 nt, Artificial Sequence
  derived and/or modified sequence opt2 from anti-HIV_Chain
caguccgcccucacccagccccccuccgccuccggcacccccggccagcgcgucaccaucuccugcuccggcuccuaccacaacaucggcuccaacgccgucaacugguaccagcagcuccccggcaccgcccccaagcuccucaucuacuccaacgaccagcgccccuccggcguccccgaccgcuucuccggcuccaaguccggcaccuccgccucccucgccaucuccggccuccaguccgaggacgaggccgacuacuacugcgccgccugggacgacucccuccacgucuucggcaccggcaccaaggucaccguccucggccagcccaaggccaaccccaccgucacccucuucccccccuccuccgaggagcuc

SEQ ID NO: 19579 - RNA, 381 nt, Artificial Sequence
  derived and/or modified sequence opt2 from anti-HIV_Chain
caguccguccucacccagguccucuccgucuccggcacccccggccagcgcgucaucaucuccugcuccggcaccuccuccaacgucggcggcaaccucgucuccugguaccagcaccuccccggcgccgccccccgccuccucauccaccgcgacgaccagcgccccuccggcguccccgaccgcuucuccggcuccaaguccggcaacuccgccucccucgucaucuccggccuccgcuccgacgacgaggccgacuacuucugcgccgccuacgacuccaccuucucccuccccgucuucggcggcggcacccgccucaccguccucucccagcccaaggccgcccccuccgucacccucuucccccccuccuccgag

SEQ ID NO: 19580 - RNA, 381 nt, Artificial Sequence
  derived and/or modified sequence opt2 from anti-HIV_Chain
cagguccagcuccuccaguccggcgccgccgucaccaagcccggcgccuccguccgcgucuccugcgaggccuccggcuacaacauccgcgacuacuucauccacugguggcgccaggcccccggccagggccuccagugggucggcuggaucaaccccaagaccggccagcccaacaaccccugccaguuccagggccgcgucucccucacccgccacgccuccugggacuucgacaccuucuccuucuacauggaccucaaggcccuccgcuccgacgacaccgccgucuacuucugcgcccgccagcgcuccgacuacugggacuucgacgucuggggcuccggcacccaggucaccgucuccuccgccuccaccaag

SEQ ID NO: 19581 - RNA, 381 nt, Artificial Sequence
  derived and/or modified sequence opt2 from anti-HIV_Chain
cagguccagcucguccaguccggcggcgagguccgcaagcccggcuccuccgucaagguccccugcaagaucuccggcaacgccuucuccaacuacggcgucaacuggguccgccaggcccccggccagggccucgagugggucggccgcaucauccccgucaucggcgucgcccagcacgcccccaaguuccagggccgcgucaccaucaccgccgacaaguccaccaccaccgccuaccucgagcucuccucccuccgcuccgacgacaccgccgucuacuucugcgccaaggaccacggcgacccccgcaccggcuacuacuucgacuacuggggccagggcgcccucgucaccgucuccuccgccuccaccaagggc

SEQ ID NO: 19582 - RNA, 381 nt, Artificial Sequence
  derived and/or modified sequence opt2 from anti-HIV_Chain
cagguccagcucggccaguccggcaccgaggucaagaagcccggcuucuccgucaaggucuccugcaaggccuccggcggcuccuccaccgccuacggcuacuccuggguccgccaggcccccggccagggcuucgaguggaugggccgcaucauccccuucuacggcaucaucaccuacgcccccaaguuccagggccgcgucaccaucaccgccgaccgcuccaccuccaccgucuacauggagcucaccucccucaccuucgccgacaccgcccucuucuucugcgcccgcgacuucggcgacccccgcaacggcuacuacuucgacuccugggaccagggccucuggcucaccgucuccuccgccuccaccaagggc

SEQ ID NO: 19583 - RNA, 381 nt, Artificial Sequence
  derived and/or modified sequence opt2 from anti-HIV_Chain
cagguccagcucguccaguccggcgccgaggucaagaagcccggcuccuccgucaaggucuccugcaaggccuccggcggcaccuucuccaacuacgccaucuccuggguccgccaggcccccggccagggccucgaguggaugggcggcaucauccccaucuucgaggccgccuccuacgcccagaaguuccaggaccgccucaccaucaccaccgacgaguccaccaccaccgccuacauggaccucuccucccuccgcuccgaggacaccgccaucuacuacugcgcccgcgcccagggcgacauccucaccgagggcuacuucgacuacuggggccagggcacccucgucaccgucuccuccgccuccaccaagggc

SEQ ID NO: 19584 - RNA, 381 nt, Artificial Sequence
  derived and/or modified sequence opt2 from anti-HIV_Chain
cagguccagcuccaggaguccggccccggccucgucaagcccuccgagacccucucccucaccugcaccgucuccggcggcuccaucuccuccgccggcuacuacugguccuggauccgccagcaccccgagaagggccucgaguucaucggcuacaucuacuaccucggcaccaccuacuacaaccccucccucaagucccgcgucuccaucuccaucgacaccuccaacaaccaguucucccucgagcucuccuccgucuccgccgccgacaccgccaucuacuacugcgcccgcgacuacaccgccuccggccgccacuucuucgacuacuggggccagggcacccucgucaccgucuccuccgccuccaccaagggc

SEQ ID NO: 19585 - RNA, 381 nt, Artificial Sequence
  derived and/or modified sequence opt2 from anti-HIV_Chain
cagguccagcucguccaguccggcgccgaggucaagaagcccggcgccuccgucaaggucuccugcaaggcccccggcuacaccuucaucggccacuacaugcacuggauccgccaggcccccggccagggccucgaguggaugggcuggaucaaccccaacuccggcgacaccaacuacgcccagaccuuccagggccgcgucaccaugacccgcgacaccuccaucuccaccgccuacauggagcucacccgccuccgcuccgacgacaccgccgucuacuacugcgcccgcgaccuccgccccaugcgcggcaacugggccaugcacgucuggggcgagggcaccaccgucaccgucuccuccgccuccaccaagggc

SEQ ID NO: 19586 - RNA, 381 nt, Artificial Sequence
  derived and/or modified sequence opt2 from anti-HIV_Chain
cagguccagcuccaggaguccggccccggccucgucaagcccuccgagacccucucccucaccugcaccgucuucggcgccuccauccgcuccuucuacuggcacuggauccgccagucccccggcaagggccucgaguggcucggcuccgucuucgacaacggccucaccaccuacaaccccucccucaagaaccgccucuccaucuccgaggaccccucccgcaaccagaucucccucaaccuccgcuccaugaccgccgccgacaccgccgucuacuacugcgcccgcgccgacuacgaccuccucaccuccuccuaccacuucgacuccuggggccagggcacccucgucaccgucuccuccgccuccaccaagggc

SEQ ID NO: 19587 - RNA, 381 nt, Artificial Sequence
  derived and/or modified sequence opt2 from anti-HIV_Chain
ucccagcagcucguccaguccggcacccaggucaagaagcccggcgccuccguccgcgucuccugccaggccuccggcuacaccuucaccgacuacguccuccacugguggcgccaggcccccggccagggccucgaguggaugggcuggaucaagcccgucuacggcgcccgcaacuacgcccaccgcuuccagggccgcaucaacuucgaccgcgacgucuaccgcgagaucgccuacauggaccucuccggccuccgcuccgacgacaccgccgucuacuucugcgcccgcgacggcuccggcgacgccaccuccuggcaccuccaccccuggggccagggcacccucgucaucgucuccuccgccuccaccaagggc

SEQ ID NO: 19588 - RNA, 381 nt, Artificial Sequence
  derived and/or modified sequence opt2 from anti-HIV_Chain
ucccagcagcucguccaguccggcacccaggucaagaagcccggcgccuccguccgcgucuccugccaggccuccggcuacaccuucaccaacuacauccuccacugguggcgccaggcccccggccgcggccucgaguggaugggccucaucaagcccgucuacggcgccgucaacuacgcccgccaguuccagggccgcauccagcucacccgcgacaucuaccgcgagaucgccuuccucgaccucuccggccuccgccccgacgacaccgccgucuacuacugcgcccgcgacgaguccggcuacgaccucaacuggcaccucgacuccuggggccagggcacccaggucaucgucucccccgccuccaccaagggc

SEQ ID NO: 19589 - RNA, 381 nt, Artificial Sequence
  derived and/or modified sequence opt2 from anti-HIV_Chain
ucccagcagcucguccaguccggcgcccaggucaagaagcccggcgccucccuccgcgucuccugccaggccuccggcuacaccuucaugaacuaccuccuccacugguggcgccaggcccccggccagggccucgaguggaugggcuggaucaaccccgucuacggcgccgucaacuacgcccaccgcuuccagggccgccucaccuucucccgcgacgucuaccgcgagaucgccuacauggaccucaacggccuccgcuccgacgacaccgccgucuacuucugcgcccgcgacggcuccggcgacgaccgcaacuggcaccucgaccccuggggccagggcacccucgucaucgucuccuccgccuccaccaagggc

SEQ ID NO: 19590 - RNA, 381 nt, Artificial Sequence
  derived and/or modified sequence opt2 from anti-HIV_Chain
ucccagcagcucguccaguccggcacccaggucaagaagcccggcgccuccguccgcaucuccugccaggccuccggcuacaccuucaccgacuacguccuccacugguggcgccaggcccccggccagggccucgaguggaugggcuggaucaagcccgucuacggcgcccgcaacuacgcccgccgcuuccagggccgcaucaacuucgaccgcgacaucuaccgcgagaucgccuuccucgaccucuccggccuccgcuccgacgacaccgcccgcuacuucugcgcccgcgacggcuccggcgacgacaccuccuggcaccuccaccccuggggccagggcacccucgucaucgucuccgccgccuccaccaagggc

SEQ ID NO: 19591 - RNA, 381 nt, Artificial Sequence
  derived and/or modified sequence opt2 from anti-HIV_Chain
ucccagcagcucguccaguccggcacccaggucaagaagaccggcgccuccguccgcgucuccugccaggccuccggcuacgacuucaccaaguaccucauccacugguggcgccaggcccccggccagggccucgaguggaugggcuggaugaagcccgucuacggcgccaccaacuacgcccaccgcuuccagggccgcaucuccuucacccgcgacaucuaccgcgagaucgccuucauggaccucaacggccuccgcuccgacgacaccgccgucuacuucugcgcccgcgacggcggcggcgacgaccgcaccuggcuccucgacgccuggggccagggcacccucgucaucgucuccuccgccuccaccaagggc

SEQ ID NO: 19592 - RNA, 381 nt, Artificial Sequence
  derived and/or modified sequence opt2 from anti-HIV_Chain
ucccagcagcucguccaguccggcacccaggucaagaagcccggcgccuccguccgcgucuccugccaggccuccggcuacaccuucaugaacuacaucauccacugguggcgccaggcccccggccagcgccucgaguggaugggcuggaucaaccccgucuucggcgcccgcaacuacgcccaccgcuuccagggccgcaucaacuucgaccgcgacaucaaccgcgagaccuuccagauggaccucaccggccuccgcuccgacgacaccgccgucuacuacugcgcccgcgacggcuccggcgacgcccgcgacuggcaccuccaccccuggggccagggcacccucgucaucgucuccuccgccuccaccaagggc

SEQ ID NO: 19593 - RNA, 381 nt, Artificial Sequence
  derived and/or modified sequence opt2 from anti-HIV_Chain
ucccagcaccucguccaguccggcacccaggucaagaagcccggcgccuccguccgcgucuccugccaggccuccggcuacaccuucaccaacuacauccuccacugguggcgccaggcccccggccagggccucgaguggaugggccucaucaagcccgucuucggcgccgucaacuacgcccgccaguuccagggccgcauccagcucacccgcgacaucaaccgcgagaucgccuuccucgaccucuccggccuccgcuccgacgacaccgccgucuacuacugcgcccgcgacgaguccggcgacgaccucaaguggcaccuccaccccuggggccagggcacccaggucaucgucucccccgccuccaccaagggc

SEQ ID NO: 19594 - RNA, 381 nt, Artificial Sequence
  derived and/or modified sequence opt2 from anti-HIV_Chain
ucccagcagcucguccaguccggcacccaggucaagaagcccggcgccuccguccgcgucuccugccaggccuccggcuacaccuucaugaacuacaucauccacugguggcgccaggcccccggccagcgccucgaguggaugggcuggaucaaccccgucuucggcgcccgcaacuacgcccaccgcuuccagggccgcaucaacuucgaccgcgacaucaaccgcgagaccuuccagauggagcucaccggccuccgcuccgacgacaccgccgucuacuacugcgcccgcgacggcuccggcgacgcccgcgacuggcaccucgaccccuggggccagggcacccucgucaucgucuccuccgccuccaccaagggc

SEQ ID NO: 19595 - RNA, 381 nt, Artificial Sequence
  derived and/or modified sequence opt2 from anti-HIV_Chain
ucccagcagcucguccaguccggcacccaggucaagaagcccggcgccuccguccgcaucuccugccaggccuccggcuacaccuucaccgacuacguccuccacugguggcgccaggcccccggccagggccucgaguggaugggcuggaucaagcccgucuacggcgcccgcaacuacgcccgccgcuuccagggccgcaucaacuucgaccgcgacaucuaccgcgagaucgccuacauggaccucuccggccuccgcuccgacgacaccgcccgcuacuucugcgcccgcgacggcuccggcgacgacaccuccuggcaccuccaccccuggggccagggcacccucgucaucgucuccgccgccuccaccaagggc

SEQ ID NO: 19596 - RNA, 381 nt, Artificial Sequence
  derived and/or modified sequence opt2 from anti-HIV_Chain
ucccagcagcucguccaguccggcacccaggucaagaagcccggcgccuccguccgcaucuccugccaggccuccggcuacuccuucaccgacuacguccuccacugguaccgccaggcccccggccagggccucgaguggaugggcuggaucaagcccgucuacggcgcccgcaacuacgcccgccgcuuccagggccgcaucaacuucgaccgcgacaucuaccgcgagaucgccuucauggaccucuccggccuccgcuccgacgacaccgcccucuacuucugcgcccgcgacggcuccggcgacgacaccuccugguaccucgaccccuggggccagggcacccucgucaucgucuccgccgccuccaccaagggc

SEQ ID NO: 19597 - RNA, 381 nt, Artificial Sequence
  derived and/or modified sequence opt2 from anti-HIV_Chain
ucccagcagcucguccaguccggcacccaggucaagaagcccggcgccuccguccgcaucuccugccaggccuccggcuacuccuucaccgacuacguccuccacugguggcgccaggcccccggccagggccucgaguggaugggcuggaucaagcccgucuacggcgcccgcaacuacgcccgccgcuuccagggccgcaucaacuucgaccgcgacaucuaccgcgagaucgccuucauggaccucuccggccuccgcuccgacgacaccgcccucuacuucugcgcccgcgacggcuccggcgacgacaccuccuggcaccucgaccccuggggccagggcacccucgucaucgucuccgccgccuccaccaagggc

SEQ ID NO: 19598 - RNA, 381 nt, Artificial Sequence
  derived and/or modified sequence opt2 from anti-HIV_Chain
ucccagcaccucguccaguccggcacccaggucaagaagcccggcgccuccguccgcgucuccugccaggccuccggcuacaccuucaccaacuacauccuccacugguggcgccaggcccccggccagggccucgaguggaugggccucaucaagcccgucuucggcgccgucaacuacgcccgccaguuccagggccgcauccagcucacccgcgacaucuaccgcgagaucgccuuccucgaccucuccggccuccgcuccgacgacaccgccgucuacuacugcgcccgcgacgaguccggcgacgaccucaaguggcaccuccaccccuggggccagggcacccaggucaucgucucccccgccuccaccaagggc

SEQ ID NO: 19599 - RNA, 381 nt, Artificial Sequence
  derived and/or modified sequence opt2 from anti-HIV_Chain
cagguccagcucgucgaguccggcggcggcgucguccagcccggcaagucccuccgccucuccugcgccaucuccggcuuccucuucaacaacuacggcggccaguggguccgccaggcccccggcaagggccucgagugggucgccgccaucuccuacgacggcaacaaccgcuacuacgccgacuccgccaagggccgcuuccucaucucccgcgacacccccaagaacauccucuaccuccagaucuacucccuccgccucgacgacaccgccgucuacuacugcgcccgcgacuccgucuccaaguccuacuccgccccccccgaguucuggggccagggcaccgucgucaccgucuccuccgccuccaccaagggc

SEQ ID NO: 19600 - RNA, 381 nt, Artificial Sequence
  derived and/or modified sequence opt2 from anti-HIV_Chain
cagguccaccucgaggaguccggccccggccucgucaagaccucccagacccucucccucaccugcuccgucuccuccuacuccaucucccgcuccggcuacuucuggaccuggauccgccagcgccccggcaagggccucgaguggaucggcuacaucuacuucaacggccgcaccaccuacaaccccucccucaagucccgcaucaccaucucccgcgacaccucccacucccaguucucccucacccucaacucccucuccgccgccgacaccgccgucuacuacugcggccgcugccaggacggccucgccucccgccccaucgacuucuggggccagggcacccucgucaccgucuccuccgccuccaccaagggc

SEQ ID NO: 19601 - RNA, 381 nt, Artificial Sequence
  derived and/or modified sequence opt2 from anti-HIV_Chain
cagguccagcucgucgaguccggcggcggcgucguccagcccggccgcucccuccgccucuccugcgccaccuccggcuucaccuccaagaacuacggcguccacuggguccgccaggcccccggcaagggccucgagugggucgccgucaucugguacgacggcuccaacaaguucuacgccgacuccgucaagggccgcuucaccaucucccgcgaccgcuccaagaacauggucuaccuccagaugaacucccuccgcgucgaggacaccgccaucuacuacugcgcccgcgacuccgucgccuucguccucgagggccccaucgacuacuggggccagggcacccucgucaccgucuccuccgccuccaccaagggc

SEQ ID NO: 19602 - RNA, 384 nt, Artificial Sequence
  derived and/or modified sequence opt2 from anti-HIV_Chain
cagguccagcucguccaguccggcggcggcgucaagaagcccggcaccuccgccuccuucuccugccgcaccuccgacgacaucuacgacaacgaguucuucgacuccgccuucaugcacuggguccgccucauccccggccagcgccccgaguggaugggcuggaugaacccccgcuccggcgccgucaacuacgcccgccagcuccagccccgcgucuccauguaccgcgaccgcgaccucuccaccgccuacauggaguucaagucccucaccuccgccgacaccggcaccuacuucugcgcccgcaagaagcgcggcgacggcuucaaccucuacuucgaccucuggggccgcggcucccaggucaucgucuccuccgcc

SEQ ID NO: 19603 - RNA, 384 nt, Artificial Sequence
  derived and/or modified sequence opt2 from anti-HIV_Chain
cagggccaccucguccaguccggcggcggcgucaagaagcucggcaccuccgucaccaucuccugccucgccuccgaggacaccuucaacgaguucgucauccacuggauccgccaggcccccggccagggcccccucuggcucggccucaucaagcgcuccggccgccucaugaccuccuaccaguuccaggaccgccucucccuccgccgcgaccgcuccaccggcaccgucuucauggagcuccgcggccuccgcgucgacgacaccgccgucuacuacugcgcccgcgacggccucggcgaggucgcccccgccuaccucuacggcaucgacgccuggggccagggcaccaccgucaucgucaccuccgccuccaccucc

SEQ ID NO: 19604 - RNA, 384 nt, Artificial Sequence
  derived and/or modified sequence opt2 from anti-HIV_Chain
caguccgcccucacccagccccccuccgucuccggcgcccccggccagcgcgucaccaucuccugcuccggcggccccuccaacgucggcggcaacuacgucuacugguaccgccaguuccccggcaccgcccccaagcuccucauccuccgcgacgaccagcgccccuccggcguccccgaccgcuucuccgccuccaaguccggcaacuccgccucccucgccaucuccggccuccgccccgacgacgaggccuucuacuucugcgccaccuacgacucccagggcuccuuccgcgucuucggcggcggcaccgcccucaccguccucucccagcccaaggccgcccccuccgucacccucuacccccccuccuccgaggag

SEQ ID NO: 19605 - RNA, 384 nt, Artificial Sequence
  derived and/or modified sequence opt2 from anti-HIV_Chain
aacuucaugcucacccagccccccuccgccuccggcacccccggccagcgcgucaccaucuccugcuccggcggcggcuccaacaucggcggcaaccucgucuccugguaccagcacuuccccggcgccgcccccaagcuccucaucuaccgcaacgaccagcgccccuccggcguccccgaccgcuucuccggcuccaaguccggcaccuccgccucccucgccaucuccggccuccgcuccgacgacaaggccaccuacuucugcgccgccuacgacuccacccucucccuccgccucuucggcggcggcaccacccucaccguccucucccagcccaaggccgcccccuccgucacccucuucccccccuccuccgaggag

SEQ ID NO: 19606 - RNA, 384 nt, Artificial Sequence
  derived and/or modified sequence opt2 from anti-HIV_Chain
aacuucaugcucacccagccccccuccgucuccgccacccccggccagaccgucaccaucuccugcuccggcuccggcuccaacgucggcggcaaccacgucuacugguaccgccagcuccccggcgccgcccccacccucgucaucuccaagaccgaccaccgccccucccgcguccccgaccgcuucuccggcuccaaguccggcaacuccgccucccucgccaucuccggccuccgccccgacgacgaggccgucuacuucugcgccaccuacgacaccggccucucccuccgccucuucggcggcggcacccgccucaccguccucucccagcccaaggccgcccccuccgucacccaguucccccccuccuccgaggag

SEQ ID NO: 19607 - RNA, 384 nt, Artificial Sequence
  derived and/or modified sequence opt2 from anti-HIV_Chain
caguccgcccucacccagccccccuccgccuccggcgcccccggccagcgcgucaccaucuccugcuccggcggccccuccaacgucggcggcaacuacgucuacugguaccgccaguuccccggcaccgcccccaagcuccucauccuccgcgacgaccagcgccccuccggcguccccgaccgcuucuccgccuccaaguccggcaacuccgccucccucgccaucuccggccuccgccccgacgacgaggcccucuacuucugcgccaccuacgacuccgacggcuccauccgccucuucggcggcggcaccgcccucaccguccucucccagcccaaggccgcccccuccgucacccucuucccccccggcugggaggag

SEQ ID NO: 19608 - RNA, 384 nt, Artificial Sequence
  derived and/or modified sequence opt2 from anti-HIV_Chain
cagguccagcuccuccaguccggcgccgccgucaccaagcccggcgccuccguccgcgucuccugcgaggccuccggcuacaacauccgcgacuacuucauccacugguggcgccaggcccccggccagggccuccagugggucggcuggaucaaccccaagaccggccagcccaacaacccccgccucuuccagggccgcgucucccucacccgccacgccuccugggacuucgacaccuucuccuucuacauggaccucaaggccguccgcuccgacgacaccgccgucuacuucugcgcccgccagcgcuccgacuacugggacuucgacgucuggggcuccggcacccaggucaccgucuccuccgccuccaccaagggc

SEQ ID NO: 19609 - RNA, 384 nt, Artificial Sequence
  derived and/or modified sequence opt2 from anti-HIV_Chain
cagguccagcuccuccaguccggcgccgucgucaccaagcccggcgccuccguccgcgucuccugcgaggccuccggcuacaagauccgcgacuacuucauccacugguggcgccaggcccccggccagggccuccagugggucggcuggaucaacccccagaccggccagcccaacaucccccgccccuuccagggccgcgucacccucacccgccacgccuccugggacuucgacaccuucuccuucuacauggaccucaaggcccuccgcuccgacgacaccgccaucuacuucugcgcccgccgccgcuccgacuacugcgacuucgacgucuggggcuccggcacccacgucaccgucuccuccgccuccaccaagggc

SEQ ID NO: 19610 - RNA, 384 nt, Artificial Sequence
  derived and/or modified sequence opt2 from anti-HIV_Chain
cagguccagcuccuccaguccggcgccgccgucaccaagcccggcgccuccguccgcgucuccugcgaggccuccggcuacaacauccgcgacuacuucauccacugguggcgccaggcccccggccagggccuccagugggucggcuggaucaaccccaagaccggccagcccaacaacccccgccaguuccagggccgcgucucccucacccgccaggccuccugggacuucgacaccaucuccuucuacauggaccucaaggcccuccgccucgacgacaccgccgucuacuucugcgcccgccagcgcuccgacuacugggacuucgacgucuggggcuccggcacccaggucaccgucuccuccgccuccaccaagggc

SEQ ID NO: 19611 - RNA, 384 nt, Artificial Sequence
  derived and/or modified sequence opt2 from anti-HIV_Chain
cagguccagcuccuccaguccggcgccgccgucaccaagcccggcgccuccguccgcgucuccugcgaggccuccggcuacaacauccgcgacuacuucauccacugguggcgccaggcccccggccagggccuccagugggucggcuggaucaaccccaagaccggccagcccaacaacccccgccaguuccagggccgcgucucccucacccgccacgccuccugggacuucgacaccuucuccuucuacauggaccucaaggcccuccgcuccgacgacaccgccgucuacuucugcgcccgccagcgcuccgacuacugggacuucgacgucuggggcuccggcacccaggucaccgucuacuccgccuccaccaagggc

SEQ ID NO: 19612 - RNA, 384 nt, Artificial Sequence
  derived and/or modified sequence opt2 from anti-HIV_Chain
cagguccagcuccuccccuucggcggcgccgucaccaagcccggcgccuccguccgcgucuccugcgaggccuccggcuacaacauccgcgacuacuucauccacugguggcgccaggcccccggccagggccuccagugggucggcuggaucaaccccaagaccggccagcccaacaaccccugccaguuccagggccgcgucucccucacccgccccgccuccugggacuucgacaccaucuccuucuacauggaccucaaggcccuccgccucgacgacaccgccgucuacuucugcgcccgccagcgcuccgacuacugggacuucgacgucuggggcuccggcacccaggucaccgucuccuccgccuccaccaagggc

SEQ ID NO: 19613 - RNA, 384 nt, Artificial Sequence
  derived and/or modified sequence opt2 from anti-HIV_Chain
cagguccaccucucccaguccggcgccgccgucaccaagcccggcgccuccguccgcgucuccugcgaggccuccggcuacaagaucuccgaccacuucauccacugguggcgccaggcccccggccagggccuccagugggucggcuggaucaaccccaagaccggccagcccaacaacccccgccaguuccagggccgcgucucccucacccgccaggccuccugggacuucgacaccuacuccuucuacauggaccucaaggcccuccgcuccgacgacaccgccaucuacuucugcgcccgccagcgcuccgacuucugggacuucgacgucuggggcuccggcacccaggucaccgucuccuccgccuccaccaagggc

SEQ ID NO: 19614 - RNA, 384 nt, Artificial Sequence
  derived and/or modified sequence opt2 from anti-HIV_Chain
cagguccaccucucccaguccggcgccgccgucaccaagcccggcgccuccguccgcgucuccugcgaggccuccggcuacaagaucuccgaccacuucauccacugguggcgccaggcccccggccagggccuccagugggucggcuggaucaaccccaagaccggccagcccaacaacccccgccaguuccagggccgcgucucccucacccgccaggccuccugggacuucgacaccuacuccuucuacauggaccucaaggccguccgcuccgacgacaccgccaucuacuucugcgcccgccagcgcuccgacuucugggacuucgacgucuggggcuccggcacccaggucaccgucuccuccgccuccaccaagggc

SEQ ID NO: 19615 - RNA, 384 nt, Artificial Sequence
  derived and/or modified sequence opt2 from anti-HIV_Chain
cagguccagcuccuccaguccggcgccgccgucaccaagcccggcgccuccguccgcgucuccugcgaggccuccggcuacaagaucuccgaccacuucauccacugguggcgccaggcccccggccagggccuccagugggucggcuggaucaaccccaagaccggccagcccaacaacccccgccaguuccagggccgcaucucccucacccgccaggccuccugggacuucgacaccuucuccuucuacauggaccucaaggcccuccgcuccgacgacaccgccgucuacuucugcgcccgccagcgcuccgacuacugggacuucgacgucuggggcuccggcacccaggucaccgucuccuccgccuccaccaagggc

SEQ ID NO: 19616 - RNA, 384 nt, Artificial Sequence
  derived and/or modified sequence opt2 from anti-HIV_Chain
cagguccagcuccuccaguccggcgccgccgucaccaagcccggcgccuccguccgcgucuccugcgaggccuccggcuacaacauccgcgacuacuucauccacugguggcgccaggcccccggccagggccuccagugggucggcuggaucaaccccaagaccggccagcccaacaacccccgccaguuccagggccgcgucucccucacccgccacgccuccugggacuucgacaccuucuccuucuacauggaccucaagggccuccgcuccgacgacaccgccaucuacuucugcgcccgccagcgcuccgacuacugggacuucgacgucuggggcuccggcacccaggucaccgucuccuccgccuccaccaagggc

SEQ ID NO: 19617 - RNA, 384 nt, Artificial Sequence
  derived and/or modified sequence opt2 from anti-HIV_Chain
cagguccagcuccuccaguccggcgccgccgucaccaagcccggcgccuccguccgcgucuccugcgaggccuccggcuacaacauccgcgacuacuucauccacugguggcgccaggcccccggccagggccuccagugggucggcuggaucaaccccaagaccggccagcccaacaacccccgccaguuccagggccgcgucucccucacccgccacgccuccugggacuucgacaccuucuccuucuacauggaccucaaggcccuccgcuccgacgacaccgccgucuacuucugcgcccgccagcgcuccgacuacugggacuucgacgucuggggcuccggcacccaggucaccgucuccuccgccuccaccaagggc

SEQ ID NO: 19618 - RNA, 384 nt, Artificial Sequence
  derived and/or modified sequence opt2 from anti-HIV_Chain
cacguccagcuccuccaguccggcgccgccgucaccaagcccggcgccuccguccgcgucuccugcgaggccuccggcuacaacauccgcgacuacuucauccacugguggcgccaggcccccggccagggccuccagugggucggcuggaucaaccccaagaccggccagcccaacaacccccgccaguuccagggccgcgucucccucacccgccaggccuccugggacuucgacaccuucuccuucuacauggaccucaaggcccuccgccucgacgacaccgccaucuacuucugcgcccgccagcgcuccgacuacugggacuucgacgucuggggcuccggcacccaggucaccgucuccuccgccuccaccaagggc

SEQ ID NO: 19619 - RNA, 384 nt, Artificial Sequence
  derived and/or modified sequence opt2 from anti-HIV_Chain
cagguccaccucucccacuccggcgccgccgucaccaagcccggcgccuccguccgcgucuccugcgaggccuccggcuacaagaucuccgaccacuucauccacugguggcgccaggcccccggccagggccuccagugggucggcuggaucaaccccaagaccggccagcccaacaacccccgccaguuccagggccgcaucucccucacccgccaggccuccugggacuucgacaccuucuccuucuacauggaccucaaggcccuccgcuccgacgacaccgccgucuacuucugcgcccgccagcgcuccgacuacugggacuucgacgucuggggcuccggcacccaggucaccgucuccuccgccuccaccaagggc

SEQ ID NO: 19620 - RNA, 384 nt, Artificial Sequence
  derived and/or modified sequence opt2 from anti-HIV_Chain
cagguccaccucucccaguccggcgccgucgucaccaagcccggcgccuccguccgcgucuccugcgaggccuccggcuacaagaucuccgaccacuucauccacugguggcgccaggcccccggccagggccuccagugggucggcuggaucaaccccaagaccggccagcccaacaacccccgccaguuccagggccgcaucucccucacccgccaggccuccugggacuucgacaccuucuccuucuacauggaccucaaggcccuccgcuccgacgacaccgccgucuacuucugcgcccgccagcgcuccgacuacugggacuucgacgucuggggcuccggcacccaggucaccgucuccuccgccuccaccaagggc

SEQ ID NO: 19621 - RNA, 384 nt, Artificial Sequence
  derived and/or modified sequence opt2 from anti-HIV_Chain
cagguccaccucucccaguccggcgccgucgucaccaagcccggcgccuccguccgcgucuccugcgaggccuccggcuacaagaucuccgaccacuucauccacugguggcgccaggcccccggccagggccuccagugggucggcuggaucaaccccaagaccggccagcccaacaacccccgccaguuccagggccgcaucucccucacccgccaggccuccugggacaucgacaccuucuccuucuacauggaccucaaggcccuccgcuccgacgacaccgccgucuacuucugcgcccgccaccgcuccgacuacugggacuucgacgucuggggcuccggcacccaggucaccgucuccuccgccuccaccaagggc

SEQ ID NO: 19622 - RNA, 384 nt, Artificial Sequence
  derived and/or modified sequence opt2 from anti-HIV_Chain
cagguccaccucucccaguccggcgccgucgucaccaagcccggcgccuccguccgcgucuccugcgaggccuccggcuacaagaucuccgaccacuucauccacugguggcgccaggcccccggccagggccuccagugggucggcuggaucaaccccaagaccggccagcccaacaucccccgccaguuccagggccgcaucucccucacccgccaggccuccggcgacuucgacaccuucuccuucuacauggaccucaaggcccuccgcuccgacgacaccgccgucuacuucugcgcccgccagcgcuccgacuacugggacuucggcgucuggggcuccggcacccaggucaccgucuccuccgccuccaccaagggc

SEQ ID NO: 19623 - RNA, 384 nt, Artificial Sequence
  derived and/or modified sequence opt2 from anti-HIV_Chain
cagguccaccucucccaguccggcgccgucgucaccaagcccggcgccuccguccgcgucuccugcgaggccuccggcuacaagaucuccggccacuucauccacugguggcgccaggcccccggccagggccuccagugggucggcuggaucaaccccaagaccggccagcccaacaacccccgccaguuccagggccgcaucucccucacccgccaggccuccugggacuucgacaccuucuccuucuacauggaccucaaggcccuccgcuccgacgacaccgccgucuacuucugcgcccgccaccgcuccgacuacugggacuucgacgucuggggcuccggcacccaggucaccgucuccuccgccuccaccaagggc

SEQ ID NO: 19624 - RNA, 384 nt, Artificial Sequence
  derived and/or modified sequence opt2 from anti-HIV_Chain
cagguccaccucucccaguccggcgccgccgucaccaagcccggcgccuccguccgcgucuccugcgaggccuccggcuacaagaucuccgaccacuucauccacugguggcgccaggcccccggccagggccuccagugggucggcuggaucaaccccaagaccggccagcccaacaacccccgccaguuccagggccgcaucucccucacccgccaggccuccugggacuucgacaccuucuccuucuacauggaccucaaggcccuccgcuccgacgacaccgccgucuacuucugcgcccgccaccgcuccgacuacugggacuucgacgucuggggcuccggcacccaggucaccgucuccuccgccuccaccaagggc

SEQ ID NO: 19625 - RNA, 384 nt, Artificial Sequence
  derived and/or modified sequence opt2 from anti-HIV_Chain
cagguccaccucucccaguccggcgccgccgucaccaagcccggcgccuccguccgcgucuccugcgaggccuccggcuacaagaucuccgaccacuucauccacugguggcgccaggcccccggccagggccuccagugggucggcuggaucaaccccaagaccggccagcccaacaacccccgccaguuccagggccgcgucucccucacccgccaggccuccugggacuucgacaccuacuccuucuacaugggccucaaggccguccgcuccgacgacaccgccaucuacuucugcgcccgccagcgcuccgacuucugggacuucgacgucuggggcuccggcacccaggucaccgucuccuccgccuccaccaagggc

SEQ ID NO: 19626 - RNA, 384 nt, Artificial Sequence
  derived and/or modified sequence opt2 from anti-HIV_Chain
cagguccaccucucccaguccggcgccgucgucaccaagcccggcgccuccguccgcgucuccugcgaggccuccggcuacaagaucuccgaccacuucauccacugguggcgccaggcccccggccagggccuccagugggucggcuggaucaaccccaagaccggccagcccaacaacccccgccaguuccagggccgcaucucccucacccgccaggccuccugggacuucgacaccuucuccuucuacauggaccucaaggcccuccgcuccgacgacaccgccgucuacuucugcgcccgccaccgcuccgacuacugggacuucgacgucuggggcuccggcacccaggucaccgucuccuccgccuccaccaagggc

SEQ ID NO: 19627 - RNA, 384 nt, Artificial Sequence
  derived and/or modified sequence opt2 from anti-HIV_Chain
cagguccaccucucccaguccggcgccgucgucaccaagcccggcgccuccguccgcgucuccugcgaggccuccggcuacaagaucuccgaccacuucauccacugguggcgccaggcccccggccagggccuccagugggucggcuggaucaaccccaagaccggccagcccaacaacccccgccaguuccagggccgcaucucccucacccgccaggccuccugggacuucgacaccuucuccuucuacauggaccucgaggcccuccgcuccgacgacaccgccgucuacuucugcgcccgccagcgcuccgacuacugggacuucgacgucuggggcuccggcacccaggucaccgucuccuccgccuccaccaagggc

SEQ ID NO: 19628 - RNA, 384 nt, Artificial Sequence
  derived and/or modified sequence opt2 from anti-HIV_Chain
cagguccaccucucccaguccggcgccgccgucaccaagcccggcgccuccguccgcgucuccugcgaggccuccggcuacaagauccgcgacuacuccauccacugguggcgccaggcccccggccagggccuccagugggucggcuggaucaacccccagaccggccagcccaacaucccccgccccuuccagggccgcaucucccucacccgccaggccuccugggacuucgacaccuucuccuucuacauggaccucgaggcccuccgcuccgacgacaccgccgucuacuucugcgcccgccagcgcuccgacuacugggacuucgacgucuggggcuccggcacccaggucaccgucuccuccgccuccaccaagggc

SEQ ID NO: 19629 - RNA, 384 nt, Artificial Sequence
  derived and/or modified sequence opt2 from anti-HIV_Chain
cagguccaccucucccaguccggcgccgccgucaccaagcccggcgccuccguccgcgucuccugcgaggccuccggcuacaagaucuccgaccacuucauccacugguggcgccaggcccccggccagggccuccagugggucggcuggaucaaccccaagaccggccagcccaacaacccccgccaguuccagggccgcaucucccucacccgccaggccuccugggacuucgacaccuucuccuucuacauggaccucaaggcccuccgcuccgacgacaccgccgucuacuucugcgcccgccagcgcuccgacuaccgcgacuucgacgucuggggcuccggcacccaggucaccgucuccuccgccuccaccaagggc

SEQ ID NO: 19630 - RNA, 384 nt, Artificial Sequence
  derived and/or modified sequence opt2 from anti-HIV_Chain
cagguccaccucucccaguccggcgccgucgucaccaagcccggcgccuccguccgcgucuccugcgaggccuccggcuacaagaucuccgaccacuucauccacugguggcgccaggcccccggccagggcccccagugggucggcuggaucaaccccaagaccggccagcccaacaacccccgccaguuccagggccgcaucucccucacccgccaggccuccugggacuucgacaccuucuccuucuacauggaccucaaggcccuccgcuccgacgacaccgccgucuacuucugcgcccgccaccgcuccgacuacugggacuucgacgucuggggcuccggcacccaggucaccgucuccuccgccuccaccaagggc

SEQ ID NO: 19631 - RNA, 384 nt, Artificial Sequence
  derived and/or modified sequence opt2 from anti-HIV_Chain
cagguccgccuccuccaguccggcgccgccgucaccaagcccggcgccuccguccgcgucuccugcgaggccuccggcuacgagauccgcgacuacuucauccacugguggcgccaggcccccggccagggccuccagugggucggcuggaucaaccccaagaccggccagcccaacaacccccgccaguuccagggccgcgucucccucacccgccaggccuccugggacuucgacuccuacuccuucuacauggaccucaaggcccuccgcuccgacgacaccgccgucuacuucugcgcccgccagcgcuccgacuacugggacuucgacgucuggggcuccggcacccaggucaccgucuccuccgccuccaccaagggc

SEQ ID NO: 19632 - RNA, 384 nt, Artificial Sequence
  derived and/or modified sequence opt2 from anti-HIV_Chain
cagguccgccuccuccaguccggcgccgccgucaccaagcccggcgccuccguccgcgucuccugcgaggccuccggcuacgagauccgcgacuacuucauccacugguggcgccaggcccccggccagggccuccagugggucggcuggaucaaccccaagaccggccagcccaacaacccccgccaguuccagggccgcgucucccucacccgccaggccuccugggacuucgacuccuacuccuucuacauggaccucaaggcccuccgcuccgacgacaccggcgucuacuucugcgcccgccagcgcuccgacuacugggacuucgacgucuggggcuccggcacccaggucaccgucuccuccgccuccaccaagggc

SEQ ID NO: 19633 - RNA, 384 nt, Artificial Sequence
  derived and/or modified sequence opt2 from anti-HIV_Chain
cagguccgccuccuccaguccggcgccgccgucaccaagcccggcgccuccguccgcgucuccugcgaggccuccggcuacgagauccgcgacuacuucauccacugguggcgccaggcccccggccagggccuccagugggucggcuggaucaaccccaagaccggccagcccaacaacccccgccaguuccagggccgcgucucccucacccgccaggccuccugggacuucgacuccuacuccuucuacauggaccucaaggcccuccgcuccgacgacaccgccgucuacuucugcgcccgccagcgcuccgacuacugggacuucgacgucuggggcuccggcucccaggucaccgucuccuccgccuccaccaagggc

SEQ ID NO: 19634 - RNA, 384 nt, Artificial Sequence
  derived and/or modified sequence opt2 from anti-HIV_Chain
cagguccagcuccuccaguccggcgccgccgucaccaagcccggcgccuccguccgcgucuccugcgaggccuccggcuacaacauccgcgacuacuucauccacugguggcgccaggcccccggccagggccuccagugggucggcuggaucaaccccaagaccggccagcccaacaaccccugccaguuccagggccgcgucucccucacccgccaggccuccugggacuucgacaccaucuccuucuacauggaccucaaggcccuccgccucgacgacaccgccgucuacuucugcgcccgccagcgcuccgacuacugggacuucgacgucuggggcuccggcacccaggucaccgucuccuccgccuccaccaagggc

SEQ ID NO: 19635 - RNA, 384 nt, Artificial Sequence
  derived and/or modified sequence opt2 from anti-HIV_Chain
cagguccagcuccuccaguccggcgccgccgucaccaagcccggcgccuccguccgcgucuccugcgaggccuccggcuacaacauccgcgacuacuucauccacugguggcgccaggcccccggccagggccuccagugggucggcuggaucaaccccaagaccggccagcccaacaacccccgccaguuccagggccgcgucucccucacccgccacgccuccugggacuucgacaccuucuccuucuacauggaccucaaggcccuccgcuccgacgacaccgccgucuacuucugcgcccgccagcgcuccgacuacugggacuucgacgucuggggcuccggcacccaggucaucgucuccuccgccuccaccaagggc

SEQ ID NO: 19636 - RNA, 384 nt, Artificial Sequence
  derived and/or modified sequence opt2 from anti-HIV_Chain
cagguccagcucguccaguccggcgccgacgucaagaagcccggcgccaccgucaccgucuccugcaagaccgacgaggacgaggacgacuuccgcgcccaccucaugcaguggaugcgccaggcccccggccagcgccucgagugggucggcuggaucaagccccagaccggccagcccuccuacggccagaaguuccagggccgcgucacccucacccgcgaggucuccaccuccaccgucuuccuccagcuccgcaaccuccgcuccgacgacaccgccgucuacuacugcgcccgcccccgcggcggccgcgacaacugguccuuccacgucuggggccgcggcacccucgucaccgucuccuccgccuccaccaagggc

SEQ ID NO: 19637 - RNA, 384 nt, Artificial Sequence
  derived and/or modified sequence opt2 from anti-HIV_Chain
gagguccagcucgucgaguccggcgccgaggucaagaagcccggcgccuccgucaaggucuccugcaaggucuccggcaacucccucaccgaguucuccauccacuggguccgccaggcccccggcaagggccucgaguggaugggcggcuucgaccccgaggagggcgagaccguccccgcccagaaguucaagggccgccucaccaugaccgaggacaccuccaccaacaccgccuacauggagcucuccucccuccgcuccgaggacaccgccgucuacuacugcuccaccgagccccgcgagaugggcacccucaccgccggcuucgaguacuggggccagggcacccucgucaccgucuccuccgccuccaccaagggc

SEQ ID NO: 19638 - RNA, 384 nt, Artificial Sequence
  derived and/or modified sequence opt2 from anti-HIV_Chain
cgcguccagcucggccaguccggcgccgaggucaagaagcccggcgccuccgucaaggucuccugcaaggucuccggcaacucccucaccgaguucuccauccacuggguccgccaggcccccggcaagggccucgaguggaugggcggcuucgaccccgaggagggcgagaccguccccgcccagaaguucaagggccgcgucaccaugaccgaggacaccuccaccaacaccgccuacauggagcucuccucccuccgcuccgaggacaccgccgucuacuacugcuccaccgagccccgcgagaugggcacccucaccgccggcuucgaguacuggggccagggcacccucgucaucgucuccuccgccuccaccaagggc

SEQ ID NO: 19639 - RNA, 384 nt, Artificial Sequence
  derived and/or modified sequence opt2 from anti-HIV_Chain
cagguccagcucguccaguccggcgccgacgucaagaagcccggcgccuccgucaccgucuccugcaagaccgacgaggacgaggacgacuuccgcgcccaccucguccaguggaugcgccaggcccccggccagcgccucgagugggucggcuggaucaagccccagaccggccagcccuccuacgcccagaaguuccagggccgcgucacccucacccgcgaggucuccaccuccaccgucuuccuccagcuccgcaaccuccgcuccgacgacaccgccgucuacuacugcgcccgcccccgcggcggccgcgacaacugguccuuccacgucuggggccgcggcacccucgucaccgucuccuccgccuccaccaagggc

SEQ ID NO: 19640 - RNA, 384 nt, Artificial Sequence
  derived and/or modified sequence opt2 from anti-HIV_Chain
cagguccagcuccaggaguccggccccggccucgucaagcccuccgagacccucucccucaccugcuccgucuccggcgccuccaucuccaacuucuacuggaccuggauccgccagcccgccggcaagggccucgagugggucggccgccucuacuccuccgaccgcaccaacuacaaccccucccucaacggccgcgucaccaugucccucgacaccuccaagaaccaguucucccuccgccucaccuccaugaccgacgccgacaccgccaucuacuucugcgcccgcgagaagggccaguggcucaccgucccccccuacuacuucgacuccuggggccagggcauccucgucaccgucuccuccgccuccaccaagggc

SEQ ID NO: 19641 - RNA, 384 nt, Artificial Sequence
  derived and/or modified sequence opt2 from anti-HIV_Chain
cagguccagcucguccaguccggcgccgagguccgcaagcccggcgccuccgucaaggucuccugcaagaccuccggcuacaccuucaccaacuccuacauccacuggguccgccaggcccccggccagggccucgaguggaugggcaucaucaacccccccggcggcaacaccuacuacgcccagaaguuccacggccgcgucacccucacccgcgacaccuccaccuccaccgucuacauggagcucaacucccuccgcuccgaggacaccgccgucuacuucugcgcccgcccccacucccccaccaacauccccucccgcccccucgacuacuggggccagggcacccucgucaccgucuccuccgccuccaccaagggc

SEQ ID NO: 19642 - RNA, 384 nt, Artificial Sequence
  derived and/or modified sequence opt2 from anti-HIV_Chain
cagguccagcuccaggaguccggccccggccucgucaagcccuccggcacccucucccucaccugcaacgucuacggcggcuccaugaucuccuacuacugguccuggauccgccagccccccggcaagggccucgaguggaucggccacgucuacaacuccggcaacaccaaguacucccccucccucaagaaccgcgucaccaucuccauggacaccucccgcaaccucuucucccucaaggucaccuccgucacccccgccgacaccgccgucuacuacugcgcccgcgccgacuacgacaacaucugggacucccgcggcggcuucgaccucuggggccagggcacccucgucaccgucuccuccgccuccaccaagggc

SEQ ID NO: 19643 - RNA, 384 nt, Artificial Sequence
  derived and/or modified sequence opt2 from anti-HIV_Chain
cagguccagcucguccaguccggcgccgaggucaagaagcccggcuccuccgucaaggucuccugcaaggccuccggcggcacccucuccuccuacaccaucuccuggguccgccaggcccccggccagggccucgaguggaugggccgccucaucccccucgucgacaucaccaccuacgcccagaaguuccagggccgcgucaccaucaccgccgacaccuccaccaacaccgccuacauggagcucuccaaccuccgcuccgaggacaccgccaucuaccacugcgccaccuccaccaugaucgccgccgucaucaacgacgccuucgaccucuggggccagggcaccaccgucaccgucuccuccgccuccaccaagggc

SEQ ID NO: 19644 - RNA, 384 nt, Artificial Sequence
  derived and/or modified sequence opt2 from anti-HIV_Chain
cagguccagcucguccaguccggcgccgaggucaagaagcccggcgccuccgucaagaucuccugcaaggccuccggcuacuccuuccgcaacuacgccguccacuggguccgccaggcccccggccagggccucgaguggaugggcgagaucaacggcggcaacggcaacaccgaguacucccagaagucccagggccgccucaccaucacccgcgacaucuccgccaccaccgccuacauggagcucuccucccuccgcuccgacgacaccgccgucuacuacugcgcccgcgucgccuacguccacgucgucaccacccgcucccucgacaacuggggccagggcacccucgucaccgucuccuccgccuccaccaagggc

SEQ ID NO: 19645 - RNA, 384 nt, Artificial Sequence
  derived and/or modified sequence opt2 from anti-HIV_Chain
cagguccgccucucccaguccggcgccgccgucaugaagaccggcgccuccgucaccaucuccugcgagaccgagggcuucaacuucgucaacuacaucauccacuggguccgccgcccccccggccgcggcuucgaguggcucggcaugaucgacccccgcaacggccaccccugguucgcccagaccguccgcggccgccucucccuccgccgcgacaccuucaacgagaucgucuacaugacccucuccggccucaccaccgacgacaccggccucuacuucugcgcccgcaacgagccccaguaccacucccuccccggcauguucgacuacuggggccagggcacccccgucaccgucuccuccgccuccaccaagggc

SEQ ID NO: 19646 - RNA, 384 nt, Artificial Sequence
  derived and/or modified sequence opt2 from anti-HIV_Chain
cagguccgccucucccaguccggcgccgccgucgucaagaccggcgccuccgucaccaucuccugcgagaccgagggcuacaacuucgucaacuacaucauccacuggguccgccgcccccccggccgcggcuucgaguggcucggcaugaucgacccccgcaacggccaccccugguucgcccagaccguccgcggccgccucucccuccgccgcgacaccuucaaggagaccgucuacaugacccucuccggccucaccuccgacgacaccggcgucuacuucugcgcccgcaacgagccccaguaccacucccuccccggcauguucgacuacuggggccacggcacccccgucaccgucuccuccgccuccaccaagggc

SEQ ID NO: 19647 - RNA, 384 nt, Artificial Sequence
  derived and/or modified sequence opt2 from anti-HIV_Chain
cagggccagcucguccaguccggcggcggcgucaagaagcucggcaccuccgucaccaucuccugccucgccuccgaguacaccuucaacgaguucgucauccacuggauccgccaggcccccggccagggcccccucuggcucggccucaucaagcgcuccggccgccucaugaccuccuaccaguuccaggaccgccucucccuccgccgcgaccgcuccaccggcaccgucuucauggagcuccgcggccuccgcgucgacgacaccgccgucuacuacugcgcccgcgacggccucggcgaggucgcccccgccuaccucuacggcaucgacgccuggggccagggcaccaccgucaucgucaccuccgccuccaccucc

SEQ ID NO: 19648 - RNA, 384 nt, Artificial Sequence
  derived and/or modified sequence opt2 from anti-HIV_Chain
cagguccagcucguccaguccggcgccgaggucaagaagcccggcgccuccgucaaggucuccugcaaggccuccggcuacaccuucaccuccuacgacaucaacuggguccgccaggccaccggccagggccucgaguggaugggcuggaugaaccccaacuccggcaacaccggcuacgcccagaccuuccagggccgcgucaccaugacccgcaacaccuccaucuccaccgccuacauggagcucuccucccuccgcuccgaggacaccgccgucuacuacugcgcccgcgaccgcuggcucccccaguacuacuacuacggcauggacgucuggggccagggcaccaccgucaccgucuccuccgccuccaccaagggc

SEQ ID NO: 19649 - RNA, 384 nt, Artificial Sequence
  derived and/or modified sequence opt2 from anti-HIV_Chain
cagguccagcucguccaguccggcgccgaggucaagaagcccggcuccuccaugaaggucuccugcaaguccuccggcggcaccuucuccaaccacgccaucuccuggguccgccaggcccccggcaagggccucgaguggaugggcggcaucauccccauguccggcaccaccaacuaccuccagaaguuccagggccgcgucaccaucaccgccgacgaguucgccaccaccgccuacauggagcucuccucccucaccuccgaggacaccgccgucuacuacugcgcccgcgcccgcgccgacucccacacccccaucgacgccuucgacaucuggggccccggcacccgcgucaucgucuccuccgccuccaccaagggc

SEQ ID NO: 19650 - RNA, 384 nt, Artificial Sequence
  derived and/or modified sequence opt2 from anti-HIV_Chain
cagguccagcucguccaguccggcgccgaggucaagaagcccggcgccuccgucaaggucuccugcaaggucuccggcuacacccucaccgagcucuccauccacuggguccgccaggcccccggcaagcgccucgaguggaugggcggcuucgaccccgaggacggcgagcgcaucuacgcccagaaguuccagggccgcgucaccaugaccgaggacaccuccaccgacaccgccuacauggagcucaacucccuccgcuccgacgacaccgccgucuacuacugcgccaccggcggccucuacugcuccuccaucuccugcaucauggacgucuggggccagggcaccaccgucaccgucuccuccgccuccaccaagggc

SEQ ID NO: 19651 - RNA, 384 nt, Artificial Sequence
  derived and/or modified sequence opt2 from anti-HIV_Chain
cagguccagcucguccaguccggcgccgaggucaagaugcccggcgccuccgucaaggucuccugcaaggucuccggcuacucccucaccgagcucuccauccacuggguccgccaggcccccggcaagcgccucgaguggaugggcggcuucgaccccgaggacgacgagcgcaucuacgcccagaaguuccaggaccgcgucaccaugaccgaggacaccuccaccgacaccgccuacauggaccucaacucccuccgcuccgaggacaccgccgucuacuacugcaccaccggcggccucuacugcuccuccaucuccugcaucauggacgucuggggccagggcaccaccgucaucgucuccuccgccuccaccaagggc

SEQ ID NO: 19652 - RNA, 387 nt, Artificial Sequence
  derived and/or modified sequence opt2 from anti-HIV_Chain
gagguccagcucuccgaguccggcggcggcuucgucaagcccggcggcucccuccgccucuccugcgaggccuccggcuucaccuucaacaacuacgccauguccuggguccgccaggcccccggcaagggccucgagugggucuccgucaccuccgcccacggcggcuccgccuacuacggcgaguucgucaagggccgcuucaccaugucccgcgaccacuucaucgacaccgucuaccucgagaugaacggccucaccgucgaggacaccgccgucuacuacugcguccgcgucaccuucuaccacgagggcuccggcuacuacuaccgcgccggcaacuacuucgacuccuggggcaagggcacccgcgucgucgucuccgcc

SEQ ID NO: 19653 - RNA, 387 nt, Artificial Sequence
  derived and/or modified sequence opt2 from anti-HIV_Chain
gagguccagcucuccgaguccggcggcggcuucgucaagcccggcggcucccuccgccucuccugcgaggccuccggcuucaccuucaacaacuacgccauguccuggguccgccaggcccccggcaagggccucgagugggucuccgucaccuccgcccacggcggcuccgccuacuacggcgaguucgucaagggccgcuucaccaugucccgcgaccacuucaucgacaccgucuaccucgagaugaaccgccucaccgucgaggacaccgccgucuacuacugcguccgcgucaccuucuaccacgagggcuccggcuacuacuaccgcgccggcaacuacuucgacuccuggggcaagggcacccgcgucgucgucuccgcc

SEQ ID NO: 19654 - RNA, 387 nt, Artificial Sequence
  derived and/or modified sequence opt2 from anti-HIV_Chain
gagguccagcucuccgaguccggcggcggcgucgucaagcccggcggcucccuccgccucuccugcgaggccuccggcuucaccuucuccaacuacgccauguccuggguccgccaggcccccggcaagggccucgagugggucuccgucaccggcggccacggcaccuacggcuacuacggcgaguucgucaagggccgcuucaccaucucccgcgaccacuccauggacaccgucuaccuccagaugaaccgccuccgcgucgaggacaccgccgucuacuacugcguccgcacccccuacuaccacgaguccuccggcuacuacuaccgcgccggcaacuacuucgacuucuggggcaagggcacccucgucaucgucuccgcc

SEQ ID NO: 19655 - RNA, 387 nt, Artificial Sequence
  derived and/or modified sequence opt2 from anti-HIV_Chain
gagguccagcucuccgaguccggcggcggcuucgucaagcccggcggcucccuccgccucuccugcgaggccuccggcuucaccuucaacaacuacgccaugggcuggguccgccaggcccccggcaagggccucgagugggucuccgucaccuccgcccacggcggcuccgccuacuucggcgaguucgucaagggccgcuucaccaugucccgcgaccacuucaucgacaccgucuaccucgagaugaaccgccucaccgucgaggacaccgccgucuacuacugcguccgcgucaccuucuaccacgagggcuccggcuacuacuaccgcgccggcaacuacuucgacuccuggggccagggcacccucgucaucgucuccgcc

SEQ ID NO: 19656 - RNA, 387 nt, Artificial Sequence
  derived and/or modified sequence opt2 from anti-HIV_Chain
cagguccagcucgucgaguccggcggcggccucguccagcccggcggcucccuccgccucuccugcgccgccuccggcuucaccuucuccacccacuggaugcacuggguccgccaggcccccggcaagggccucgucugggucucccgcauccacuccgacggccgcuccaccuccuacgccgacuccgucaagggccgcuucaccaucucccgcgacaacgccaagaacacccucuaccuccagaugaacucccuccgcgccgaggacaccgccgucuacuacugcgcccgcggcgccgccgucuucggcgucgucaucaucggcggcauggaccucuggggccagggcaccaccgucaccgucuccuccgccuccaccaagggc

SEQ ID NO: 19657 - RNA, 387 nt, Artificial Sequence
  derived and/or modified sequence opt2 from anti-HIV_Chain
cagguccagcucgucgaguccggcggcgcccucguccagcccggcggcucccuccgccucuccugcgccgccuccggcuucuccuucuccuccuacgccauguccuggguccgccaggcccccggcaagggccucgagugggucuccgccaucucccgcuccggcggcuccaccuacuacgccgacuccgucaagggccgcuucaccaucuccaucgacaacuccaacaacacccucuaccuccagaugaacucccuccgcgucgaggacaccgccgucuacuacugcgccaagcgcgaggccuucuacuacggcgccggcggcuacggcauggacgucuggggccagggcaccaccgucaccgucuccuccgccuccaccaagggc

SEQ ID NO: 19658 - RNA, 387 nt, Artificial Sequence
  derived and/or modified sequence opt2 from anti-HIV_Chain
uuccagggccaccucguccaguccggcggcggcgucaagaagcccggcaccuccgucacccucuccugccucgccuccgaguacaccuucaccgaguucaccauccacuggauccgccaggcccccggccagggcccccucuggcucggccucaucaagcgcuccggccgccucaugaccuccuaccgcuuccaggaccgccucucccuccgccgcgaccgcuccaccggcaccgucuucauggagcuccgcucccuccgcaccgacgacaccgccgucuacuacugcgcccgcgacggccucggcgagcucgcccccgccuaccacuacggcaucgacgccuggggccagggcaccaccgucaucgucaccuccgccuccaccucc

SEQ ID NO: 19659 - RNA, 387 nt, Artificial Sequence
  derived and/or modified sequence opt2 from anti-HIV_Chain
cagggccuccucguccaguccggcggcggcgucaagaagcucggcaccuccgucaccaucuccugccucgccuccgaguacaccuucaacgaguucgucauccacuggauccgccaggcccccggccagggcccccucuggcucggccucaucaagcgcuccggccgccucaugaccuccuaccaguuccaggaccgccucucccuccgccgcgaccgcuccaccggcaccgucuucauggagcuccgcggccuccgcgucgacgacaccgccgucuacuacugcgcccgcgacggccucggcgaggucgcccccgccuaccucuacggcaucgacgccuggggccagggcaccaccgucaucgucaccuccgccuccaccaagggc

SEQ ID NO: 19660 - RNA, 387 nt, Artificial Sequence
  derived and/or modified sequence opt2 from anti-HIV_Chain
aacuucaugcucacccagcccgccuccgucuccggcucccccggccaguccaucaccaucuccugcuccggcaccggcuccgacaucggcgucuacaacuacgucuccugguaccagcagcaccccggcaaggccccccgccucaugaucuacgacgucaccaaccgccccuccggcgucuccaaccgcuucuccggcuccaaguccggcuucaccgccucccucaccaucuccggccuccagggcgacgacgaggccgacuacuacugcuccuccuacuccuccaccaacaccuacgucuucggcaccggcacccacgucaccguccucggccagcccaaggccaaccccaccgucacccucuucccccccuccuccgaggagcuc

SEQ ID NO: 19661 - RNA, 387 nt, Artificial Sequence
  derived and/or modified sequence opt2 from anti-HIV_Chain
caguccgcccucacccagccccgcuccgucuccggcucccccggccaguccgucaccaucuccugcaccggcaccuccuccgacgucggcgccuacaacuacgucuccugguaccgccagcaccccggcaaggcccccaagcucaugaucaacgacgucuccaagcgccccuccggcguccccgaccgcuucuccggcuccaaguccggcaacaccgccucccucaccaucuccggccuccaggccgaggacgaggccgacuacuacugcugcuccuacgccggcaccuacuccuacgucuucggcaccggcaccaaggucaccguccucggccagcccaaggccaaccccaccgucacccucuucccccccuccuccgaggagcuc

SEQ ID NO: 19662 - RNA, 387 nt, Artificial Sequence
  derived and/or modified sequence opt2 from anti-HIV_Chain
cagggccagcucguccaguccggcggcggccucaagaagcccggcaccuccgucaccaucuccugccucgccuccgaguacaccuucaacgaguucgucauccacuggauccgccaggcccccggccagggcccccucuggcucggccucaucaagcgcuccggccgccucaugaccgccuacaacuuccaggaccgccucucccuccgccgcgaccgcuccaccggcaccgucuucauggagcuccgcggccuccgccccgacgacaccgccgucuacuacugcgcccgcgacggccucggcgaggucgcccccgacuaccgcuacggcaucgacgucuggggccagggcuccaccgucaucgucaccgccgccuccaccaagggc

SEQ ID NO: 19663 - RNA, 387 nt, Artificial Sequence
  derived and/or modified sequence opt2 from anti-HIV_Chain
aacuucaugcucacccagccccccuccgccuccggcgcccccggccagcgcgucaccaucuccugcuccggcggccccuccaacgucggcggcaacuacgucuacugguaccgccaguuccccggcaccgcccccaaccuccucauccuccgcgacgaccagcgccccuccggcguccccgaccgcuucuccgccuccaaguccggcaacuccgccucccucgccaucuccggccuccgccccgacgacgaggccuucuacuucugcgccaccuacgacuccgacggcuccauccgccucuucggcggcggcaccacccucaccguccucucccagcccaaggccgcccccuccgucacccucuucccccccuccuccgaggagcuc

SEQ ID NO: 19664 - RNA, 387 nt, Artificial Sequence
  derived and/or modified sequence opt2 from anti-HIV_Chain
cagcucguccucacccagccccccuccgucuccggcgcccccggccagcgcgucaccaucuccugcuccggcggccccuccaacgucggcggcaaccucgucuacugguacaagcaguuccccggcaccgcccccaagcuccucauccgccgcgacgaccagcgccccuccggcguccccgaccgcuucuccggcuccaaguccggcaacuccgccucccucaccaucuccggccuccgccccgacgacgaggccuucuacuucugcgccaccuacgacucccagggcuccacccgccucuucggcggcggcaccguccucaccguccucucccagcccaaggccgcccccuccgucacccucuucccccccuccuccgaggagcuc

SEQ ID NO: 19665 - RNA, 387 nt, Artificial Sequence
  derived and/or modified sequence opt2 from anti-HIV_Chain
aacuucaugcucacccagccccccuccgucuccggcgcccccggccagcgcgucaccaucuccugcuccggcggccccuccaacgucggcggcaaccucgucuacugguacaagcaguuccccggcaccgcccccaagcuccucauccgccgcgacgaccagcgccccuccggcguccccgaccgcuucuccggcuccaaguccggcaacuccgccucccucgccaucuccggccuccgccccgacgacgaggccuucuacuucugcgccaccuacgacucccacggcuccauccgccucuucggcggcggcacccuccucaccguccucucccagcccaaggccgcccccuccgucacccucuucccccccuccuccgaggagcuc

SEQ ID NO: 19666 - RNA, 387 nt, Artificial Sequence
  derived and/or modified sequence opt2 from anti-HIV_Chain
caguccgcccucacccgcacccccuccgucuccggcgcccccggccagcgcgucaccaucuccugcuccggcggccccuccaacgucggcggcaacuacgucuacugguaccagcaguuccccggcgccgcccccaagcuccucauccgccgcgacgaccagcgccccuccggcguccccgaccgcuucuccggcuccaaguccggcaacuccgccucccucgccaucuccggccuccgccucgacgacgaggccuacuacuucugcgccaccuacgacuccggcugguccauccgccucuucggcggcggcacccgccucaccguccucucccagcccaaggccgcccccuccgucacccucuucccccccuccuccgaggagcuc

SEQ ID NO: 19667 - RNA, 387 nt, Artificial Sequence
  derived and/or modified sequence opt2 from anti-HIV_Chain
caguccgcccucacccagccccccuccgucuccgccacccccggccagaccgucaccaucuccugcuccggcuccggcuccaacgucggcggcaaccacgucuacugguaccgccagcuccccggcgccgcccccacccuccucaucuccaagaccgaccaccgccccucccgcguccccgaccgcuucuccgccuccaaguccggcaacuccgccucccucgccaucuccggccuccgccccgacgacgaggccaucuacuucugcgccaccuacgacaccggccucucccuccgccucuucggcggcggcacccgccucaccguccucucccagcccaaggccgcccccuccgucacccucuucccccccuccuccgaggagcuc

SEQ ID NO: 19668 - RNA, 387 nt, Artificial Sequence
  derived and/or modified sequence opt2 from anti-HIV_Chain
cagguccagcuccucgaguccggccccggccucgucacccccuccggcacccucucccucgccugcgccgucuccggcgccuccaucuccuccucccacugguggaccuggguccgccagucccccggcaagggccucgaguggaucggcgagaucgaccgccgcggcaccaccaacuacaaccccucccuccgcucccgcgucaccauccuccucgacaacuccaagaaccaguucucccucucccuccgcuccgucaccgccgccgacaccgccgucuacuacugcaccaaggucuacgccggccucuucaacgagcgcaccuacggcauggacgucuggggccacggcaccaccguccucgucuccuccgccuccaccaagggc

SEQ ID NO: 19669 - RNA, 387 nt, Artificial Sequence
  derived and/or modified sequence opt2 from anti-HIV_Chain
caggccgucgucacccagccccccuccgucuccgccacccccggccagaccgucaccaucuccugcuccggcuccggcuccaacgucggcggcaaccacgucuacugguaccgccagcuccccggcgccgcccccacccuccucaucuccaagaccaaccgccgccccucccagguccccgaccgcuucuccggcuccaaguccggcaacuccgccucccucgccaucuccggccuccgccccgacgacgaggccgacuacuucugcgccaccuacgacaccgaccucucccuccgccucuucggcggcggcacccgccucaccguccucucccagcccaaggccgcccccuccgucacccucuucccccccuccuccgaggagcuc

SEQ ID NO: 19670 - RNA, 387 nt, Artificial Sequence
  derived and/or modified sequence opt2 from anti-HIV_Chain
caguccgcccucacccagccccccuccgucuccggcacccccggccagaacgucaccaucuccugcuccggcggcggcuccgacgucggcggcaaccucgucuccugguaccagcacuuccccggcgccgcccccaagcuccucauccaccgcgacaaccagcgccccuccggcguccccgaccgcuucuccgcccucaaguccggcaacuccgccucccucgccaucuccggccuccgcuccgacgacgaggccuucuacuucugcgccgucuacgacuccucccucucccucggccucuucggcggcggcaccaagcucaccguccucucccagcccaaggccgcccccuccgucacccucuucccccccuccuccgaggagcuc

SEQ ID NO: 19671 - RNA, 387 nt, Artificial Sequence
  derived and/or modified sequence opt2 from anti-HIV_Chain
caguccgcccucacccagccccccuccgccuccggcacccccggccagcgcgucaccaucuccugcuccggcggcggcuccaacaucggcggcaaccucgucuccugguaccagcacuuccccggcaccgcccccaagcuccucaucuaccgcaacgaccagcgccccuccggcguccccgaccgcuucuccggcuccaaguccggcaccuccgccucccucaccaucuccggccuccgcuccgacgacgaggccaccuacuucugcgccgccuacgacuccucccucucccuccgccucuucggcggcggcaccacccucaacguccucucccagcccaaggccgcccccuccgucacccucuucccccccuccuccgaggagcuc

SEQ ID NO: 19672 - RNA, 387 nt, Artificial Sequence
  derived and/or modified sequence opt2 from anti-HIV_Chain
caguccgcccucacccagccccccuccgucuccgccacccccggccagaccgucaccaucuccugcuccggcuccggcuccaacgucggcggcaaccacgucuacugguaccgccagcuccccggcgccgcccccacccuccucaucuccaagaccaaccaccgccccucccagguccccgaccgcuucuccgccuccaaguccggcaacuccgccucccucgccaucuccggccuccgccccgacgacgaggccgacuacuucugcggcaccuacgacaccucccucucccuccgccucuucggcggcggcacccgccucaccguccucucccagcccaaggccgcccccuccgucacccucuucccccccuccuccgaggagcuc

SEQ ID NO: 19673 - RNA, 387 nt, Artificial Sequence
  derived and/or modified sequence opt2 from anti-HIV_Chain
caguccguccucacccagguccucuccgucuccggcacccccggccagcgcgucaucaucuccugcuccggcaccuccuccaacgucggcggcaaccucgucuccugguaccagcaccuccccggcgccgccccccgccuccucauccaccgcgacgaccagcgccccuccggcguccccgaccgcuucuccggcuccaaguccggcaacuccgccucccucgucaucuccggccuccgcuccgacgacgaggccgacuacuucugcggcgccuacgacuccaccuucucccuccccgucuucggcggcggcacccgccucaccguccucucccagcccaaggccgcccccuccgucacccucuucccccccuccuccgaggagcuc

SEQ ID NO: 19674 - RNA, 387 nt, Artificial Sequence
  derived and/or modified sequence opt2 from anti-HIV_Chain
caguccgcccucacccagccccccgccaccuccggcacccccggccagcgcgucaccaucuccugcuccggcggcggcuccaacgucggcggcaaccucgucuccugguaccagcaguuccccggcgccgcccccaagcucauccuccaccgcgacggccagcgccccuccggcguccccgaccgcuucuccgccuccaaguccggcaccuccgccucccucaccaucuccggccuccgcuccgacgacgaggccaccuacuucugcgccgccuucgacuccgcccucucccucccccucuucggcggcggcaccaagcucaccguccucucccagcccaaggccgcccccuccgucacccucuucccccccuccuccgaggagcuc

SEQ ID NO: 19675 - RNA, 387 nt, Artificial Sequence
  derived and/or modified sequence opt2 from anti-HIV_Chain
cagcucguccucacccagccccccuccgucuccgccacccccggccagaccgucaccaucuccugcuccggcuccggcuccaacgucggcggcaaccacgucuacugguaccgccagcuccccggcgccgcccccacccucgucaucuccaagaccgaccaccgccccucccgcguccccgaccgcuucuccggcuccaaguccggcaacuccgccucccucgccaucuccggccuccgccccgacgacgaggccgccuacuucugcgccaccuacgacaccggccucucccuccgccucuucggcggcggcacccgccucgccguccucucccagcccaaggccgcccccuccgucacccucuucccccccuccuccgaggagcuc

SEQ ID NO: 19676 - RNA, 387 nt, Artificial Sequence
  derived and/or modified sequence opt2 from anti-HIV_Chain
caguccgcccucacccagccccccuccgucuccggcacccccggccagaacgucaccaucuccugcuccggcggcggcuccaacgucggcggcaaccucgucuccugguaccagcacuuccccggcgccgcccccaagcuccucauccaccgcgacaaccagcgccccuccggcguccccgaccgcuucuccguccucaaguccggcaacuccgccucccucgccaucuccggcccccgcuccgacgacgaggccuucuacuucugcgccgucuacgacuccucccucucccucggccucuucggcggcggcaccaagcucaccguccucucccagcccaaggccgcccccuccgucacccucuucccccccuccuccgaggagcuc

SEQ ID NO: 19677 - RNA, 387 nt, Artificial Sequence
  derived and/or modified sequence opt2 from anti-HIV_Chain
cagaccgucgucacccagccccccuccgccuccggcacccccggccagcgcgucaccaucuccugcuccggcggcggcuccaacaucggcggcaaccucgucuccugguaccagcacuuccccggcgccgcccccaagcuccucaucuaccgcaacgaccagcgccccuccggcguccccgaccgcuucuccggcuccaaguccggcaccuccgccucccucaccaucuccggccuccgcuccgacgacgaggccaccuacuucugcgccgccuacgacugcacccucucccuccgccucuucggcggcggcaccacccucaacguccucucccagcccaaggccgcccccuccgucacccucuucccccccuccuccgaggagcuc

SEQ ID NO: 19678 - RNA, 387 nt, Artificial Sequence
  derived and/or modified sequence opt2 from anti-HIV_Chain
caguccgcccucacccagacccccuccgucuccggcgcccccggccagcgcgucaccaucuccugcuccggcggccccuccaacgucggcggcaacuacgucuacugguaccagcaguuccccggcgccgcccccaagcuccucauccgccgcgacgaccagcgccccuccggcguccccgaccgcuucuccggcuccaaguccggcaacuccgccucccucgccaucuccggccuccgccucgacgacgaggccuacuacuucugcgccaccuacgacuccggcugguccauccgccucuucggcggcggcacccgccucaccguccucucccagcccaaggccgcccccuccgucacccucuucccccccuccuccgaggagcuc

SEQ ID NO: 19679 - RNA, 387 nt, Artificial Sequence
  derived and/or modified sequence opt2 from anti-HIV_Chain
caguccguccucacccagccccccuccgccuccggcgcccccggccagcgcgucaccaucuccugcuccggcggccccuccaacgucggcggcaacuacgucuacugguaccgccaguuccccggcaccgcccccaaccuccucauccuccgcgacgaccagcgccccuccggcguccccgaccgcuucuccgccuccaaguccggcaacuccgccucccucgccaucuccggccuccgccccgacgacgaggccuucuacuucugcgccaccuacgacuccgacggcuccguccgccucuucggcggcggcaccacccucaccguccucucccagcccaaggccgcccccuccgucacccucuucccccccuccaacggcggccgc

SEQ ID NO: 19680 - RNA, 387 nt, Artificial Sequence
  derived and/or modified sequence opt2 from anti-HIV_Chain
cagggccagcucguccaguccggcggcggcgucaagaagcccggcaccuccgucaccaucuccugccucgccuccgaguacaccuucaacgaguucgucauccacuggauccgccaggcccccggccagggcccccucuggcucggccucaucaagcgcuccggccgccucaugaccuccuacaaguuccaggaccgccucaaccuccgccgcgaccgcuccaccggcaccgucuucauggagcuccgcggccuccgccccgacgacaccgccgucuacuacugcgcccgcgacggccucggcgaggucgcccccgacuaccgcuacggcaucgacgucuggggccagggcuccaccgucaucgucaccgccgccuccaccaagggc

SEQ ID NO: 19681 - RNA, 387 nt, Artificial Sequence
  derived and/or modified sequence opt2 from anti-HIV_Chain
gagguccagcucgucgaguccggcgccgaggucaagaagcccggcgccuccgucaaggucgccugcaaggucuccggcaagaagcucuccgaccucuccauccacuggguccgccaggcccccggcaagggccucgaguggaugggcggcuucgacgaggaggacggcaagaucuccuacgagcgcaaguuccagggccgcgucaccaugaccgaggacaccgcccgcgacaccgccuucauggagauguccucccuccgcuccgacgacaccgccgucuacuucugcgccgccgccccccgccucgaccucggcgagcucuccuccggcuuccacuucuggggccucggcacccucgucuccgucuccuccgccuccaccaagggc

SEQ ID NO: 19682 - RNA, 387 nt, Artificial Sequence
  derived and/or modified sequence opt2 from anti-HIV_Chain
cagggccagcucguccaguccggcggcggcggcaagaagcucggcaccuccgucaccaucuccugccucgccuccgaguacaccuucaacgaguucgucauccacuggauccgccaggcccccggccagggcccccucuggcucggccucaucaagcgcuccggccgccucaugaccuccuaccaguuccaggaccgccucucccuccgccgcgaccgcuccaccggcaccgucuucauggagcuccgcggccuccgcgucgacgacaccgccgucuacuacugcgcccgcgacggccucggcgaggucgcccccgccuaccucuacggcaucgacgccuggggccagggcaccaccgucaucgucuccuccgccuccaccaagggc

SEQ ID NO: 19683 - RNA, 387 nt, Artificial Sequence
  derived and/or modified sequence opt2 from anti-HIV_Chain
gagguccagcucgucgaguccggcgccgaggucaagaagcccggcgccuccgucaaggucuccugcaaggucuccggcuacacccucuccgaccucuccaugcacuggguccgccaggcccccggcaagggccucgaguggaugggcggcuucgacgaggaggacggcgagaucaccuacgcccagaaguuccagggccgcgucuccaugaccgaggacaccucccgcgacaccgccuacauggagcucuccucccuccgcuccgaggacaccgccgucuacuacugcgccaccgccccccgccucgagcucggcgagcucuccuccggcuuccacuacuggggccucggcacccucgucaccgucuccuccgccuccaccaagggc

SEQ ID NO: 19684 - RNA, 387 nt, Artificial Sequence
  derived and/or modified sequence opt2 from anti-HIV_Chain
cagggccagcucguccaguccggcggcggcgucaagaagaccggcaccuccgucaccaucuccugccucgccuccgaguacaccuucaccgaguucaccauccacuggauccgccaggcccccggccagggcccccucuggcucggccucaucaagcgcuccggccgccucaugaccgccaaccgcuuccaggaccgccucucccuccgccgcgaccgcuccaccggcaccgucuucauggagcuccgcucccuccgcaucgacgacaccgccgucuacuacugcgcccgcgacggccucggcgagcucgcccccgccuaccacuacggcaucgacgucuggggccagggcaccaccaucaucgucaccuccgccuccaccaagggc

SEQ ID NO: 19685 - RNA, 387 nt, Artificial Sequence
  derived and/or modified sequence opt2 from anti-HIV_Chain
cagggccagcucguccaguccggcggcggcgucaagaagcucggcaccuccgucaccaucuccugccucgccuccgaguacaccuucaacgaguucgucauccacuggauccgccaggcccccggccagggcccccucuggcucggccucaucaagcgcuccggccgccucaugaccuccuaccaguuccaggaccgccucucccuccgccgcgaccgcuccaccggcaccgucuucauggagcuccgcggccuccgcgucgacgacaccgccgucuacuacugcgcccgcgacggccucggcgaggucgcccccgccuaccucuacggcaucgacgccuggggccagggcaccaccgucaucgucaccuccgccuccaccaagggc

SEQ ID NO: 19686 - RNA, 387 nt, Artificial Sequence
  derived and/or modified sequence opt2 from anti-HIV_Chain
cagggccagcucguccaguccggcggcggcgucaagaagcucggcaccuccgucaccauccccugccucgccuccgaguacaccuucaacgaguucgucauccacuggauccgccaggcccccggccagggcccccucuggcucggccucaucaagcgcuccggccgccucaugaccuccuaccaguuccaggaccgccucucccuccgccgcgaccgcuccaccggcaccgucuucauggagcuccgcggccuccgcgucgacgacaccgccgucuacuacugcgcccgcgacggccucggcgaggucgcccccgccuaccucuacggcaucgacgccuggggccagggcaccaccgucaucgucaccuccgccuccaccaagggc

SEQ ID NO: 19687 - RNA, 387 nt, Artificial Sequence
  derived and/or modified sequence opt2 from anti-HIV_Chain
cagggccagcucguccaguccggcggcggcgucaagaagcccggcaccuccgucaccaucuccugccucgccuccgaguacaccuucaacgaguucgucauccacuggauccgccaggcccccggccagggccccgucuggcucggccucaucaagcgcuccggccgccucaugaccuccuacaaguuccaggaccgccucucccuccgccgcgaccgcuccaccggcaccgucuucauggagcuccgcggccuccgccucgacgacaccgccgucuacuacugcgcccgcgacggccucggcgaggucgcccccgccuaccucuacggcaucgacgccuggggccagggcuccaaggucaucgucacccccgccuccaccaagggc

SEQ ID NO: 19688 - RNA, 387 nt, Artificial Sequence
  derived and/or modified sequence opt2 from anti-HIV_Chain
caggcccgccucgaccaguggggcaccggccuccucaagcccuccgagacccucucccucaagugcgccgucuucggcguccucuucaccgacuacaacuggaccuggguccgccagucccccggcaaggagcucgaguggaucggccaccucgaccaccgcggcggcggcaacuacaaccccucccucgagucccgcgucaccaucucccucgacuacuccaaggcccaguucucccuccaccucaaguccgucaccgucgccgacaccgcccgcuacuacugcgccggcgccgucaagggcuucugguucgacgaccccuacaccugguucggccccuggucccagggcacccucgucaccgucgccuccgccuccaccaagggc

SEQ ID NO: 19689 - RNA, 387 nt, Artificial Sequence
  derived and/or modified sequence opt2 from anti-HIV_Chain
caggcccgccucgaccaguggggcaccggccuccucaagcccuccgagacccucucccucaagugcgccgucuucggcguccucuucaccgacuacaacuggaccuggguccgccagucccccggcaagggccucgaguggaucggccaccucgaccaccgcggcggcggcuccuacaaccccucccucgagucccgcgucuccaucucccucgacuacuccaaggcccaguucucccuccaccucaaguccgucaccgucgccgacaccgcccucuacuacugcgccggcgccgucaagggcuucugguucgacgagcccuccaccugguucggccccuggucccagggcaccauggucaccgucgccuccgccuccaccaagggc

SEQ ID NO: 19690 - RNA, 387 nt, Artificial Sequence
  derived and/or modified sequence opt2 from anti-HIV_Chain
cagggccaccucguccaguccggcggcggcgucaagaagcucggcaccuccgucaccaucuccugccucgccuccgaggacaccuucaacgaguucgucauccacuggauccgccaggcccccggccagggcccccucuggcucggccucaucaagcgcuccggccgccucaugaccuccuaccaguuccaggaccgccucucccuccgccgcgaccgcuccaccggcaccgucuucauggagcuccgcggccuccgcgucgacgacaccgccgucuacuacugcgcccgcgacggccucggcgaggucgcccccgccuaccucuacggcaucgacgccuggggccagggcaccaccgucaucgucaccuccgccuccaccaagggc

SEQ ID NO: 19691 - RNA, 387 nt, Artificial Sequence
  derived and/or modified sequence opt2 from anti-HIV_Chain
cagguccagcucguccaguccgaggccgaggucaagaagcccggcuccuccgucaaggucuccugcaaggccuccggcggcaccuuccgcggcuacaccaucuccuggguccgccaggcccccggccagggccucgaguggaugggccgcaucauccccauccucggcaaggccaucuacgcccccuccuuccagggccgcgucacccucaccgccgacaaguccaccggcaccgccuacauggagcucucccgccuccgcuccgacgacaccgccgucuacuacugcgccaaggucaagaugcgcggcuccuccggcuacuacuaccucuucgacgacuggggccagggcacccucgucaccgucuccuccgccuccaccaagggc

SEQ ID NO: 19692 - RNA, 387 nt, Artificial Sequence
  derived and/or modified sequence opt2 from anti-HIV_Chain
caggcccgccucgaccaguggggcaccggccuccucaagcccuccgagacccucucccucaagugcgccgucuucggcguccucuucaccgacuacaacuggaccuggguccgccagucccccggcaagggccucgaguggaucggccaccucgaccaccgcggcggcggcaacuacaaccccucccucgagucccgcgucaccaucucccucgacuacuccaaggcccaguucucccuccaccucaaguccgucaccgucgccgacaccgcccucuacuacugcgccggcgccgucaagggcuucugguucgacgaggucuacaacugguucggccccuggucccagggcacccucgucaccgucgccuccgccuccaccaagggc

SEQ ID NO: 19693 - RNA, 387 nt, Artificial Sequence
  derived and/or modified sequence opt2 from anti-HIV_Chain
cagggccagcucguccaguccggcggcggcgucaagaagcccggcaccuccgucaccaucuccugccucgccuccgaguacaccuucaccgaguucaccauccacuggauccgccaggcccccggccagggcccccucuggcucggccucaucaagcgcuccggccgccucaugaccgccuaccgcuuccaggaccgccucucccuccgccgcgaccgcuccaccggcaccgucuucauggagcuccgcaaccuccgcauggacgacaccgccgucuacuacugcgcccgcgacggccucggcgagcucgcccccgccuaccaguacggcaucgacgucuggggccagggcaccaccgucaucgucuccuccgccuccaccaagggc

SEQ ID NO: 19694 - RNA, 387 nt, Artificial Sequence
  derived and/or modified sequence opt2 from anti-HIV_Chain
cagguccgccucguccaguccggcccccaggucaagcgccccggcgccuccauccgccucuccugcgaguccuccggcuaccgcuuccaggacuacaucgucgccuggauccgccagacccgcggccagggcuucgaguucgucggcauggucaacccccgcggcggccgccccuggcccuccucccgcuuccgcgaccgcgucacccucacccgcgacaucgaguccgagaccuucuaccucggccucaacgaccucaccuccgacgacaccgccaccuacuucugcgcccgccucgaggccgacggcuccgacuacucccccaagauguucgacuucuggggccagggcaccaagaucgucgucucccccgccuccaccaagggc

SEQ ID NO: 19695 - RNA, 387 nt, Artificial Sequence
  derived and/or modified sequence opt2 from anti-HIV_Chain
cagguccgccucguccaguccggcccccaggucaagacccccggcgccuccaugcgcgucuccugcgaggccuccggcuaccgcuuccucgacuacaucaucgucuggauccgccagacccacggccagcacuucgaguacgucggcaugaucaacccccgcggcggcacccccuggcccuccuccaaguuccgcgaccgccucucccucacccgcgacauccacaccgacaccuucuaccucggccucaacaaccucggcuccgacgacaccgccaucuacuucugcgcccgccucgaggccgacggcgacgacuacucccccaagauguucgaccacuggggccagggcacccgcaucaucgucuccgccgccuccaccaagggc

SEQ ID NO: 19696 - RNA, 387 nt, Artificial Sequence
  derived and/or modified sequence opt2 from anti-HIV_Chain
cagguccgccucguccaguccggcccccaggucaagacccccggcgccuccauccgccucuccugcgaggccuccggcuaccgcuuccucgacuacuucaucgucuggguccgccagacccccggccagggcuucgaguacgucggcaugaucaacccccgcggcggccgccccugguccuccuggaaguuccgcgaccgccucucccucacccgcgagaucgacaccgacaccuucuaccucggccucuccaaccuccgcuccgacgacaccgccaucuacuucugcgcccgccucgaggccgacggcgacgacuacucccccaagauggucgacuacuggggccagggcaccaagaucaucgucuccgccgccuccaccaagggc

SEQ ID NO: 19697 - RNA, 387 nt, Artificial Sequence
  derived and/or modified sequence opt2 from anti-HIV_Chain
cagguccgccucguccaguccggcccccaggucaagcgccccggcgccuccauccgccucuccugcgagaccuccggcuaccgcuuccaggacuacaucgucgccuggauccgccagacccgcggccagcgcuucgaguucgucggcauggucaacccccgcggcggccgccccuggcccuccuccaaguuccgcgaccgcgucacccucacccgcgacaucgaguccgagaccuuccaccucggccucaacgaccucaccuccgacgacaccgccaccuacuucugcgcccgccucgaggccgacggcgccgacuacucccccaagauguucgacuucuggggccagggcaccaagaucgucgucucccccgccuccaccaagggc

SEQ ID NO: 19698 - RNA, 387 nt, Artificial Sequence
  derived and/or modified sequence opt2 from anti-HIV_Chain
cagguccgccucguccaguccggcccccaggucaagacccccggcgccuccaugcgcaucuccugcgaggccuccggcuaccgcuuccaggacuacaucaucgucuggauccgccagacccacggccagggcuucgaguacgucggcaugaucaacccccgcggcggcacccccugguccuccuccaaguuccgcgaccgccucucccucacccgcgacaucuacaccgacaccuucuaccucggccucaacaaccucggcuccgacgacaccgccaucuacuucugcgcccgccucgaggccgacggcggcgacuacucccccaagauguucgacuacuggggccagggcacccgcaucaucgucuccgccgccuccaccaagggc

SEQ ID NO: 19699 - RNA, 387 nt, Artificial Sequence
  derived and/or modified sequence opt2 from anti-HIV_Chain
cagggccagcucguccaguccggcggcggcgucaagaagcccggcgccuccgucaccaucuccugccucgccuccgaguacaccuucaacgaguucgucauccacuggauccgccaggcccccggccagggcccccucuggcucggccucaucaagcgcuccggccgccucaugaccgccuacaaguuccaggaccgccucucccuccgccgcgaccgcuccaccggcaccgucuucauggagcuccgcggccuccgccccgaggacaccgccgucuacuacugcgcccgcgacggccucggcgaggucgcccccgacuaccgcuacggcaucgacgucuggggccagggcuccaccgucaucgucuccgccgccuccaccaagggc

SEQ ID NO: 19700 - RNA, 387 nt, Artificial Sequence
  derived and/or modified sequence opt2 from anti-HIV_Chain
cagguccgccucguccaguccggcccccagaugaagacccccggcgccucccuccgccucuccugcgaggucuccggcuaccgcuuccucgacuacuucaucgucuggguccgccagaccggcggccagggcuucgaguacgucggcaugaucaacccccgcggcggccgccccugguccuccuggaaguuccgcgaccgccucucccucacccgcgacaucgagaccgacaccuucuaccucggccucaacaaccuccgcuccgacgacaccgccaucuacuucugcgcccgccucgaggccgacggcgacaacuacucccccaagauggucgacuacuggggccagggcaccaagaucaucgucucccccgccuccaccaagggc

SEQ ID NO: 19701 - RNA, 387 nt, Artificial Sequence
  derived and/or modified sequence opt2 from anti-HIV_Chain
caggucucccucguccaguccggcccccaggucaagacccccggcgccuccaugcgcgucuccugcgagaccuccggcuaccgcuuccucgacuacaucaucgucuggauccgccagacccacggccagcacuucgaguacgucggcaugaucaacccccgcggcggcacccccuggcccuccuccaaguuccgcgaccgccucaccaugacccgcgacauccacaccgacaccuucuaccucggccucaacaaccuccgcuccgacgacaccgccaucuacuucugcgcccgccucgaggccgacggcgacgacuacucccccaagauguucgacuacuggggccagggcacccgcaucaucgucuccgccgccuccaccaagggc

SEQ ID NO: 19702 - RNA, 387 nt, Artificial Sequence
  derived and/or modified sequence opt2 from anti-HIV_Chain
cagguccgccucguccaguccggcccccaggucaagaccgccggcgccuccaugcgcgucuccugcgaggccuccggcuaccgcuuccucgacuacaucaucgucuggauccgccagacccacggccagcacuucgaguacgucggcaugaucaacccccgcggcggcacccccuggcccuccuccaaguuccgcgaccgccucacccucacccgcgacaucuacaccgacaccuucuaccucggccucaacaaccucggcuccggcgacaccgccaucuacuucugcgcccgccucgaggccgacggcgacgacuacucccccaagauguucgacuacuggggccagggcacccgcaucaucgucuccgccgccuccaccaagggc

SEQ ID NO: 19703 - RNA, 387 nt, Artificial Sequence
  derived and/or modified sequence opt2 from anti-HIV_Chain
cagggccagcucguccaguccggcggcggcgucaagaagcccggcaccuccgucaccaucuccugccucgccuccgaguacaccuucaacgaguucgucauccacuggauccgccaggcccccggccagggccccgucuggcucggccucaucaagcgcuccggccgccucaugaccuccuacaaguuccaggaccgccucucccuccgccgcgaccgcuccaccggcaccgucuucauggagcuccgcggccuccgccucgacgacaccgccgucuacuacugcgcccgcgacggccucggcgaggucgcccccgccuaccucuacggcaucgacgccuggggccagggcuccaccgucaucgucaccuccgccuccaccaagggc

SEQ ID NO: 19704 - RNA, 387 nt, Artificial Sequence
  derived and/or modified sequence opt2 from anti-HIV_Chain
cagggccagcucguccaguccggcggcggccucaagaagcccggcaccuccgucaccaucuccugccucgccuccgaguacaccuucaacgaguucgucauccacuggauccgccaggcccccggccagggcccccucuggcucggccucaucaagcgcuccggccgccucaugaccgccuacaacuuccaggaccgccuccgccuccgccgcgaccgcuccaccggcaccgucuucauggagcuccgcggccuccgccccgacgacaccgccgucuacuacugcgcccgcgacggccucggcgaggucgcccccgacuaccgcuacggcaucgacgucuggggccagggcuccaccgucaucgucaccgccgccuccaccaagggc

SEQ ID NO: 19705 - RNA, 387 nt, Artificial Sequence
  derived and/or modified sequence opt2 from anti-HIV_Chain
cagggccaccucguccaguccggcggcggcgucaagaagcucggcaccuccgucaccaucuccugccucgucuccgaguacaccuucaacgaguucgucauccacuggauccgccaggcccccggccagggcccccucuggcucggccucaucaagcgcuccggccgccucaugaccuccuaccaguuccaggaccgccucucccuccgccgcgaccgcuccaccggcaccgucuucauggagcuccgcggccuccgcgucgacgacaccgccgucuacuacugcgcccgcgacggccucggcgaggucgcccccgccuaccucuacggcaucgacgccuggggccagggcaccaccgucaucgucaccuccgccuccaccaagggc

SEQ ID NO: 19706 - RNA, 387 nt, Artificial Sequence
  derived and/or modified sequence opt2 from anti-HIV_Chain
cagggccagcucguccaguccggcggcggcgucaagaagcucggcaccuccgucaccaucuccugccucgccuccgaguacaccuucaacgaguucgucauccacuggauccgccaggcccccggccagggcccccucuggcucggccucaucaagcgcuccggccgccucaugaccuccuaccaguuccaggaccgccucucccuccgccgcgaccgcuccaccggcaccgucuucauggagcuccgcggccuccgcgucgacgacaccgccgucuacuacugcgcccgcgacggccucggcgaggucgcccccgccuaccucuacggcaucgacgccuggggccagggcaccaccgucaucgucuccuccgccuccaccaagggc

SEQ ID NO: 19707 - RNA, 387 nt, Artificial Sequence
  derived and/or modified sequence opt2 from anti-HIV_Chain
cagggccaccucguccaguccggcggcggcgucaagaagcucggcaccuccgucaccaucuccugccucgccuccgaguacaccuucaacgaguucgucauccacuggauccgccaggcccccggccagggcccccucuggcucggccucaucaagcgcuccggccgccucaugaccuccuaccaguuccaggaccgccucucccuccgccgcgaccgcuccaccggcaccgucuucauggagcuccgcggccuccgcgucgacgacaccgccgucuacuacugcgcccgcgacggccucggcgaggucgcccccgccuaccucuacggcaucgacgccuggggccagggcaccaccgucaucgucaccuccgccuccaccaagggc

SEQ ID NO: 19708 - RNA, 387 nt, Artificial Sequence
  derived and/or modified sequence opt2 from anti-HIV_Chain
cagguccagcucguccaguccggcuccgagcucaagaagcccggcgccuccgucaaggucuccugcaaggccuccggcuacaccuucaccuccuacgccaucaacuggguccgccaggcccccggccagggccucgaguggaugggcuggaucaacaccaacaccggcaaccccaccuacgcccagggcuucaccggccgcuucgucuucucccucgagaccuccgucuccaccgccuaccuccagaucaacucccucaaggccgaggacaccgccgucuacuacugcgcccgcgaccuccucgagucccgcaccuacuacaacgacauccgcgacugcuggggccagggcacccucgucaccgucuccuccgccuccaccaagggc

SEQ ID NO: 19709 - RNA, 387 nt, Artificial Sequence
  derived and/or modified sequence opt2 from anti-HIV_Chain
cagguccagcucguccaguccggcgccgaggucaagaagcccggcgccuccgucaaggucuccugcaaggccuccggcuacaccuucaccgacuacuacauccacuggguccgccaggcccccggccagggccucgaguggaugggcuggaucaaccccuccaccggcggcaccaacuucguccagaaguuccucggccgcgucaccaugaccuccgacaccuccaucaacaccgccuacauggagcuccgccgccucaagaacgacgacgccgccaucuacuacugcgccaccuacuccacccgccaguucuuccacuacuacuacgucaccgacgucuggggccagggcaccaccgucaccgucuccuccgccuccaccaagggc

SEQ ID NO: 19710 - RNA, 387 nt, Artificial Sequence
  derived and/or modified sequence opt2 from anti-HIV_Chain
uuccagggccagcucguccaguccggcggcggcgucaagaagcccggcuccuccgucaccaucuccugccucgccuccgaguacaccuucaccgaguucaccauccacuggauccgccaggcccccggccagggcccccucuggcucggccucaucaagcgcuccggccgccucaugaccuccuacggcuuccaggaccgccucuccguccgccgcgaccgcuccaccggcaccgucuucauggagcuccgcucccuccgcaccgacgacaccgccgucuacuacugcgcccgcgacggccucggcgagcucgcccccgccuaccacuacggcaucgacgucuggggccagggcaccaccgucaucgucaccuccgccuccaccucc

SEQ ID NO: 19711 - RNA, 387 nt, Artificial Sequence
  derived and/or modified sequence opt2 from anti-HIV_Chain
cagguccagcucgucgaguccggcggcggcgucguccagcccggccgcucccuccgccucuccugcgccgccuccggcuucaccuucuccuccuacgccaugcacuggguccgccaggcccccggcaagggccucgagugggucgccgucaucuccuacgacggcuccaacaaguacuacgccgacuccgucaagggccgcuucaccaucucccgcgacgacuccaaguccaccgucuaccuccagaucaacucccuccgcgccgccgacaccgccgucuacuucugcgcccgcgagggcggccuccgcuuccucgaguggcucuucuggggccagggcacccucgucaccgucuccuccggcgaguccuccgccuccaccaagggc

SEQ ID NO: 19712 - RNA, 390 nt, Artificial Sequence
  derived and/or modified sequence opt2 from anti-HIV_Chain
cagguccagcucguccaguccggcgccgucgucaagucccccggcuccuccgccaagcucuccugccgccuccucggcgacgaguucggcaccuacuucaucuccuggauccgccaggcccccggccgcggccucgagugggucggcggcaucgucccccacucccagcuccaguccuccgcccagaaguuccacggccgcuucuucaucaccggcggcgucaccccccccaucaucuuccuccagcucaccaacgucaccuucgaggacaccggcaccuacuucugcgcccgcgagcgcggccgccaccgcgaccccaagaccggcaagucccuccgcggccgcuacuucgacuucuggggccgcggcaccggcgucaccgucuccccc

SEQ ID NO: 19713 - RNA, 390 nt, Artificial Sequence
  derived and/or modified sequence opt2 from anti-HIV_Chain
cagaucgagcuccgccaguccggcgccgccaugaagucccccggcuccuccgucaagcucuccugcaccguccucggcgagaacuucggcaccuacuucaucuccuggauccgccaggcccccggccagggccucgagugggucggcggcaucgucccccacucccagcuccaguccuccgcccagaaguuccacggccgcaucaagaucuccggcggcggcaccccccccgucgucucccucgagcucaccaacgucaccuucgacgacaccggcaccuacuucugcgcccgcgagcgcggccgccacgucgagcccaagaccggcgaccgccucgccggccgcuacuucgacaucuggggccgcggcaccggccuccgcgucuccccc

SEQ ID NO: 19714 - RNA, 390 nt, Artificial Sequence
  derived and/or modified sequence opt2 from anti-HIV_Chain
gagguccagcucgucgaguccggcggcggccucgucaagcccggcggcucccuccgccucuccugcgaggccuccggcuucaccuucaccaacgccuggaugaacuggguccgccaggcccccggcaagggccucgagugggucggccgcaucaagucccagacccacggcggcaccacccgcuacgccgcccccgucaagggccgcuucaccaucucccgcgacgacuccaagcacacccucuaccuccagauggaccgccucaccaccgaggacaccgccgucuacuacugcaccggcaccaucaccggcuccaccuucuacuacuacggcauggacgucuggggccagggcaccaccgucaccgucucccccgccuccaccaagggc

SEQ ID NO: 19715 - RNA, 390 nt, Artificial Sequence
  derived and/or modified sequence opt2 from anti-HIV_Chain
gucguccagcucguccaguccggccccggccucgucaagcccucccagacccucucccucaccugcaccgucuccggcggcuccaucuccuccggcgacuucuacugguccuggauccgccagccccccggcaagggccucgaguggaucggcuacaucuacuacuccggcuccaccuacuacaaccccucccucaagucccgccucaccaucuccgucgacaccuccaagaaccaguucucccuccgccucuccuccgucaccgccgccgacaccgccgucuacuacugcgcccgcgaccucaacucccgcaucgucggcgcccucgacgccuucgacaucuggggccagggcaccauggucaccgucuccuccgccuccaccaagggc

SEQ ID NO: 19716 - RNA, 390 nt, Artificial Sequence
  derived and/or modified sequence opt2 from anti-HIV_Chain
gagguccagcucguccaguccggcggcggccucguccagcccggccgcucccuccgccucuccugcgccgccuccggcuucaccuucgacgacuacgccaugcacuggguccgccaggcccccggcaagggccucgagugggucuccggcaucuccuggaacuccggcaccaucggcuacgccgacuccguccgcggccgcuucaccaucucccgcgacgacgccaaguccucccucuaccuccagaugaacucccuccgcaccgaggacaccgcccucuacuacugcgccaaggacggcugggucggcuccggcuccuccacccuccgcggcuccgacuacuggggccagggcacccucgucaccgucuccuccgccuccaccaagggc

SEQ ID NO: 19717 - RNA, 390 nt, Artificial Sequence
  derived and/or modified sequence opt2 from anti-HIV_Chain
caguccguccucacccagccccccuccgccuccggcucccccggccaguccaucaccaucuccugcaccggcaccuccuccgacgucggcggcuacaacuacgucuccugguaccagcagccccccggcaaggcccccaaggucaucaucuacgaggucuccaagcgccccuccggcguccccgaccgcuucuccggcuccaaguccggcaacaccgccucccucaccgucuccggccuccaggccgaggacgaggccgacuacuacugcuccuccuacgccggcuccaacaacuucgucuucggcaccggcaccgaggucaccgucgucggccagcccaaggccaaccccaccgucacccucuucccccccuccuccgaggagcuccuc

SEQ ID NO: 19718 - RNA, 390 nt, Artificial Sequence
  derived and/or modified sequence opt2 from anti-HIV_Chain
caggccgucgucacccaggagcccucccucaccgucucccccggcggcaccgucacccucaccugcgccuccuccaccggcgccgucaccuccggcuucuacccccacugguuccagcagaagcccggccaggccccccgcgcccucaucuacuccaccuccaaccgcuacuccuggacccccgcccgcuucuccggcucccuccucggcggcaaggccgcccucacccucuccggcguccagcccgaggacgaggccgaguacuacugccuccuccuccccuacuacggcggccccuggaucuucggcggcggcaccaagcucaccguccucggccagcccaaggccgcccccuccgucacccucuucccccccuccuccgaggagcuc

SEQ ID NO: 19719 - RNA, 390 nt, Artificial Sequence
  derived and/or modified sequence opt2 from anti-HIV_Chain
caguccgcccucacccagccccccuccgccuccggcgcccccggccagcgcgucaccaucuccugcuccggcggccccuccaacgucggcggcaacuacgucuacugguaccgccaguuccccggcaccgcccccacccuccucauccuccgcgacgaccagcgccccuccggcguccccgaccgcuucuccgccuccaaguccggcaacuccgccucccucgccaucuccggccuccgccccgacgacgagggcuucuacuucugcgccaccuacgacuccgacggcuccauccgccucuucggcggcggcaccgcccucaccguccucucccagcccaaggccgcccccuccgucacccucuucccccccuccuccgaggagcucaag

SEQ ID NO: 19720 - RNA, 390 nt, Artificial Sequence
  derived and/or modified sequence opt2 from anti-HIV_Chain
cagguccagcucgucgaguccggcuccgacguccgcaagcccggcgccaccgucaccgucuccugcaaggccgacgaggacgaggacgacuucaccgccuacaacuacuucaugcacuggguccgccaggcccccggccacggccucgaguggaucggcuggaucaacccccgcaccggccagcccaaccacgccaagcaguuccagggccgcgucacccucacccgcgagcgcuccaccuccaccgucuucaugaagcucaccaaccuccgccucgacgacaccgccgucuacuucugcgcccgcccccuccgcggcggcgacaccuggcacuaccacuccuggggccgcggcaccucccucaccgucuccuccgccuccaccaagggc

SEQ ID NO: 19721 - RNA, 390 nt, Artificial Sequence
  derived and/or modified sequence opt2 from anti-HIV_Chain
gagguccagcucgucgaguccggcuccgacguccgcaagcccggcgccaccgucaccgucuccugcaaggccgacgaggacgaggacgacuucaccgccuacaacuacuucaugcacuggguccgccaggcccccggccacggccucgaguggaucggcuggaucaacccccgcaccggccagcccaaccacgccaagcaguuccagggccgcgucacccucacccgcgagcgcuccaccuccaccgucuucaugaagcucaccaaccuccgccucgacgacaccgccgucuacuucugcgcccgcccccuccgcggcggcgacaccuggcacuaccacuccuggggccgcggcaccucccucaccgucuccuccgccuccaccaagggc

SEQ ID NO: 19722 - RNA, 390 nt, Artificial Sequence
  derived and/or modified sequence opt2 from anti-HIV_Chain
gagguccagcucguccaguccggcuccgacguccgcaagcccggcgccaccgucaccgucuccugcaaggccgacgaggacgaggacgacuucaccgccuacgacuacuucaugcacuggguccgccaggcccccggccacggccucgaguggaucggcuggaucaacccccgcaccggccagcccaaccacgccaagcaguuccagggccgcgucacccucacccgcgagcgcuccaccuccaccgucuucaugaagcucaccaaccuccgccucgacgacaccgccgucuacuucugcgcccgcccccuccgcggcggcgacaccuggcacuaccacuccuggggccgcggcaccucccucaccgucuccuccgccuccaccaagggc

SEQ ID NO: 19723 - RNA, 390 nt, Artificial Sequence
  derived and/or modified sequence opt2 from anti-HIV_Chain
cagguccagcucguccaguccggcuccgacguccgcaagcccggcgccaccgucaccgucuccugcaaggccgacgaggacgaggacgacuucaccgccuacaacuacuucaugcacuggguccgccaggcccccggccacggccucgaguggaucggcuggaucaacccccgcaccggccagcccaaccacgccaagcaguuccagggccgcgucacccucacccgcgagcgcuccaccuccaccgucuucaugaagcucaccaaccuccgccucgacgacaccgccgucuacuucugcgcccgcccccuccgcggcggcgacaccuggcacuaccacuccuggggccgcggcaccucccucaccgucuccuccgccuccaccaagggc

SEQ ID NO: 19724 - RNA, 390 nt, Artificial Sequence
  derived and/or modified sequence opt2 from anti-HIV_Chain
cagguccagcucguccaguccggcuccgacguccgcaagcccggcgccaccgucaccgucuccugcaaggccgacgaggacgaggacgacuucaccgccuacaacuacuucaugcacuggguccgccaggcccccggccacggccucgaguggaucggcuggaucaacccccgcaccggccagcccaaccacgccaagcaguuccagggccgcgucacccucacccgcgagcgcuccaccuccaccgucuucaugaagcucaccaaccuccgccucgacgacaccgccgucuacuucugcgcccgcccccuccgcggcggcgacaccuggcacuaccacucccgcggccgcggcaccucccucaccgucuccuccgccuccaccaagggc

SEQ ID NO: 19725 - RNA, 390 nt, Artificial Sequence
  derived and/or modified sequence opt2 from anti-HIV_Chain
gagguccagcucgucgaguccggcuccgacguccgcaagcccggcgccaccgucaccgucuccugcaaggccgacgaggacgaggacgacuucaccgccuacaacuacuucaugcacuggguccgccaggcccccggccagggccucgaguggaucggcuggaucaacccccgcaccggccagcccaaccacgccaagcaguuccagggccgcgucacccucacccgcgagcgcuccaccuccaccgucuucaugaagcucaccaaccuccgccucgacgacaccgccgucuacuucugcgcccgcccccuccgcggcggcgacaccuggcacuaccacuccuggggccgcggcaccucccucaccgucuccuccgccuccaccaagggc

SEQ ID NO: 19726 - RNA, 390 nt, Artificial Sequence
  derived and/or modified sequence opt2 from anti-HIV_Chain
gucguccagcucguccaguccggcuccgacguccgcaagcccggcgccaccgucaccgucuccugcaaggccgacgaggacgaggacgacuucaccgccuacaacuacuucaugcacuggguccgccaggcccccggccacggccucgaguggaucggcuggaucaacccccgcaccggccagcccaaccacgccaagcaguuccagggccgcgucacccucacccgcgagcgcuccaccuccaccgucuucaugaagcucaccaaccuccgccucgacgacaccgccgucuacuucugcgcccgcccccuccgcggcggcgacaccuggcacuaccacuccuggggccgcggcaccucccucaccgucuccuccgccuccaccaagggc

SEQ ID NO: 19727 - RNA, 390 nt, Artificial Sequence
  derived and/or modified sequence opt2 from anti-HIV_Chain
gagguccagcucguccaguccggcuccgacguccgcaagcccggcgccaccgucaccgucuccugcaaggccgacgaggacgaggacgacuucaccgccuacaacuacuucaugcacuggguccgccaggcccccggccacggccucgaguggaucggcuggaucaacccccgcaccggccagcccaaccacgccaagcaguuccagggccgcgucacccucacccgcgagcgcuccaccuccaccgucuucaugaagcucaccaaccuccgccucgacgacaccgccgucuacuucugcgcccgcccccuccgcggcggcgacaccuggcacuaccacuccuggggccgcggcaccucccucaccgucuccuccgccuccaccaagggc

SEQ ID NO: 19728 - RNA, 390 nt, Artificial Sequence
  derived and/or modified sequence opt2 from anti-HIV_Chain
gagguccagcucguccaguccggcuccgacgucaagaagcccggcaccaccgucaccaucuccugcaaggccgacgaggacgaggacgacuucaccgccuacaacuacuucaugcacuggguccgccaggcccccggccagggccucgaguggaucggcuggaucaacccccgcaccggccagcccaaccacgccaagcagcuccagggccgcgucacccucacccgcgagcgcuccaccuccaccgucuucaugaagcucaccaaccuccgccucgacgacaccgccgucuacuucugcgcccgcccccuccgcggcggcgacaccuggcacuaccacuccuggggccgcggcaccucccucaucgucuccuccgccuccaccaagggc

SEQ ID NO: 19729 - RNA, 390 nt, Artificial Sequence
  derived and/or modified sequence opt2 from anti-HIV_Chain
cagguccagcucgucgaguccggcggcggccucgucaagcccggcggcucccuccgccucuccugcgccgccuccggcuucuccuucaacgaguacuacauguccuggauccgccaggcccccggccagggccucgagugggucgccaacaucggcuccuccgacgccuacaccaucuacgccgacuccgucaagggccgcuucaccaucucccgcgacaacgccgagaacaccgucuaccuccagaugaacucccuccgcggcgaggacaccgccgucuacuacugcgcccgcaucgagggcuacugcuccaacucccgcugcuccaacuacuucgaccccuggggccagggcgcccucgucaccgucuccuccgccuccaccaagggc

SEQ ID NO: 19730 - RNA, 390 nt, Artificial Sequence
  derived and/or modified sequence opt2 from anti-HIV_Chain
cagguccagcucguccaguccggcgccgaggucaagaagcccggcgccuccgucaaggucuccugcaaggucuccggcuacccccucgccgagcucuccguccacuggguccgccagguccccggcaagggccucgagugggucggcggcuucgaccccgaggagggcaagaccgucuacgcccagaaguuccagggccgcgucaccaugaccgaggaccgcuccaccgacaccgucuacauggagcucaucucccuccgcuacgaggacaccgccgucuacuacugcgccaccgacaaccccguccuccagcucggcgagcucuccuccucccucgacuacuggggccagggcacccucgucaccgucuccuccgccuccaccaagggc

SEQ ID NO: 19731 - RNA, 390 nt, Artificial Sequence
  derived and/or modified sequence opt2 from anti-HIV_Chain
gagguccagcucguccaguccggcgccgaggucaagaagcccggcgagucccuccgcaucuccugcaagaccuccggcuacaacuucaacgacgacuggaucgccuggguccgccagcgccccgacaagggccccgaguggaugggcaucuucuaccccggcgacucccaggccaccuacucccccuccuuccagggccacgucaccuucuccgccgacaccuccaucuccaccgccuaccuccaguggaccucccucaaggccuccgacaccgccaucuacuacugcgcccgcacccgcugcuucggcgccaacugcuucaacuucauggacgucuggggcaagggcaccgcccucaccgucaccgucuccuccgccuccaccaagggc

SEQ ID NO: 19732 - RNA, 390 nt, Artificial Sequence
  derived and/or modified sequence opt2 from anti-HIV_Chain
cagguccagcucguccagcuccuccaguccggcgccgaggucaagaagcccggcuccuccgucaaggucuccugccagaucuccggcuacggcuucuccaacuacgccaucuccuggguccgccaggcccccggccagggccucgaguggcucggccgcaucguccccgccgucggcaugaccgaguacgcccagaaguuccagggccgcgucaccuucaccgccgaccgcuccaccaucaccgccuacauggaccuccgcggccuccgcuccgacgacaccgccgucuacuacugcguccgcgacccccaggucgagguccgcggcaacgccuucgacaucuggggccagggcaccauggucaccgucuccuccgccuccaccaagggc

SEQ ID NO: 19733 - RNA, 390 nt, Artificial Sequence
  derived and/or modified sequence opt2 from anti-HIV_Chain
cagguccaccuccagcaguggggcgccggccuccucaagcccuccgagacccucucccucaccugcgccgucuccggcggcuccuucuccggcuucuucuggaccuggauccgccagucccccggcaagggccucgaguggaucggcgaggucaaccacuccggcuucacccacuccaaccccucccucgagucccgcgccaccaucuccgucgccgccuccaacacccaguucucccuccgccucgccuccgucaccgccgccgacaccgccaucuacuucugcgcccuccgcuacuucgacuggucccccuuccgccgcgacaccuacggcaccgacgucuggggccagggcaccaccgucaucgucuccuccgccuccaccaagggc

SEQ ID NO: 19734 - RNA, 390 nt, Artificial Sequence
  derived and/or modified sequence opt2 from anti-HIV_Chain
cagguccgccucgagcaguccggcggcgcccuccgcaagcccggcgccuccgucacccucuccugccaggccuccggcuacaacuucgucaaguacaucauccacuggguccgccagcgccccggccucggcuucgagugggucggcaugaucgaccccuaccgcggccgccccugguacgcccacuccuucgccggccgccucucccucucccgcgacaccuccaccgagacccucuacaugacccucuccucccucaaguccgacgacaccgccaccuacuucugcgcccgcgccgaggccgccuccgacucccacucccgccccaucauggacuggaccuggcgcauccucugccuccucgccgucguccccgccuccaccaagggc

SEQ ID NO: 19735 - RNA, 390 nt, Artificial Sequence
  derived and/or modified sequence opt2 from anti-HIV_Chain
cagguccgccucgagcaguccggcgccgccguccgcaagcccggcgccuccgucacccucuccugccaggccuccggcuacaacuucgucaacuacaucauccacuggguccgccagcgccccggccucgacuucgagugggucggcaugaucgaccccuaccgcggccgccccugguccgcccacaaguuccagggccgccucucccucucccgcgacgucuccaccgagauccucuacaugacccucaacucccuccgcuccgacgacaccgccaccuacuucugcgcccgcgccgaggccgagucccagucccacucccgccccaucauguucgacuccuggggccagggcucccgcgucaccgucuccuccgccuccaccaagggc

SEQ ID NO: 19736 - RNA, 390 nt, Artificial Sequence
  derived and/or modified sequence opt2 from anti-HIV_Chain
cagguccgccucgagcaguccggcgccgccgucaagaagcccggcgccuccgucaccaucuccugccaggccuccggcuacaacuucgucaaguucuucauccacuggguccgccagcgccccggccagggcuucgagugggucggcaugaucgagcccuaccgcggccgccccugguccgccggcaacuuccagggccgccucucccucucccgcgacgucuccaccgagacccucuacaugacccucaacaaccuccgcuccgacgacaccgccgucuacuucugcgcccgccucgaggccgaguccgacucccacucccgccccaucauguucgaccacuggggccacggcucccucgucaccgucuccuccgccuccaccaagggc

SEQ ID NO: 19737 - RNA, 390 nt, Artificial Sequence
  derived and/or modified sequence opt2 from anti-HIV_Chain
cagguccgccucgagcaguccggcgccgccguccgcaagcccggcgccuccgucacccucuccugccaggccuccggcuacaacuucgucaacuacaucauccacuggguccgccagcgccccggccucgacuucgagugggucggcaugaucgaccccuaccgcggccgccccugguccgcccacaaguucgagggccgccucucccucucccgcgacgucuccaccgagguccucuacaugacccucuccucccuccgcuccgacgacaccgccaccuacuucugcgcccgcgccgaggccgagucccagucccacucccgccccaucauguucgacuacuggggccagggcucccgcgucaccgucuccuccgccuccaccaagggc

SEQ ID NO: 19738 - RNA, 390 nt, Artificial Sequence
  derived and/or modified sequence opt2 from anti-HIV_Chain
cagguccgccucgagcaguccggcaccgccguccgcaagcccggcgccuccgucaccaucuccugccaggccuccggcuacaacuucgucaaguucuucauccacggcguccgccagcgccccggccagggcuucgagugggucggcaugaucgagcccuuccgcggccgccccugguccgccggcaacuuccagggccgccucucccucucccgcgacgucuccaccgagacccucuacaugacccucaacaaccuccgcuccgacgacaccgccgucuacuucugcgcccgccucgaggccgaguccgacucccacucccgccccaucauguucgaccacuggggccacggcucccucgucaccgucuccuccgccuccaccaagggc

SEQ ID NO: 19739 - RNA, 390 nt, Artificial Sequence
  derived and/or modified sequence opt2 from anti-HIV_Chain
cagguccgccucgagcaguccggcaccgccaugcgcaagcccggcgccuccgucacccucuccugccaggccuccggcuacaacuucgucaaguacaucguccacuggguccgccagaagcccggccucggcuucgagugggucggcaugaucgaccccuaccgcggccgccccugguccgcccacaaguuccagggccgccucucccucucccgcgacaccuccauggagauccucuacaugacccucaccucccucaaguccgacgacaccgccaccuacuucugcgcccgcgccgaggccgccuccgacucccacucccgccccaucauguucgaccacuggggccagggcucccgcgucaccgucuccuccgccuccaccaagggc

SEQ ID NO: 19740 - RNA, 390 nt, Artificial Sequence
  derived and/or modified sequence opt2 from anti-HIV_Chain
cagguccgccucgagcaguccggcgccgccaugcgcaagcccggcgccuccgucacccucuccugccaggccuccggcuacaacuucgucaaguacaucguccacuggguccgccagaagcccggccucggcuucgagugggucggcaugaucgaccccuaccgcggccgccccugguccgcccacaaguuccagggccgccucucccucucccgcgacaccuccauggagauccucuacaugacccucaccucccucaaguccgacgacaccgccaccuacuucugcgcccgcgccgaggccgccuccgacucccacucccgccccaucauguucgaccacuggggccagggcucccgcgucaccgucuccuccgccuccaccaagggc

SEQ ID NO: 19741 - RNA, 390 nt, Artificial Sequence
  derived and/or modified sequence opt2 from anti-HIV_Chain
cagguccgccucgagcaguccggcgccgccaugcgcaagcccggcgccuccgucacccucuccugccaggccuccggcuacaacuucgucaaguacaucauccacuggguccgccagaagcccggccucggcuucgagugggucggcaugaucgaccccuaccgcggccgccccugguccgcccacaaguuccagggccgccucucccucucccgcgacaccuccauggagauccucuacaugacccucaccucccucaaguccgacgacaccgccaccuacuucugcgcccgcgccgaggccgccuccgacucccacucccgccccaucauguucgaccacuggggccagggcucccgcgucaccgucuccuccgccuccaccaagggc

SEQ ID NO: 19742 - RNA, 390 nt, Artificial Sequence
  derived and/or modified sequence opt2 from anti-HIV_Chain
cagguccgccucgagcaguccggcaacgccguccgcaagcccggcgccuccgucaccaucuccugccaggccuccggcuacaacuucgucaaguucuucauccacuggguccgccagcgccccggccagggcuucgagugggucggcaugaucgagcccuuccgcggccgccccugguccgccggcaacuuccagggccgccucucccucucccgcgacgucuccaccgagacccucuacaugacccucaacaaccuccgcuccgacgacaccgccgucuacuucugcgcccgccucgaggccgaguccgacucccacucccgccccaucauguucgaccacuggggccacggcucccucgucaccgucuccuccgccuccaccaagggc

SEQ ID NO: 19743 - RNA, 390 nt, Artificial Sequence
  derived and/or modified sequence opt2 from anti-HIV_Chain
cagguccgccucgagcaguccggcgccgccguccgcaagcccggcgccuccgucacccucuccugccaggccuccggcuacaacuucguccgcuacaucauccacuggguccgccagcgccccggccucgacuucgagugggucggcaugaucgaccccuaccgcggccgccccugguccgcccacaaguucggcggccgccucucccucacccgcgacgucuccaccgagauccucuacaugacccucaccucccuccgcuccgacgacaccgccaccuacuucugcgcccgcgccgaggccgagucccagucccacucccgccccaucauguucgacuccuggggccagggcucccgcgucaccgucuccuccgccuccaccaagggc

SEQ ID NO: 19744 - RNA, 390 nt, Artificial Sequence
  derived and/or modified sequence opt2 from anti-HIV_Chain
cagguccgccucgagcaguccggcgccgccguccgcaagcccggcgccuccgucacccucuccugccaggccuccggcuacaacuucgucaacuacaucauccacuggguccgccagcgccccggccucgacuucgagugggucggcaugaucgaccccuaccgcggccgccccugguccgcccacaaguuccagggccgccucucccucucccgcgacgucuccaccgagauccucuacaugacccucuccucccuccgcuccgacgacaccgccaccuacuucugcgcccgcgccgaggccgagucccagucccacucccgccccaucauguucgacuucuggggccagggcucccgcgucaccgucuccuccgccuccaccaagggc

SEQ ID NO: 19745 - RNA, 390 nt, Artificial Sequence
  derived and/or modified sequence opt2 from anti-HIV_Chain
cagguccgccucgagcaguccggcaccgccguccgcaagcccggcgccuccgucaccaucuccugccaggccuccggcuacaacuucgucaaguucuucauccacuggguccgccagcgccccggccagggcuucgagugggucggcaugaucgagcccuuccgcggccgccccugguccgccggcaacuuccagggccgccucucccucucccgcgacgucuccaccgagacccucuacaugacccucaacaaccuccgcuccgacgacaccgccgucuacuucugcgcccgccucgaggccgaguccgacucccacucccgccccaucauguucgaccacuggggccacggcucccucgucaccgucuccuccgccuccaccaagggc

SEQ ID NO: 19746 - RNA, 390 nt, Artificial Sequence
  derived and/or modified sequence opt2 from anti-HIV_Chain
cagguccgccucgagcaguccggcgccgccaugcgcaagcccggcgccuccgucacccucuccugccaggccuccggcuacaacuucgucaaguacaucguccacuggguccgccagaagcccggccucggcuucgagugggucggcaugaucgaccccuaccgcggccgccccugguccgcccacaaguuccagggccgccucucccucucccgcgacaccuccauggagauccucuacaugacccucaccucccucaccuccgacgacaccgccaccuacuucugcgcccgcgccgaggccgccuccgacucccacucccgccccaucauguucgaccacuggggccagggcucccgcgucaccgucuccuccgccuccaccaagggc

SEQ ID NO: 19747 - RNA, 390 nt, Artificial Sequence
  derived and/or modified sequence opt2 from anti-HIV_Chain
gagguccagcucguccaguccggcggcggccucguccagcccggcggcucccuccgccucuccugcgccgccuccggccucaccuuccgcaacuucgccauguccuggguccgccaggcccccggcaagggccucgagugggucuccuccaucuccggcuccggcggcuccaccuacuacgccgacuccgucaagggccgcuucaccaucucccgcgacaacuccaagaacacccucuaccuccagaugaacucccuccgcggcgaggacaccgccgucuacuucugcgccaagggcgucggcuacgacauccucaccggccucggcgacgccuucgacaucuggggccagggcaccgucgucgccgucuccuccgccuccaccaagggc

SEQ ID NO: 19748 - RNA, 393 nt, Artificial Sequence
  derived and/or modified sequence opt2 from anti-HIV_Chain
cagguccagcucguccaguccggcgccgccguccgcaagcccggcgccuccgucaccgucuccugcaaguucgccgaggacgacgacuacuccccccacugggucaaccccgcccccgagcacuacauccacuuccuccgccaggcccccggccagcagcucgaguggcucgccuggaugaaccccaccaacggcgccgucaacuacgccuggcagcuccacggccgccucaccgccacccgcgacggcuccaugaccaccgccuuccucgagguccgcucccuccgcuccgacgacaccgccgucuacuacugcgcccgcgcccagaagcgcggccgcuccgagugggccuacgcccacuggggccagggcacccccguccucgucuccucc

SEQ ID NO: 19749 - RNA, 393 nt, Artificial Sequence
  derived and/or modified sequence opt2 from anti-HIV_Chain
cagguccagcuccagcaguggggcgccggccuccucaagcccuccgagacccucucccucaccugcgccgucuacgccggcuccuucuccggcuacuacuggaccuggauccgccagccccccggcaagggccucgaguggaucggcgaggucaaccacggcggcuccaccaacuacaaccccucccucaagucccgcgucacccucuccgucgacaccuccaagaaccaguucucccucaagcucaccuccgucaccgccgccgacaccgccgucuacuacugcgcccgcgucucccgcuacgacuucugguccggcaacuacggcuccuacggccucgacgucuggggccagggcaccaccgucaccgucuccuccgccuccaccaagggc

SEQ ID NO: 19750 - RNA, 393 nt, Artificial Sequence
  derived and/or modified sequence opt2 from anti-HIV_Chain
gagguccagcucguccaguccggcggcggcgucguccagcccggccgcucccuccgccucuccugcgucgucuccggcuucaccuucuccuccuucaccuuccacuggguccgccaggcccccggcaagggccucgagugggucgccggcauguccuuccacgccaccuacaucuacuacgccgacuccgucaagggccgcuucaccaucucccgcgacgacucccaggacacccucuaccucgagauggacucccuccgcuccgaggacaccgccaucuacuacugcgcccgcgaccccggcauccacgacuacggcgacuacgcccccggcgccuucgacuacuggggccagggcucccccgucaccgucuccuccgccuccaccaagggc

SEQ ID NO: 19751 - RNA, 393 nt, Artificial Sequence
  derived and/or modified sequence opt2 from anti-HIV_Chain
cagguccagcucguccaguccggcaccgagguccagaagcccggcgccuccgucaaggucuccugcaagaccuccggcuacaccuucuccaaguacuacauccacuggguccgccaggcccccggccagggccucgagugggucggccgcaucaacaccgacuccggcggcaccgacuacgccgagaaguuccagggccgcgucaccaugacccgcgacaccuccaucaccaccgucuaccucgagaugcgcggccucaccuccgacgacaccgccgccuucuacugcgcccgcggccccccccacgccggcggcuggaccaucuacuacuacggccucgacgucuggggccagggcaccuccgucaucgucuccuccgccuccaccaagggc

SEQ ID NO: 19752 - RNA, 393 nt, Artificial Sequence
  derived and/or modified sequence opt2 from anti-HIV_Chain
cgcaccgucgucacccagccccccuccgucuccggcgcccccggccagcgcgucaccaucuccugcaccggcuccuccuccaacaucggcgccggcuacgacguccacugguaccagcagcuccccggcaccgcccccaagcuccucaucuacggcaacuccaaccgccccuccggcguccccgaccgcuucuccggcuccaaguccggcaccuccgccucccucgccaucaccggccuccaggccgaggacgaggccgacuacuacugccaguccuacgacuccucccucuccggcuccggcgucuucggcaccggcaccaaggucaccguccucggccagcccaaggccaaccccaccgucacccucuucccccccuccuccgaggagcuc

SEQ ID NO: 19753 - RNA, 393 nt, Artificial Sequence
  derived and/or modified sequence opt2 from anti-HIV_Chain
cagguccagcuccagcaguggggcuccggccuccucaagcccuccgagacccucucccucaccugcgccgucuacggcggcuccuuccgcuccuacuacuggaacuggauccgccagucccccggcaagggccucgaguggaucggcgaggucucccacuccggcuccaccaacuacaaccccgcccucaagucccgcgucaccaucuccgucgacaccuccaagaaccaguucucccucaaggucaaguccgucaccgccgccgacaccgcccucuacuacugcucccgcggccgcggcaagcgcugcuccggcgccuacugcuucgccggcuacuucgacuccuggggccagggcggccucgucgucgucuccuccgccuccaccaagggc

SEQ ID NO: 19754 - RNA, 393 nt, Artificial Sequence
  derived and/or modified sequence opt2 from anti-HIV_Chain
cagguccaccucguccaguccggcgccgaggucaagaagcccggcuccuccguccgcgucuccugcgaggccuccggcuggaccuucggcuccgucaacuccgccaucaccuggguccgccaggcccccggccagggccucgaguggaugggccgcaccauccccuuccucggcaucuccaacuacgcccagaaguuccagggccgcgucaccaucaccgccgacaaguccaccaacaucgccuacgucgacgucaccucccucaccucccaggacaccgccgucuacuacugcgcccgccucaucaccggcaugaccgcccccugguucuacuacauggacgucuggggcaagggcaccaccgucaccgucuccuccgccuccaccaagggc

SEQ ID NO: 19755 - RNA, 393 nt, Artificial Sequence
  derived and/or modified sequence opt2 from anti-HIV_Chain
cagguccaccuccaggaguccggcccccgccucguccgcuccuccgagacccucucccucaccugcuccguccccggcggcuccaucgucaaccccaucaccaacuacuacugguccuggauccgccaguccccccgcaagggccuccaguggaucggcgacaucuacuacaccggcaccuccucccgcaaccccucccucgacucccgcgucuccaucuccauggacgucucccgcaagcagaucucccucacccucuacuccgucaccgccgccgacaccgccguccacuacugcgccucccagucccucuccugguaccgccccuccggcuacuucgaguccuggggccagggcauccucgucaccgucuccuccgccuccaccaagggc

SEQ ID NO: 19756 - RNA, 393 nt, Artificial Sequence
  derived and/or modified sequence opt2 from anti-HIV_LightChain
augaagcuccccguccgccuccucguccucauguucuggauccccgccuccuccuccgacaucgucaugacccaguccccccucucccuccccgucacccccggcgagcccgccuccaucuccugccgcuccucccagcgccuccucuccuccuacggccacaccuaccuccacugguaccuccagaagcccggccaguccccccagcuccucaucuacgaggucuccaaccgcuucuccggcguccccgaccgcuucuccggcuccggcuccggcaccgacuucacccucaagaucucccgcgucgaggccgaggacgucggcgucuacuacugcucccaguccacccacgucccccucaccuucggccagggcaccaaggucgagaucaag

SEQ ID NO: 19757 - RNA, 396 nt, Artificial Sequence
  derived and/or modified sequence opt2 from anti-HIV_Chain
cagguccagcuccaggaguccggccccggccucgucaagcccuccgagacccucuccgucaccugcuccgucuccggcgacuccaugaacaacuacuacuggaccuggauccgccagucccccggcaagggccucgaguggaucggcuacaucuccgaccgcgccuccgccaccuacaaccccucccucaacucccgcgucgucaucucccgcgacaccuccaagaaccagcucucccucaagcucaacuccgucacccccgccgacaccgccgucuacuacugcgccaccgcccgccgcggccagcgcaucuacggcgucgucuccuucggcgaguucuucuacuacuacuccauggacgucuggggcaagggcaccaccgucaccgucuccucc

SEQ ID NO: 19758 - RNA, 396 nt, Artificial Sequence
  derived and/or modified sequence opt2 from anti-HIV_Chain
cagguccagcuccaggaguccggccccggccucgucaagccccccgagacccucucccucaccugcuccgucuccggcgccuccgucaacgacgccuacugguccuggauccgccagucccccggcaagcgccccgagugggucggcuacguccaccacuccggcgacaccaacuacaaccccucccucaagcgccgcgucaccuucucccucgacaccgccaagaacgaggucucccucaagcucgucgcccucaccgccgccgacuccgccgucuacuucugcgcccgcgcccuccacggcaagcgcaucuacggcaucgucgcccucggcgagcucuucaccuacuucuacauggacgucuggggcaagggcaccaccgucaccgucuccucc

SEQ ID NO: 19759 - RNA, 396 nt, Artificial Sequence
  derived and/or modified sequence opt2 from anti-HIV_Chain
cagguccagcuccaggaguccggccccggccucgucaagcccuccgagacccucucccucaccugcuccgucuccggcgccuccaucuccgacuccuacugguccuggauccgccgcucccccggcaagggccucgaguggaucggcuacguccacaaguccggcgacaccaacuacucccccucccucaagucccgcgucaaccucucccucgacaccuccaagaaccaggucucccucucccucgucgccgccaccgccgccgacuccggcaaguacuacugcgcccgcacccuccacggccgccgcaucuacggcaucgucgccuucaacgagugguucaccuacuucuacauggacgucuggggcaacggcacccaggucaccgucuccucc

SEQ ID NO: 19760 - RNA, 396 nt, Artificial Sequence
  derived and/or modified sequence opt2 from anti-HIV_Chain
cagguccaccuccaggaguccggccccggccucgucaagcccuccgagacccucucccucaccugcaacgucuccggcacccucguccgcgacaacuacugguccuggaugcgccagccccucggcaagcagcccgaguggaucggcuacguccacgacuccggcgacaccaacuacaaccccucccucaagucccgcguccaccucucccucgacaaguccaacaaccucgucucccuccgccucaccgccgucaccgccgccgacuccgccaccuacuacugcgccaccaccaagcacggccgccgcaucuacggcaucgucgccuucaacgagugguucaccuacuucuacauggacgucuggggcaagggcaccaccgucaccgucuccucc

SEQ ID NO: 19761 - RNA, 396 nt, Artificial Sequence
  derived and/or modified sequence opt2 from anti-HIV_Chain
cagguccagcuccaggaguccggccccggccucgucaagcccuccgagacccucuccgucaccugcuccgucuccggcgacuccaugaacaacuacuacuggaccuggauccgccagucccccggcaagggccucgaguggaucggcuacaucuccgaccgcgaguccgccaccuacaaccccucccucaacucccgcgucgucaucucccgcgacaccuccaccaaccagcucucccucaagcucaacuccgucacccccgccgacaccgccgucuacuacugcgccaccgcccgccgcggccagcgcaucuacggcgucgucuccuucggcgaguucuucuacuacuacuccauggacgucuggggccgcggcaccaccgucaccgucuccucc

SEQ ID NO: 19762 - RNA, 396 nt, Artificial Sequence
  derived and/or modified sequence opt2 from anti-HIV_Chain
cagguccagcucgucgaguccggccccggccucgucacccccuccgagacccucucccucaccugcaccgucuccaacggcuccgucuccggccgcuucugguccuggauccgccagucccccggccgcggccucgaguggaucggcuacuucuccgacaccgaccgcuccgaguacucccccucccuccgcucccgccucacccucucccucgacgccucccgcaaccagcucucccucaagcucaaguccgucaccgccgccgacuccgccaccuacuacugcgcccgcgcccagcagggcaagcgcaucuacggcaucgucuccuucggcgaguucuucuacuacuacuacauggacgccuggggcaagggcaccgccgucaccgucuccucc

SEQ ID NO: 19763 - RNA, 396 nt, Artificial Sequence
  derived and/or modified sequence opt2 from anti-HIV_Chain
cagguccagcuccaggaguccggccccggccucgucaagccccccgagacccucucccucaccugcuccgucuccggcgccuccaucaacgacgccuacugguccuggauccgccagucccccggcaagcgccccgagugggucggcuacguccaccacuccggcgacaccaacuacaaccccucccucaagcgccgcgucaccuucucccucgacaccgccaagaacgaggucucccucaagcucgucgaccucaccgccgccgacuccgccgucuacuucugcgcccgcgcccuccacggcaagcgcaucuacggcaucgucgcccucggcgagcucuucaccuacuucuacauggacgucuggggcaagggcaccaccgucaccgucuccucc

SEQ ID NO: 19764 - RNA, 396 nt, Artificial Sequence
  derived and/or modified sequence opt2 from anti-HIV_Chain
cagguccagcuccaggaguccggccccggccucgucaagccccccgagacccucucccucaccugcuccgucuccggcgccuccaucaacgacgccuacugguccuggauccgccagucccccggcaagcgccccgagugggucggcuacguccaccacuccggcgacaccaacuacaaccccucccucaagcgccgcgucuccuucucccucgacaccgccaagaacgaggucucccucaagcucgucgaccucaccgccgccgacuccgccaucuacuucugcgcccgcgcccuccacggcaagcgcaucuacggcaucgucgcccucggcgagcucuucaccuacuucuacauggacgucuggggcaagggcaccaccgucaccgucuccucc

SEQ ID NO: 19765 - RNA, 396 nt, Artificial Sequence
  derived and/or modified sequence opt2 from anti-HIV_Chain
cagguccagcuccaggaguccggccccggccucgucaagcccuccgagacccucuccgucaccugcuccgucuccggcgacuccaugaacaacuccuacuggaccuggauccgccagucccccggcaagggccucgaguggaucggcuacaucuccaaguccgaguccgccaacuacaaccccucccucaacucccgcgucgucaucucccgcgacaccuccaagaaccagcucucccucaagcucaacuccgucacccccgccgacaccgccgucuacuacugcgccaccgcccgccacggccagcgcaucuacggcgucgucuccuucggcgaguucuucaccuacuacuccauggacgucuggggcaagggcaccaccgucaccgucuccucc

SEQ ID NO: 19766 - RNA, 396 nt, Artificial Sequence
  derived and/or modified sequence opt2 from anti-HIV_Chain
cagguccagcuccaggaguccggccccggccucgucaagcccuccgagacccucucccucaccugcuccgucuccaacggcuccgucuccggccgcuucugguccuggauccgccagucccccggccgcggccucgaguggaucggcuacuucuccgacaccgagaaguccaacuacaaccccucccuccgcucccgccucacccucuccgucgacgccuccaagaaccagcucucccucaagcucaacuccgucaccgccgccgacuccgccaccuacuacugcgcccgcacccagcagggcaagcgcaucuacggcgucgucuccuucggcgaguucuuccacuacuacuacauggacgccuggggcaagggcaccgccgucaccgucuccucc

SEQ ID NO: 19767 - RNA, 396 nt, Artificial Sequence
  derived and/or modified sequence opt2 from anti-HIV_Chain
cagguccagcucguccaguccggcaccgcccucaagucccccggcuccuccgccaagcucuccugcaccguccucggcgacgaguucggcaccuacuucaucuccuggauccgccaggcccccggccagggccucgagugggucggcggcaucgucccccacucccagcuccaguccuccgcccagaaguuccacggccgcaucaucaucuccgccggcgccggcgucaccccccccgucgucucccuccagcucaccaaccucaccuucgaggacaccggcaccuacuucugcgcccgcgagcgcggccgccaccgcgaccccaagaccggcgacgcccuccgcggccgcuacuucgacuucuggggccgcggcaccggcgucuccgucuccgcc

SEQ ID NO: 19768 - RNA, 396 nt, Artificial Sequence
  derived and/or modified sequence opt2 from anti-HIV_Chain
cagguccagcucguccaguccggcaccgcccucaagucccccggcuccuccgccaagcucuccugcaccguccucggcgacgaguucggcaccuacuucaucuccuggauccgccaggcccccggccagggccucgagugggucggcggcaucgucccccacucccagcuccaguccuccgcccagaaguuccacggccgcaucaucaucuccgccggcgccggcgucaccccccccgucgucucccuccagcucaccaaccucaccuucgaggacaccggcaccuacuucugcgcccgcgagcgcggccgccaccgcgaccccaagaccggcaaggccccccgcggccgcuacuucgacuucuggggccgcggcaccggcgucaccgucuccgcc

SEQ ID NO: 19769 - RNA, 396 nt, Artificial Sequence
  derived and/or modified sequence opt2 from anti-HIV_Chain
cagguccagcucguccaguccggcaccgcccucaagucccccggcuccuccgccaagcucuccugcaccguccucggcgacgaguucggcaccuacuucaucuccuggauccgccaggcccccggccagggccucgagugggucggcggcaucgucccccacucccagcuccaguccuccgcccagaaguuccacggccgcaucaccaucuccgccggcgccggcgucaccccccccgucgucucccuccagcucaccaaccucaccuucgaggacaccggcaccuacuucugcgcccgcgagcgcggccgccaccgcgaccccaagaccggcgacgcccuccgcggccgcuacuucgacuucuggggccgcggcaccggcguccgcgucuccacc

SEQ ID NO: 19770 - RNA, 396 nt, Artificial Sequence
  derived and/or modified sequence opt2 from anti-HIV_Chain
cagguccagcucguccaguccggcgccgccgucaagucccccggcuccuccgccaagcucuccugcaccguccucggcgacgaguucggcaccuacuucaucuccuggauccgccaggcccccggccagggccucgagugggucggcggcaucgucccccacucccagcuccaguccuccgcccagcgcuuccacggccgcaucaccaucuccgccggcgccggcgucaccccccccgucgucucccuccagcucaccaaccucaccuucgacgacgccggcaccuacuucugcgcccgcgagcgcggccgccaccgcgaccccaagaccggcgacgcccuccgcggccgcuacuucgacuucuggggccgcggcaccggcaucuccgucuccccc

SEQ ID NO: 19771 - RNA, 396 nt, Artificial Sequence
  derived and/or modified sequence opt2 from anti-HIV_Chain
gagguccagcucguccaguccggcgccgaggucaagaagcccggcgccuccgucaaggucuccugcaaggucuccggcuacacccucaccgagcucuccauccacuggguccgccaggcccccggcaagggccucgaguggaugggcggcuucgaccccgaggacgacgaggccaucuacgagcccaaguuccagggccgccucaccaugaccgaggacaccuccaccgacaccgccuacauggagcucuccucccuccgcuccgaggacaccgccgucuacuacugcgccaccgccgaccccuucaaggucgcccaggacgagggccucuacgucaucuucgacuacuggggccagggcacccucgucaccgucuccuccgccuccaccaagggc

SEQ ID NO: 19772 - RNA, 396 nt, Artificial Sequence
  derived and/or modified sequence opt2 from anti-HIV_Chain
gagguccagcucgucgaguccggcggcggccuccuccagcccggcggcucccuccgccucuccugcgccgccuccggcuucuccuucaacgacuucgagaugaacuggguccgccaggcccccggcaagggccucgagugggucuccuacaucuccaacgacggcaccaugauccacuacgccgacuccgucaagggccgcuucaccaucucccgcgacaacgccaagaagucccucuuccuccagaugaacucccuccgcgccgaggacaccgccgucuacuacugcgcccgccucgccgaggucccccccgccauccgcggcuccuacuacuacggcauggacgucuggggccagggcaccaccgucaccgucgccuccgccuccaccaagggc

SEQ ID NO: 19773 - RNA, 396 nt, Artificial Sequence
  derived and/or modified sequence opt2 from anti-HIV_Chain
cagguccagcucaugcaguccggcgccgaggucaagcgccccggcgccuccgucaaggucuccugcaaggccuuccgccacucccucaacaaccucggcaucuccuggauccgccgcgcccccggccgcggccucgaguggcucggcuggaucaacgucuacgagggcaacaccaaguacggccgccgcuuccagggccgcgucaccaugaccaccgaccgcuccaccaacaccgucuccauggagcuccgcucccucaccuccgacgacaccgccgucuacuacugcgcccgcgacaaccacuucugguccggcuccucccgcuacuacuacuucggcauggacgucuggggccagggcaccaccgucaucgucuccuccgccuccaccaagggc

SEQ ID NO: 19774 - RNA, 396 nt, Artificial Sequence
  derived and/or modified sequence opt2 from anti-HIV_Chain
cagguccagcucguccaguggggcgccggccuccucaagccccucgagacccucucccucaccugcgccgucuacggcggcuccuucaacggcuacuucugguccuggauccgccagacccccggcaagggccucgaguggaucggcgagaucaaccacggcggcuccgccaacuucaaccccucccucaagucccgcgucaccauguccgucgacaccuccaagaaccaguucucccucaagcucgccuccgucaccgccgccgacaccgccaucuacuacugcgcccgcggccgcaucaccaugguccgcggcgacccccagcgcggcggcguccgcauggacgucuggggccagggcaccuccgucaccgucuccuccgccuccaccaagggc

SEQ ID NO: 19775 - RNA, 396 nt, Artificial Sequence
  derived and/or modified sequence opt2 from anti-HIV_Chain
cucguccagcucguccaguccggcgccgaggucaagaagcccggcgccuccgucaaggucuccugcaaggucuccggccacacccucuccgagcucuccaucaacuggguccgccacguccccggcaagggccucgaguggaugggcggccucgaccccgaggacggcgaggccauccacgagcccaaguuccagggccgccucaccaugaccgaggacaccuccaccgacaccgccuacuccacccucuccgucugggcccccgucgccgccgccauguacuacugcgccaccgccgaccccuucaaggucgcccaggacgagggccucuacgucaucuucgacuacuggggccagggcacccucgucaccgucuccuccgccuccaccaagggc

SEQ ID NO: 19776 - RNA, 396 nt, Artificial Sequence
  derived and/or modified sequence opt2 from anti-HIV_Chain
cagguccagcuccuccaguccggcggcgaggucaagaagcccggcgccuccgucaaggucuccugcaaggucuccggcuacacccucaccgagcucuccauccacuggguccgccaggcccccggcaagggccucgaguggaugggcggcuucgaccccgaggacgacgaggccaucuacgagcccaaguuccagggccgccucaccaugaccgaggacaccuccaccgacaccgccuacauggagcucuccucccuccgcuccgaggacaccgccgucuacuacugcgccaccgccgaccccuucaaggucgcccaggacgagggccucuacgucaucuucgacuacuggggccagggcacccucgucaccgucuccuccgccuccaccaagggc

SEQ ID NO: 19777 - RNA, 396 nt, Artificial Sequence
  derived and/or modified sequence opt2 from anti-HIV_Chain
cagguccagcucguccaguccggcgccgaggucaagaagcccggcgccuccgucaaggucuccugcaaggucuccggcuacacccucaccgagcucuccauccacuggguccgccaggcccccggcaagggccucgaguggaugggcggcuucgacuccgaggacggcgaggccuucuacaagcagaacuuccagggccgcgucaccaugaccgaggacaccuccaccgacaccgccuacauggagcuccgccgccuccgcuccgaggacaccgccgucuacuacugcgccaccgccgaccgcuucaaggucgcccaggacgagggccucuucgucaucuucgacuacuggggccagggcacccucgucaccgucuccuccgccuccaccaagggc

SEQ ID NO: 19778 - RNA, 396 nt, Artificial Sequence
  derived and/or modified sequence opt2 from anti-HIV_Chain
cagguccaccucguccaguccggcgccgaggucaagaagcccggcgccuccguccgcgucuccugcaaggccuccggcuacaccuucaccaccuacggcaucuccuggguccgccaggcccccggccagggccucgaguggaugggcuggaucuccgcccacuccggcgacaccaacuacgcccagaagcuccaggcccgcgucaccaugaccaccgacaccuccaccaacaccgccuacauggagcuccgcucccucaccuccgacgacaccgccgucuacuacugcgcccgcgaccgcccccgccacuacuacgaccgcggcggcuacuacucccccuucgacuacuggggccagggcacccucgucaccgucuccuccgccuccaccaagggc

SEQ ID NO: 19779 - RNA, 396 nt, Artificial Sequence
  derived and/or modified sequence opt2 from anti-HIV_Chain
cucguccagcuccuccaguccggcgccgaggucaagaagcccggcgccuccgucaaggucuccugcaaggucuccggcuacacccucaccgagcucuccauccacuggguccgccaggcccccggcaagggccucgaguggaugggcggcuucgaccccgaggacgacgaggccaucuacgagcccaaguuccagggccgccucaccaugaccgaggacaccuccaccgacaccgccuacauggagcucuccucccuccgcuccgaggacaccgccgucuacuacugcgccaccgccgaccccuucaaggucgcccaggacgagggccucuacgucaucuucgacuacuggggccagggcacccucgucaccgucuccuccgccuccaccaagggc

SEQ ID NO: 19780 - RNA, 396 nt, Artificial Sequence
  derived and/or modified sequence opt2 from anti-HIV_Chain
cagguccagcucguccaguccggcgccgaggucaagaagcccggcgccuccgucaaggucuccugcaaggucuccggccacacccucuccgagcucuccaucaacuggguccgccacguccccggcaagggccucgaguggaugggcggccucgaccccgaggacggcgaggccauccacgagcccaaguuccagggccgccucaccaugaccgaggacaccuccaccgacaccgccuacgucgagcucuccucccuccgcuccgaggacaccgccauguacuacugcgccaccgccgaccccuucaaggucgcccaggacgagggccucuacgucaucuucgacuacuggggccagggcacccucgucaccgucuccuccgccuccaccaagggc

SEQ ID NO: 19781 - RNA, 396 nt, Artificial Sequence
  derived and/or modified sequence opt2 from anti-HIV_Chain
cagguccagcuccuccaguccggcgccgaggucaagaagcccggcgccuccgucaaggucuccugcaaggucuccggcuacacccucaccgagcucuccaucaacuggguccgccaggcccccggcaagggccucgaguggaugggcggcuucgaccccgaggacgacgaggccaucuacgagcccaaguuccagggccgccucaccaugaccgaggacaccuccaccgacaccgccuacauggagcucuccucccuccgcuccgaggacaccgccgucuacuacugcgccaccgccgaccccuucaaggucgcccaggacgagggccucuacgucaucuucgacuacuggggccagggcacccucgucaccgucuccuccgccuccaccaagggc

SEQ ID NO: 19782 - RNA, 396 nt, Artificial Sequence
  derived and/or modified sequence opt2 from anti-HIV_Chain
cagccccagcucguccaguccggcuccggcgccgaggucaagaagcccggcgccuccguccgcaucuccugcgaggccuccgaguacaacgucuucgaccacuucaugcaguggguccgccaggcccccggccagggccucgaguggaugggcuggaucaacccccgcggcggcuaccccuccuacucccccaccuuccagggccgccucaccuucacccgccagcccuccugggacgacuccaccaucaccuuccacauggagcuccgcggccucggccacgacgacaccgccgucuacuacugcgcccgcccccacucccccgacgacgccuggucccucgacgucuggggccgcggcacccucgucaccgucuccuccgccuccaccaagggc

SEQ ID NO: 19783 - RNA, 396 nt, Artificial Sequence
  derived and/or modified sequence opt2 from anti-HIV_Chain
cagccccagcucguccaguccggcuccggcgccgaggucaagaagcccggcgccuccguccgcaucuccugcgaggccuccgaguacaacgucuucgaccacuucaugcaguggguccgccaggcccccggccagggccucgaguggaugggcuggaucaacccccgcggcggcuaccccuccuacuccccccgcuuccagggccgccucaccuucacccgccagcccuccugggacgacuccuccgucaccuuccacauggagcuccgcggccuccgccacgacgacaccgccgucuacuacugcgcccgcccccacucccccgacgacgccuggucccucgacgucuggggccgcggcacccucgucaccgucuccuccgccuccaccaagggc

SEQ ID NO: 19784 - RNA, 396 nt, Artificial Sequence
  derived and/or modified sequence opt2 from anti-HIV_Chain
gagguccagcucgucgaguccggcggcggcgucgucgagcccggcgagucccuccgccucuccugcgccgccuccggcuucaccuuccgcuccuacgacauguucuggguccgccaggccaccggcaagucccucgagugggucuccgccaucggcaucgccggcgacaccuacuacuccggcuccgucaagggccgcuucaccaucucccgcgagaacgcccgcaccucccucuaccuccagcucuccggccuccgcgucgaggacuccgccgucuacuucugcguccgcggcucccccccccgcaucgccgccaccgaguacaacuacuacuacggccucgacgucuggggccagggcaccaccgucuccgucuucuccgccuccaccaagggc

SEQ ID NO: 19785 - RNA, 396 nt, Artificial Sequence
  derived and/or modified sequence opt2 from anti-HIV_Chain
cagguccagcucguccaguccggcgccgaggucaagaagcccggcuccuccgucaaggucuccugcaaggccuccggcggcaccuucaccaccuacgacaucuccuggguccgccaggcccccggccagggccucgaguggaugggcggcauccuccccgacuucggcgcccccuccuacgcccagaaguuccaggaccgcgucaccaucaccaccgacgaguccuccuccaccgccuacauggagcucaacucccuccgcuccgaggacaccgccaucuacuacugcgcccgcggccgcggcgacgacuucugguccggcgagucccccuccugguacuucgacuacuggggccagggcacccucgucaccgucuccuccgccuccaccaagggc

SEQ ID NO: 19786 - RNA, 396 nt, Artificial Sequence
  derived and/or modified sequence opt2 from anti-HIV_Chain
cagccccagcucguccaguccggcuccggcgccgaggucaagaagcccggcgccuccguccgcaucuccugcgaggccuccgaguacaacgucuucgaccacuucaugcaguggguccgccaggcccccauggagggccucgaguggaugggcuggaucaacccccgcggcggcuaccccuccuacucccccaccuuccagggccgccucaccuucacccgccagcccuccugggacgacuccaccaucaccuuccacauggagcuccgcggccuccgccacgacgacaccgccgucuacuacugcgcccgcccccacucccccgacgacgccuggucccucgacgucuggggccgcggcacccucgucaccgucuccuccgccuccaccaagggc

SEQ ID NO: 19787 - RNA, 396 nt, Artificial Sequence
  derived and/or modified sequence opt2 from anti-HIV_Chain
gagguccgccuccucgaguccggcggcggccucguccagcccggcggcucccuccgccucuccugcuccgccuccggcuucaccuucuccaacuccgcccucuccuggguccgccaggcccccggcaagggccucgagugggucuccuccgucgucuccuccggcggcgacaccuucuacgccgacuccgucaagggccgcuucaccaucucccgcgacaacucccgcaacacccucuaccuccagaugaagucccuccgcgccgaggacaccgcccucuacuacugcgccaagguccagauccagcagcucaacuucggcgucaucaccgacgccggcauggacgucuggggcaagggcaccaccgucaucgucuccuccgccuccaccaagggc

SEQ ID NO: 19788 - RNA, 396 nt, Artificial Sequence
  derived and/or modified sequence opt2 from anti-HIV_Chain
cagguccagcucgucgaguccggcggcggcgucguccagcccggccgcucccuccgccucuccugcgucggcuccggcuucaccuucuccuccuccggcaugcacuggguccgccaggcccccggcaagggccucgagugggucgccgucaucuccuccgacggcuccgacgaguacuacggcgacuccgucgagggccgcuucaccaucucccgcgacaacuccaagaacacccucuuccuccagcucgacucccucgaggccgaggacuccgccgucuacuacugcgccaagacccccccccacuacgacgcccucaccggcuaccccuccuccguccucgaguucuggggccucggcacccucgucaccgucuccuccgccuccaccaagggc

SEQ ID NO: 19789 - RNA, 396 nt, Artificial Sequence
  derived and/or modified sequence opt2 from anti-HIV_Chain
gagguccagcucguccaguccggcgccgaggucaagaagcccggcuccuccgucaaggucuccugcaaggccuccggcggcaccuucaccaccuacgacaucuccuggguccgccaggcccccggccagggccucgaguggaucggcggcauccuccccgacuucggcgcccccuccuacgcccagaaguuccaggaccgcgucaccaucaccaccgacgaguccucccgcaccgccuacauggagcucaacucccuccgcuccgaggacaccgccaucuacuacugcgcccgcggccgcggcgacgacuucugguccggcgagucccccuccugguacuucgacuacuggggccagggcacccaggucaccgucuccuccgccuccaccaagggc

SEQ ID NO: 19790 - RNA, 396 nt, Artificial Sequence
  derived and/or modified sequence opt2 from anti-HIV_Chain
cagguccagcuccuccaguccggcaccgaggucaagaagcccggcuccuccgucaaggucuccugccgcgccuccggcuggacccucggcaacucccccaacuccgccaucggcuggguccgccaggcccccggccagggccucgaguggaucggccgcaucauccccauccucgacgucaccaacuacgcccagaaguuccagggccgcgucaccaucuccgccgacaaguccaccaacaucgccuacauggagaucuccucccucggcuccgaggacaccgccuucuacuacugcgcccgcgucaucaccggcaugaccucccccugguacuucuacauggacgucuggggcgagggcaccaccgucaucgucuccuccgccuccaccaagggc

SEQ ID NO: 19791 - RNA, 396 nt, Artificial Sequence
  derived and/or modified sequence opt2 from anti-HIV_Chain
cagguccaccucguccaguccggcgccgaggucaagaagcccggcuccuccguccgcgucuccugcaaggccuccggcuggaccuucggcgacuccgucaacuccgccaucaccuggguccgccaggcccccggccagggccucgaguggaugggccgcuucauccccauccucggccucuccaacuacgcccagaaguuccaggaccgcgucaccaucaacgucgaccgcuccaccaacaccgccuacauggagcucuccggccuccgcuccgaggacaccgccgucuacuacugcgcccgccucaucaccggcaugaacgcccccugguucuacuacauggacgucuggggcaagggcaccaccaucaccgucuccuccgccuccaccaagggc

SEQ ID NO: 19792 - RNA, 396 nt, Artificial Sequence
  derived and/or modified sequence opt2 from anti-HIV_Chain
cagguccaccucguccaguccggcgccgaggccaagcgccccggcuccuccguccgcgucuccugccgcgccuccggcggcgacuucuccuccuacacccucuccuggguccgccaggcccccggccagggccucgagcgcaugggcggcgucguccccaugcucgacaccguccacuacgcccagaaguuccagggccgccucacccucuccgucgacgagggcaccuccaccgccuacauggagcucuccucccuccgcuccgaggacaccgccauguacuacugcacccgcggccgccagaccuuccgcgccaucugguccggcccccccgucgucuucgacaucuggggccagggcacccucgucuccgucuccuccgccuccaccaagggc

SEQ ID NO: 19793 - RNA, 396 nt, Artificial Sequence
  derived and/or modified sequence opt2 from anti-HIV_Chain
cagguccaccucguccaguccggcgccgaggccaagcgccccggcuccuccguccgcgucuccugccgcgccuccggcggcgacuucuccuccuacacccucuccuggguccgccaggcccccggccagggcaucgaguggaugggcggcgucguccccaugcucgacaccguccacuacgcccagaaguuccagggccgccucacccucuccgucgacgagggcaccuccaccgccuacauggagcucuccucccuccgcuccgaggacaccgccauguacuacugcacccgcggccgccagaccuuccgcgccaucugguccggcccccccgccgucuucgacaucuggggccagggcacccucgucaucgucuccuccgccuccaccaagggc

SEQ ID NO: 19794 - RNA, 396 nt, Artificial Sequence
  derived and/or modified sequence opt2 from anti-HIV_Chain
cagguccagcucguccaguccggcgccgagcucaagaagcccggcuccuccgucaaggucuccugcaaggccuccggcggcaccuucaacaaccacaccuucaacuggguccgccaggcccccggccagggccucgaguggaugggccgcaccauccccauccucggcucccgcgacuacgccaagaccuuccaggaccgcgucaccaucaucgccgacaaguccaccuccaccgucuaccucgagcuccgccgccucaaguccgaggacaccggcgucuacuacugcgccaccuccauguacuacuucgacuccggcggcuacuaccgcaacaccgaccucgacaaguggggccagggcucccucgucaccgucuccuccgccuccaccaagggc

SEQ ID NO: 19795 - RNA, 396 nt, Artificial Sequence
  derived and/or modified sequence opt2 from anti-HIV_Chain
caggucuaccucguccaguccggccccgagcucaagaagcccggcgccuccgucaagaucuccugcaaggccuccggcuacaacuuccccaaguacgccauccacuggguccgccaggcccccggccagggccuccaguggaugggcuggaucaacggcgacaacggcgacgcccgcuacucccagaagcuccagggccgcgucacccccuccaccgacaccuccgccuccgucgucuacauggagcucaagcgccuccgcuccgaggacaccgccgucuacuacugcgcccgcgcccucuaccccugggagaucggcggcguccccuccaccaugggcgacgacuacuggggccagggcacccucaucaccgucuccuccgccuccaccaagggc

SEQ ID NO: 19796 - RNA, 396 nt, Artificial Sequence
  derived and/or modified sequence opt2 from anti-HIV_Chain
cagguccagcucguccaguccggccccgagcucaugaagcccggcuccuccgucaaggucuccugccgcgccuccggcgacaacuuccucaccuccaccuucaacuggcuccgccaggcccccggccagcgccucgaguggaugggccgcuucauccccucccucggccucaucaccuccgcccccaaguucuccgaccgccucaccaucaccgccgaccaggccacccucaccgccuacauggagcucaccggccucaccuccgaggacaccgcccucuacuacugcgcccgcggccucugccgcggcggcaacugccgccucggccccuccggcuggcucgaccccuggggccgcggcacccaggucaccgucuccuccgccuccaccaagggc

SEQ ID NO: 19797 - RNA, 396 nt, Artificial Sequence
  derived and/or modified sequence opt2 from anti-HIV_Chain
ggcguccacuuccagggccaccucguccaguccggcggcggcgucaagaagcccggcuccuccgucaccaucuccugccucgccuccgaguacaccuucaccgaguucaccauccacuggauccgccaggcccccggccagggcccccucuggcucggccucaucaagcgcuccggccgccucaugaccuccuaccgcuuccaggaccgccucucccuccgccgcgaccgcuccaccggcaccgucuucauggagcuccgcggccuccgcaucgacgacaccgccgucuacuacugcgcccgcgacggccucggcgaggucgcccccgccuaccucuacggcaucgacgucuggggccagggcuccaccgucaucgucaccuccgccuccaccucc

SEQ ID NO: 19798 - RNA, 396 nt, Artificial Sequence
  derived and/or modified sequence opt2 from anti-HIV_Chain
cagguccagcuccuccaguccggcgccgaggucaagaagcccggcgccuccgucaaggucuccugcaaggucuccggcuacacccucaccgagcucuccauccacuggguccgccaggcccccggcaagggccucgaguggaugggcggcuucgaccccgaggacgacgaggccaucuacgagcccaaguuccagggccgccucaccaugaccgaggacaccuccaccgacaccgccuacauggagcucuccucccuccgcuccgaggacaccgccgucuacuacugcgccaccgccgaccccuucaaggucgcccaggacgagggccucuacgucaucuucgacuacuggggccagggcacccucgucaccgucuccuccgccuccaccaagggc

SEQ ID NO: 19799 - RNA, 396 nt, Artificial Sequence
  derived and/or modified sequence opt2 from anti-HIV_Chain
cagguccagcucguccaguccggcgccgaggucaagaagcccggcgccuccgucaaggucuccugcaaggucuccggcuacacccucaccgagcucuccauccacuggguccgccaggcccccggcaagggccucgaguggaugggcggcuucgaccccgaggacggcgaggccuccuucgagcccaaguuccagggccgccucaccaugaccgaggacaccuccaccgacaccgccuacauggagcucuccucccuccgcuccgaggacaccgccgucuacuacugcgccaccgccgaccccuucaaggucgcccaggacgagggccucuacgucaucuucgacuacuggggccagggcacccucgucaccgucuccuccgccuccaccaagggc

SEQ ID NO: 19800 - RNA, 396 nt, Artificial Sequence
  derived and/or modified sequence opt2 from anti-HIV_Chain
ggcguccacuuccagggccaccucguccaguccggcggcggcgucaagaagcccggcuccuccgucaccaucuccugccucgccuccgaguacaccuucaccgaguucaccauccacuggauccgccaggcccccggccagggcccccucuggcucggccucaucaagcgcuccggccgccucaugaccuccuaccgcuuccaggaccgccucucccuccgccgcgaccgcuccaccggcaccgucuucauggagcuccgcggccuccgcaucgacgacaccgccgucuacuacugcgcccgcgacggccucggcgaggucgcccccgccuaccucuacggcaucgacgucuggggccagggcaccaccgucaucgucaccuccgccuccaccucc

SEQ ID NO: 19801 - RNA, 396 nt, Artificial Sequence
  derived and/or modified sequence opt2 from anti-HIV_Chain
cagguccagcucggcgaguccggcggcggccucgucgagcccggcggcucccuccgccucuccugcgccgccuccggcuuccucuucuccgacuaccagauguccuggauccgccucgcccccggcaagggccucgaguggaucuccuucaucuccggcuucggcuccgucuacuacgccgacuccgucgagggccgcuucaccaucucccgcgacaacgcccgcaacucccucuaccuccagaugaacaaccuccgcgccgaggacaccgccgucuacuacugcgcccgcgccuacggcaccggcaacuggcgcggccucuacuacuacuacuacggcauggacgucuggggccacggcaccaccgucaccgucuccuccgccuccaccaagggc

SEQ ID NO: 19802 - RNA, 399 nt, Artificial Sequence
  derived and/or modified sequence opt2 from anti-HIV_Chain
cagguccagcucguccaguccggcaccgcccucaagucccccggcuccuccgccaagcucuccugcaccguccucggcgacgaguucggcaccuacuucaucuccuggauccgccaggcccccggccagggccucgagugggucggcggcaucgucccccacucccagcuccaguccuccgcccagaaguuccacggccgcaucaucaucuccgccggcgccggcgucaccccccccgucgucucccuccagcucaccaaccucaccuucgaggacaccggcaccuacuucugcgcccgcgagcgcggccgccaccgcgaccccaagaccggcgacgcccuccgcggccgcuacuucgacuucuggggccgcggcaccggccuccgcgucuccaccucc

SEQ ID NO: 19803 - RNA, 399 nt, Artificial Sequence
  derived and/or modified sequence opt2 from anti-HIV_Chain
gagguccagcucguccaguccggcggcggccucgucaagcccggcggcucccuccgccucuccugcgccgccuccggcuucaccuucaagaacgccuggauguccuggguccgccaggcccccggcaagggccucgagugggucggccacaucaaguccaagaccgacggcggcaccaucgacuacgccgcccccgucaagggccgcuucaccaucucccgcgacgacuccaagaacacccucuaccuccagaugaacucccucaagaucgaggacaccgccgucuacuacugcaccaccgacaucggcuccggccgcggcugggacuuccacuacuacgacuccaacgacuggggccagggcacccucgucaccgucuccuccgccuccaccaagggc

SEQ ID NO: 19804 - RNA, 399 nt, Artificial Sequence
  derived and/or modified sequence opt2 from anti-HIV_Chain
cagguccagcucgucgaguccggcggcggcgucguccagcccggccgcucccuccgccucuucugcgccgccuccggcuucgccuucaacaccuacggcaugcacuggguccgccaggcccccggcaagggccucgagugggucgccgucaccuggcacgacggcucccagaaguacuacgccgacuccgucaagggccgcuucaccaucucccgcgacaacuccaagaacacccucuaccuccagaugaacucccuccgcgccgaggacaccgccaucuacuacugcgccuccgaccagggcggcuucgacgacuccuccggcuacuucgcccccggcggcauggacgucuggggccgcggcaccaccgucaucgucuccuccgcccccaccaagggc

SEQ ID NO: 19805 - RNA, 399 nt, Artificial Sequence
  derived and/or modified sequence opt2 from anti-HIV_Chain
ggcuacuccgagguccagcucguccaguccggccccggccucgucaagcccucccagacccucucccucaccugcaccgucuccggcggcuccaucuccaacggcggccacuacuggaacuggauccgccagcaccccggcaagggccucgaguggaucggccacaucuacaacaucgccaccaccuacuacaaccccucccucaagucccgcgucuccaucuccgucgacaccuccaagaaccaguucucccucaagcucuccuccgucaccgccgccgacaccgccgucuacuacugcgcccgcggcuccggccgcuggaccaucggcgcccgcaucuacuucgacaacuggggccagggcgcccucgucgccgucuccuccgccuccaccaagggc

SEQ ID NO: 19806 - RNA, 399 nt, Artificial Sequence
  derived and/or modified sequence opt2 from anti-HIV_Chain
cagcuccagcucaaggaguccggccccggcauggucaagcccuccgagacccucucccucaccugcuccgucuccggcgccuccgucgucuccgccaacgacuacuggggcuggauccgccaggcccccggcaagggccucgagugcaucggcaucauccucuacaccggcuccaccuucuacaaccccucccuccagucccgcgucaccaucucccgcgaccccuccaagaaccacgucucccucacccucaccuccgucaccgccgccgacuccgccgucuacuacugcgcccgcauccccuaccacuccgaguccuacuacaacgucgucaucggcggcuucgacgucuggggccagggcacccgcgucaccgucuccuccgccuccaccaagggc

SEQ ID NO: 19807 - RNA, 399 nt, Artificial Sequence
  derived and/or modified sequence opt2 from anti-HIV_Chain
ugccagguccagcucgucgaguccggcggcggcgucguccagcccggccgcucccuccgccucuccugcgucggcuccggcuucaccuucuccuccuccggcaugcacuggguccgccaggcccccggcaagggccucgagugggucgccgucaucuccuccgacggcuccgacgaguacuacggcgacuccgucgagggccgcuucaccaucucccgcgacaacuccaagaacacccucuuccuccagcucgacucccucgaggccgaggacuccgccgucuacuacugcgccaagacccccccccacuacgacgcccucaccggcuaccccuccuccguccucgaguucuggggccucggcacccucgucaccgucuccuccgccuccaccaagggc

SEQ ID NO: 19808 - RNA, 399 nt, Artificial Sequence
  derived and/or modified sequence opt2 from anti-HIV_Chain
cagguccagcucguccaguccggcgccgacgucaagaagcccggcgccuccgucaaggucuccugcaaggucuccggcuacaccgucuccgagcucuccauccacuggguccgccaggcccccggcaagggccucgaguggaugggcggcuucgaccccgaggacggcaagaccgucuccgcccagaacuuccagggccgcgucaccaugaccgaggacaaguccaccggcaccgccaacauggagcuccgcucccuccgcuccgaggacaccgccgucuacuacugcgccaccaccguccagcucaucgucgacuucugcaacggcggccccugcuacaacuucgacgacuggggccagggcacccucgucaccgucuccuccgccuccaccaagggc

SEQ ID NO: 19809 - RNA, 399 nt, Artificial Sequence
  derived and/or modified sequence opt2 from anti-HIV_Chain
ggccucgaccucgagcacgacggccaccacaaggaggagccccgcgccuccgucaccgucuccugcgaggccuccggcuacaacuucgucaacuacaucauccacuggguccgccucacccccggccgcggcuucgaguggaugggcaugaucgacccccgccgcggccgccccugguccgcccagaaguuccagggccgccucacccucacccgcgacaucgacuccgagcgccucuacaugcagcucuccggccuccgcggcgacgacaccgccgucuacuucugcgcccgccaggagcccgacuuccacgacggccacggccacacccuccgcggcauguucgacuccuggggccagggcucccccgucuccgucuccuccgccuccaccaagggc

SEQ ID NO: 19810 - RNA, 399 nt, Artificial Sequence
  derived and/or modified sequence opt2 from anti-HIV_Chain
cagguccgccucguccaguccggcgcccagcucaagaagcccggcgccuccgucaccgucuccugcgaggccuccggcuacaacuucgucaacuacaucaucaacuggguccgccagacccccggccgcuccuucgagugggucggcaugaucgacccccgccgcggccgccccugguccgcccagaaguuccagggccgccucacccucacccgcgacaucgacuccgagaagcucuacaugcaccucuccggccuccgcggcgacgacaccgccgucuacuacugcgcccgccaggacuccgacuuccacgacggccacggccacacccuccgcggcauguucgacuccuggggccagggcucccccgucaccgucuccuccgccuccaccaagggc

SEQ ID NO: 19811 - RNA, 399 nt, Artificial Sequence
  derived and/or modified sequence opt2 from anti-HIV_Chain
cagguccgccucucccaguccggcgccgccgucgucaagaccggcgccuccgucaccaucuccugcgagaccgagggcuacaccuucgucaacuacaucauccacuggguccgccagccccccggccgcggcuucgaguggcucggcaugaucgacccccgcaacggccaccccugguucggccagcgcuuccgcggccgccucucccuccgccgcgaccgcuccaccgagaccgucuucaugacccucuccggccucaccuccgacgacaacggcaucuacuucugcgcccgcaacgagccccaguacuacgacggcuccggccacucccuccccggcauguucgacuacuggggccagggcacccgcgucgucgucuccuccgccuccaccaagggc

SEQ ID NO: 19812 - RNA, 399 nt, Artificial Sequence
  derived and/or modified sequence opt2 from anti-HIV_Chain
cagguccgccucucccaguccggcgccgccgucaugaagaccggcgccuccgucaccaucuccugcgagaccgagggcuacaacuucgucaacuacaucauccacuggguccgccgcccccccggccgcggcuucgaguggcucggcaugaucgaccccaagaacggccaccccugguucgcccaggccguccgcggccgccucucccuccgccgcgacaccuucaacgaggucgucuacaugacccucuccggccucaccuccgacgacaccggccucuacuucugcgcccgcaacgagccccaguaccacgacggcaacggccacucccuccccggcauguucgacuucuggggccagggcacccucgucaccgucuccuccgccuccaccaagggc

SEQ ID NO: 19813 - RNA, 399 nt, Artificial Sequence
  derived and/or modified sequence opt2 from anti-HIV_Chain
cagguccgccucucccaguccggcgccgccgucgucaagaccggcgccuccgucaccaucuccugcgagaccgagggcuacaccuucgucaacuacaucauccacuggguccgccagccccccggccgcggcuucgaguggcucggcaugaucgacccccgcaacggccaccccugguucggccagcgccuccagggccgccucucccuccgccgcgaccgcuccaccgagaccgucuucaugacccucuccggccucaccuccgacgacaccggcaucuacuucugcgcccgcaacgagccccaguacuacgacggcuccggccacucccuccccggcauguucgacuacuggggccagggcacccgcgucgucgucuccuccgccuccaccaagggc

SEQ ID NO: 19814 - RNA, 399 nt, Artificial Sequence
  derived and/or modified sequence opt2 from anti-HIV_Chain
cagguccgccucucccaguccggcgccgccgucgucaagaccggcgccuccgucaccaucuccugcgagaccgagggcuacaccuucgucaaccacaucauccacuggguccgccagccccccggccgcggcuucgaguggcucggcaugaucgacccccgcaacggccaccccugguucggccagcgccuccgcggccgccucucccuccgccgcgaccgcuccaccgagaccgucuucaugacccucuccggccucaccuccgacgacaucggcaucuacuucugcgcccgcaacgagccccaguacuucgacggcuccggccacucccuccccggcauguucgacuacuggggccagggcacccgcgucgucgucuccuccgccuccaccaagggc

SEQ ID NO: 19815 - RNA, 399 nt, Artificial Sequence
  derived and/or modified sequence opt2 from anti-HIV_Chain
cagguccaguucuuccaguccggcuccuccaugaagaaguccggcgccuccgucaccaucuccugcgaggccaccggcuacaacaucaagaaccacauccuccacuggguccgccagaagcccggccgcggcuucgagugggucggcaugaucgaccccaucaacggccgccccugguucggccaggccuuccgcggccgccucacccucacccgcgaccucuccaccgagaccuucuacaugucccucuccggccucaccuccgacgacaccgccaccuacuucugcgcccgccgcgaggccgacuaccacgacggcaacggccacacccuccccggcauguucgacuucuggggccccggcacccucgucaccgucuccuccgccuccaccaagggc

SEQ ID NO: 19816 - RNA, 399 nt, Artificial Sequence
  derived and/or modified sequence opt2 from anti-HIV_Chain
cagguccgccucucccaguccggcgccgccgucgucaagaccggcgccuccgucaccaucuccugcgagaccgagggcuacaccuucgucaacuacaucauccacuggguccgccagucccccggccgcggcuucgaguggcucggcaugaucgacccccgcaacggccaccccugguucggccagcgccuccgcggccgccucucccuccgccgcgaccgcuccaccgagaccgucuucaugacccucuccggccucaccuccgacgacaccgccaucuacuucugcgcccgcaacgagccccaguacuacgacggcuccggccacucccuccccggcauguucgacuacuggggccagggcacccgcgucgucgucuccuccgccuccaccaagggc

SEQ ID NO: 19817 - RNA, 399 nt, Artificial Sequence
  derived and/or modified sequence opt2 from anti-HIV_Chain
cagguccgccucucccaguccggcgccgccaugaagaagcccggcgccuccgucaccaucuccugcgagaccgagggcuacaccuucaucaacuacaucauccacuggguccgccagccccccggccgcggcuucgaguggcucggcaugaucgacccccgcaacggccgccccugguucggccaguccguccagggccgccucucccuccgccgcgacaccuacaccgaggucgucuacaugacccucuccggccucaccuccgacgacgccggccucuacuucugcgcccgcaacgagccccaguaccacgacggcaacggccacucccuccccggcauguucgacuacuggggccagggcacccucgucgccgucuccuccgccuccaccaagggc

SEQ ID NO: 19818 - RNA, 399 nt, Artificial Sequence
  derived and/or modified sequence opt2 from anti-HIV_Chain
cagguccgccucguccaguccggcgcccagcucaagaagcccggcgccuccgucaccgucuccugcgaggccuccggcuacaacuucgucaacuacaucaucaacuggguccgccagacccccggccgcggcuucgagugggucggcaugaucgacccccgccgcggccgccccugguccgcccagaaguuccagggccgccucacccucacccgcgacaucgacuccgagaagcucuacaugcaccucuccggccuccgcggcgacgacaccgccgucuacuacugcgcccgccaggacuccgacuuccacgacggccacggccacacccuccgcggcauguucgacuccuggggccagggcucccccgucaccgucuccuccgccuccaccaagggc

SEQ ID NO: 19819 - RNA, 399 nt, Artificial Sequence
  derived and/or modified sequence opt2 from anti-HIV_Chain
cagguccacaccuuccaguccggcuccuccaugaagaaguccggcgccuccgucaccaucuccugcgaggccaccggcuacaacaucaagaacuacauccuccacuggguccgccagaagcccggccgcggcuucgagugggucggcaugaucgaccccaucaacggccgccccugguucggccagcccuuccgcggccgccucacccucacccgcgaccucuccaccgagaccuucuacaugucccucuccggccucaccuccgacgacaccgccaccuacuucugcgcccgccgcgaggccgacuaccacgacggcaacggccacacccuccccggcauguucgacuucuggggccccggcacccucaucaccgucuccuccgccuccaccaagggc

SEQ ID NO: 19820 - RNA, 399 nt, Artificial Sequence
  derived and/or modified sequence opt2 from anti-HIV_Chain
cagguccgccucuuccaguccggcgccgccaugaagaagcccggcgccuccgucaccaucuccugcgaggccuccggcuacaacuucaugaacuacuucguccacuggguccgccagcgccccggccgcggcuucgaguggcucggcaugaucaacccccgcggcggccgccccugguccgcccaguccguccagggccgccucacccucacccgcgacaucuccaccgagauguucuacaugcgccucgacggccuccgcuccgacgacaccgccaccuacuucugcgcccgcaacgaggccgacuaccacgacggcaacggccacucccuccgcggcauguucgacuacuggggccagggcucccucaucaccgucuccuccgccuccaccaagggc

SEQ ID NO: 19821 - RNA, 399 nt, Artificial Sequence
  derived and/or modified sequence opt2 from anti-HIV_Chain
cagguccagcucuuccaguccggcgccgccaugcgcaagcccggcgccuccgucaccaucuccugcgaggccuccggcuacaacuucaugaacuacuucguccacuggguccgccagcgccccggccgcggcuucgaguggcucggcaugaucaacccccgcggcggccgccccugguccgcccaguccguccagggccgccucacccucacccgcgacaccuccaccgagauguucuacaugcgccucgacggccuccgcuccgacgacaccgccaccuacuucugcgcccgcaacgaggccgacuaccacgacggcaacggccacucccuccgcggcauguucgacuacuggggccagggcucccucaucaccgucuccuccgccuccaccaagggc

SEQ ID NO: 19822 - RNA, 399 nt, Artificial Sequence
  derived and/or modified sequence opt2 from anti-HIV_Chain
cagguccgccucucccaguccggcgccgccaucaagaagcccggcgccuccgucaccaucuccugcgagaccgagggcuacaccuucaucaacuacaucauccacuggguccgccagccccccggccgcggcuucgaguggcucggcaugaucgacccccgcaacggccgccccugguucggccaguccguccagggccgccucucccuccgccgcgacaccuacaccgaggucgucuacaugacccucuccggccucaccuccgacgacaccggccucuacuucugcgcccgcaacgagccccaguaccacgacggcaacggccacucccuccccggcauguucgacuccuggggccagggcacccucgucgccgucuccuccgccuccaccaagggc

SEQ ID NO: 19823 - RNA, 399 nt, Artificial Sequence
  derived and/or modified sequence opt2 from anti-HIV_Chain
cagguccgccucuuccaguccggcgccgccaugcgcaagcccggcgccuccgucaccaucuccugcgaggccuccggcuacaacuuccucaacuacuucguccacuggguccgccagcgccccggccgcggcuucgaguggcucggcaugaucaacccccgcggcggccgccccugguccgcccaguccguccagggccgccucacccucacccgcgacaccuccaccgagauguucuacaugcgccucgacggccuccgcuccgacgacaccgccaccuacuucugcgcccgcaacgaggccgacuaccacgacggcaacggccacucccuccgcggcauguucgacuacuggggccagggcucccucaucaccgucuccuccgccuccaccaagggc

SEQ ID NO: 19824 - RNA, 399 nt, Artificial Sequence
  derived and/or modified sequence opt2 from anti-HIV_Chain
cagguccgccucucccaguccggcgccgccgucaagaagcccggcgccuccgucaccaucgucugcgagaccgagggcuacaacuucaucgacuacaucauccacuggguccgccagccccccggccgcggcuucgaguggcucggcaugaucgacccccgcaacggccgccccugguccggccagaagguccacggccgccucucccucuggcgcgacaccuccaccgagaaggucuacaugacccucaccggccucaccuccgacgacaccggccucuacuucugcggccgcaacgagccccaguaccacgacgacaacggccacucccuccccggcaugaucgacuacuggggccagggcaccauggucaccgucuccuccgccuccaccaagggc

SEQ ID NO: 19825 - RNA, 399 nt, Artificial Sequence
  derived and/or modified sequence opt2 from anti-HIV_Chain
cagguccgccucucccaguccggcgccgccaucaagaagcccggcgccuccgucaccaucuccugcgagaccgagggcuacaccuucaucaacuacaucauccacuggguccgccagccccccggccgcggcuucgaguggcucggcaugaucgacccccgcaacggccgccccugguucggccaguccguccagggccgccucucccuccgccgcgacaccuacaccgaggucgucuacaugacccucuccggccucaccuccgacgacgccggccacuacuucugcgcccgcaacgagccccaguaccacgacggcaacggccacucccuccccggcauguucgacuacuggggccagggcacccucgucgccgucuccuccgccuccaccaagggc

SEQ ID NO: 19826 - RNA, 399 nt, Artificial Sequence
  derived and/or modified sequence opt2 from anti-HIV_Chain
cagguccgccucuuccaguccggcgccgccaugcgcaagcccggcgccuccgucaccaucuccugcgaggccuccggcuacaacuucaugaacuacuucguccacuggguccgccagcgccccggccgcggcuucgaguggcucggcaugaucaacccccgcggcggccgccccugguccgcccaguccguccagggccgccucacccucacccgcgacaccuccaccgagauguucuacaugcgccucgacggccuccgcuccgacgacaccgccaccuacuucugcgcccgcaacgaggccgacuaccacgacggcaacggccacucccuccgcggcauguucgacuacuggggccagggcucccucaucaccgucuccuccgccuccaccaagggc

SEQ ID NO: 19827 - RNA, 399 nt, Artificial Sequence
  derived and/or modified sequence opt2 from anti-HIV_LightChain
augaagcuccccguccgccuccucguccucauguucuggauccccgccuccuccuccgacaucgucaugacccaguccccccucucccuccccgucacccccggcgagcccgccuccaucuccugccgcuccucccagcgccuccucuccuccuacggccacaccuaccuccacugguaccuccagaagcccggccaguccccccagcuccucaucuacgaggucuccaaccgcuucuccggcguccccgaccgcuucuccggcuccggcuccggcaccgacuucacccucaagaucucccgcgucgaggccgaggacgucggcgucuacuacugcucccaguccacccacgucccccucaccuucggccagggcaccaaggucgagaucaagcgcaag

SEQ ID NO: 19828 - RNA, 402 nt, Artificial Sequence
  derived and/or modified sequence opt2 from anti-HIV_Chain
cagcccuacaucguccaguccggccccgccgucaagggcgccggcuccuccgucaccgucaccugcaaggucgacggcgacgacgacggcaucuucuccuucggcaccuacuucauggucuggguccgccaggcccccggccagggccuccaguacaugggcggccucguccccuccuacgcccccaccuacgcccacaaguucgagggccgcaucaccaucuccgccgccggcaccccccccgucgucucccucacccuccucaaccucaccaacgacgacgccgccaccuacuucugcgcccgcgagcgcggccgccacuacgacuccaagacccgcgagaaccgccgcggccgcuacuucgacauguggggccgcggcacccgcaucaccgucuccccc

SEQ ID NO: 19829 - RNA, 402 nt, Artificial Sequence
  derived and/or modified sequence opt2 from anti-HIV_Chain
cagcccuacaucguccaguccggccccgccgucaagggcgccggcuccuccgucaccgucaccugccgcgucgacggcgacgacgacggcaucuucaacuucggcaccuacuucauggucuggguccgccaggcccccggccagggccuccaguacaugggcggccucguccccuccuacgcccccaccuacgcccacaaguucgagggccgcaucaccaucuccgccgccggcaccccccccgucgucucccucacccucaucaaccucaccaacgccgacgccgccaccuacuucugcgcccgcgagcgcggccgccacuacgacuccaagacccgcgagaaccgccgcggccgcuacuucgacauguggggccgcggcacccgcaucaccgucuccccc

SEQ ID NO: 19830 - RNA, 402 nt, Artificial Sequence
  derived and/or modified sequence opt2 from anti-HIV_Chain
cgcguccacucccagguccagcucgucgaguccggccccggccucgucaagcccucccagacccucucccucaccugcaccgucuccggcggcuccaucuccaacggcggccacuacuggaacuggauccgccagcaccccggcaagggccucgaguggaucggccacaucuacaacaucgccaccaccuacuacaaccccucccucaagucccgcgucuccaucuccgucgacaccuccaagaaccaguucucccucaagcucuccuccgucaccgccgccgacaccgccgucuacuacugcgcccgcggcuccggccgcuggaccaucggcgcccgcaucuacuucgacaacuggggccagggcgcccucgucgccgucuccuccgccuccaccaagggc

SEQ ID NO: 19831 - RNA, 402 nt, Artificial Sequence
  derived and/or modified sequence opt2 from anti-HIV_Chain
uccgucgacgagcgccuccucgaguucggcggccgccucguccagcccggcggcucccuccgccucuccugcuccgccuccggcuucaccuucuccaacuccgccauguccuggguccgccaggcccccggcaagggccucgagugggucuccuccauccucuccuccggcgucggcaccuucuacgccgacuccgucaagggccgcuucaccgucucccgcgacaacucccgcaacacccucuaccuccagaugaagucccuccgcgccgaggacaccgcccucuacuacugcgccaagguccagauccagcagcucaacuucggcgucaucaccgacgccggccucgacgucuggggcaagggcaccacccucaucgucuccuccgccuccaccaagggc

SEQ ID NO: 19832 - RNA, 402 nt, Artificial Sequence
  derived and/or modified sequence opt2 from anti-HIV_Chain
guccagucccaggucuaccucguccaguccggcggcgaggucaagaagcccggcuccuccgucaaggucuccugcaaggccuccggcgacuccuucuccuccuccgucaucaccuggguccgccaggcccccggccagggccccgaguggaugggccgcaucauccccguccucggcgucgccgccuacgcccagaacuucuacggccgcgucaccaucuccgccgacaccuccuccaacaccgccuacauggagcucuccucccuccgcuucgaggacaccgccgucuucuacugcgcccgcgagaccggccgcggcggcaaccucgcccuccgccaguacuucuucgacuccuggggccagggcacccucgucaccgucuccucccccuccaccaagggc

SEQ ID NO: 19833 - RNA, 402 nt, Artificial Sequence
  derived and/or modified sequence opt2 from anti-HIV_Chain
cagcuccagcuccaggaguccggccccggccucgucaagcccuccgagacccucucccucaccugcuccgucuccgacggcuccaucaacuccaacuccuacuacugggccuggauccgccagucccccggcaagggccucgaguggaucggcuccgucuacuacuucggcggcaccuacuacucccccucccucaagucccgcgucaccauguccgucgaccgcuccaagaaccaguucucccucaacgucuccuccgucaccgccgccgacaccgccaucuacuacugcgcccgccacguccgccccuacgaccgcuccggcuaccccgagcgccccaacugguucgaccccuggggccgcggcacccucgucaccgucuccuccgccuccaccaagggc

SEQ ID NO: 19834 - RNA, 402 nt, Artificial Sequence
  derived and/or modified sequence opt2 from anti-HIV_Chain
cagguccagcuccaccaguggggcgccggccuccucaagcccuccgacacccucucccucaccugcggcauccucggcgucuccccccccggcucccucaccggcuacuacuggaccuggauccgccagccccccggcaagggccucgaguggaucggcgaggucuaccacuccggcuccaccaacuacaaccccucccucgccucccgcgucaccaucuccaugggcaccaccaagacccaguucucccuccgccucaccuccgucaccgccgccgacuccgccgucuacuacugcgccuccggcaaggucuggggcaucaccgcccgcccccgcgacgccggccucgacgucuggggccagggcaccaccgucaccgucaccuccgccuccaccaagggc

SEQ ID NO: 19835 - RNA, 402 nt, Artificial Sequence
  derived and/or modified sequence opt2 from anti-HIV_Chain
cagguccagcucguccaguccggcgccgaggucaagaagcccggcuccuccgucaaggucuccugccgcgccuccggcggcuccuucggcaacuacgccaucaacuggguccgccaggcccccaugcagggccucgaguggaugggcggcaucauccccaucuucggcaccaccaacuacgcccagaacuuccgcggccgcgucaccaucaacgccgacaccuucaccaacaccgucaacauggaccucuccucccuccgcuccgaggacaccgccgucuacuacugcggccgcuccaucaacgccgccguccccggccucgagggcgucuacuacuacuacggcauggccgucuggggccagggcaccaccgucaccgucuccuccgccuccaccaagggc

SEQ ID NO: 19836 - RNA, 402 nt, Artificial Sequence
  derived and/or modified sequence opt2 from anti-HIV_Chain
uucguccagcucgucgaguccggcggcggccucguccagcccggcggcucccuccgccucuccugcgccgccuccggcuucaacuucaacaccuacuggaugaacuggguccgccaggcccccggcaagggccucgagugggucgccaacaugaaggaggacggcuccgagaaguacuacgucgacuccgucaagggccgcuucaccaucucccgcgacaacgccaagaacucccucuaccuccagaugaacucccuccgcgccgaggacaccgccgucuacuacugcgcccgcaaccccgagucccgcugcaucgucggccgcaaccgcggcuggugccgcuacuucgaccucuggggccgcggcucccucgucaccgucucccccgccuccaccaagggc

SEQ ID NO: 19837 - RNA, 405 nt, Artificial Sequence
  derived and/or modified sequence opt2 from anti-HIV_Chain
cagcuccagcucgaccagcccggcgccgccaugaagucccucggcuccucccucaccaucaccugccgcgucuccggcgacgaccucggcuccuuccacuucggcaccuacuucaugaucuggguccgccagggccccggccagggccucgaguacaugggcggcauccuccccuccaccaagacccccaccuacgcccacaaguuccgcggccgcgucuccaucuccgcccccggcgucccccccguccucucccucgcccucaccaaccucaccuacgacgacaccgccaccuacuucugcgcccgcgagcgcggccgccacuucgagcccaagaaccgcgaccaccucgagggcaaguuccucgaccucuggggccgcggcaccuucguccgcgucuccccc

SEQ ID NO: 19838 - RNA, 405 nt, Artificial Sequence
  derived and/or modified sequence opt2 from anti-HIV_Chain
cagguccagcucguccagcccggcaccgccaugaagucccucggcuccucccucaccaucaccugccgcgucuccggcgacgaccucggcuccuuccacuucggcaccuacuucaugaucuggguccgccaggcccccggccagggccucgaguacaugggcggcauccuccccuccaccaagacccccaccuacgcccacaaguuccgcggccgcgucuccaucuccgcccccggcgucccccccguccucucccucgcccucaccaaccucaccuacgacgacaccgccaccuacuucugcgcccgcgagcgcggccgccacuucgagcccaagaaccgcgacaaccucgagggcaaguucuucgaccucuggggccgcggcaccuucguccgcgucuccccc

SEQ ID NO: 19839 - RNA, 405 nt, Artificial Sequence
  derived and/or modified sequence opt2 from anti-HIV_Chain
cagguccagcucguccagcccggcaccgccaugaagacccucggcuccucccucaccaucuccugccgcgucuccggcgacgacggcaacuuccacuucggcaccuacuucauggccuggguccgccagguccccggccagggccucgaguacaugggcggcauccuccccuccaccaagucccccaccuacgcccacaaguuccgcggccgcgucuccaucuccaccgccggcgucccccccgucgucucccucgcccucaccaaccucaccuacgacgacaccgccaccuacuucugcgcccgcgagcgcggccgccacuacgacuccaagaagcaggagaacuaccgcggcaaguucuucgaccucuggggccgcggcaccuggguccgcgucucccccacc

SEQ ID NO: 19840 - RNA, 405 nt, Artificial Sequence
  derived and/or modified sequence opt2 from anti-HIV_Chain
caccucguccaguccggcaccgaggucaagaagcccggcuccuccgucaccgucuccugcaaggccuacggcgucaacaccuucggccucuacgccgucaacuggguccgccaggcccccggccagucccucgaguacaucggccagaucuggcgcuggaaguccuccgccucccaccacuuccgcggccgcguccucaucuccgccgucgaccucaccggcuccuccccccccaucuccucccucgagaucaagaaccucaccuccgacgacaccgccgucuacuucugcaccaccaccuccaccuacgaccagugguccggccuccaccacgacggcgucauggccuucuccuccuggggccagggcacccucaucuccgucuccgccgccuccaccaagggc

SEQ ID NO: 19841 - RNA, 405 nt, Artificial Sequence
  derived and/or modified sequence opt2 from anti-HIV_Chain
cagguccagcucguccaguccggcgccgaggucaagaagcccggcuccuccgucaaggucuccugcaaggccuccggcggcaccuucuccaccuacgccuucuccuggguccgccaggcccccaucgagggccucgaguggaugggcggcaucauccccaucuucggcaccgagaacuacgcccagaaguuccagggccgcgucaccaucaccgccgacaaguccaccuccaccgccuacauggagcucuccucccuccgcuccgaggacaccgccgucuacuacugcgcccgcgaccgcuccuccgccaucggcuacugcuccuccaucuccugcuacaagggcuccuucgacaucuggggccagggcaccauggucaccgucuccuccgccuccaccaagggc

SEQ ID NO: 19842 - RNA, 405 nt, Artificial Sequence
  derived and/or modified sequence opt2 from anti-HIV_Chain
cagguccagcucguccaguccggcgccgaggucaagaagcccggcuccuccgucaaggucuccugcaaggccuccggcggcaccuucuccaccuacgccuucuccuggguccgccaggcccccggccagggccucgaguggaugggcggcaucauccccaucuucggcaccgagaacuacgcccagaaguuccagggccgcgucaccaucaccgccgacaaguccaccuccaccgccuacauggagcucuccucccuccgcuccgaggacaccgccgucuacuacugcgcccgcgaccgcuccuccgccaucggcuacugcuccuccaucuccugcuacaagggcuccuucgacaucuggggccagggcaccauggucaccgucuccuccgccuccaccaagggc

SEQ ID NO: 19843 - RNA, 405 nt, Artificial Sequence
  derived and/or modified sequence opt2 from anti-HIV_Chain
gagguccagcucgucgaguccggcggcggccucguccagcccggcggcucccuccgccucuccugcgccgccuccggcuucaccuucuccuccuacuccaugaacuggguccgccaggcccccggcaagggccucgagugggucuccuacaucuccggcuccuccuacaccaucuacuacgccgacuccguccgcggccgcuucaccaucucccgcgacaacgccaagaacucccucuaccuccagaugaacucccuccgcgacgaggacaccgccgucuacuucugcgcccgcgccaccccccccaacccccucaaccucuacaacuacgacuccuccggcuccuccuucgacuacuggggccagggcacccucgucaccgucuccuccgccuccaccaagggc

SEQ ID NO: 19844 - RNA, 405 nt, Artificial Sequence
  derived and/or modified sequence opt2 from anti-HIV_Chain
gagguccagcucguccaguccggcgccgaggucaagaagcccggcuccuccgucaaggucuccugcaaggccuccggcggcaccuucuccaccuacgccuucuccuggguccgccaggcccccggccagggccucgaguggaugggcggcaucauccccaucuucggcaccgagaacuacgcccagaaguuccagggccgcgucaccaucaccgccgacaaguccaccuccaccgccuacauggagcucuccucccuccgcuccgaggacaccgccgucuacuacugcgcccgcgaccgcuccuccgccaucggcuacugcuccuccaucuccugcuacaagggcuccuucgacaucuggggccagggcaccauggucaccgucuccuccgccuccaccaagggc

SEQ ID NO: 19845 - RNA, 405 nt, Artificial Sequence
  derived and/or modified sequence opt2 from anti-HIV_Chain
gagguccagcucgucgaguccggcgccgaggucaagaagcccggcuccuccgucaaggucuccugcaaggccuccggcggcaccuucuccaccuacgccuucuccuggguccgccaggcccccggccagggccucgaguggaugggcggcaucauccccaucuucggcaccgagaacuacgcccagaaguuccagggccgcgucaccaucaccgccgacaaguccaccuccaccgccuacauggagcucuccucccuccgcuccgaggacaccgccgucuacuacugcgcccgcgaccgcuccuccgccaucggcuacugcuccuccaucuccugcuacaagggcuccuucgacaucuggggccagggcaccauggucaccgucuccuccgccuccaccaagggc

SEQ ID NO: 19846 - RNA, 405 nt, Artificial Sequence
  derived and/or modified sequence opt2 from anti-HIV_Chain
ccccucguccagcucgagcccuccggcgucgaggucaagaagcgcggcgccuccgucaaggucuccugcaaggucuccggcuacucccucaccgagcucuccaugcacuggguccgccaggcccccggcaagggccucgaguggaugggcuccuucgacccccucgacggcgacaccaucuacgcccagaaguuccagggccgcgucaccaugaccgucgacaccuccaccgacaccgccuacauggaccucuccucccuccgcuucgaggacaccgccgucuacuacugcgccacccccuccaaggccuacuacuacgacucccccaacuacgagggcgacuucuacauggacgucuggggcaagggcaccaccgucaucgucuccuccgccuccaccaagggc

SEQ ID NO: 19847 - RNA, 408 nt, Artificial Sequence
  derived and/or modified sequence opt2 from anti-HIV_HeavyChain
cagauccaccucguccaguccggcaccgaggucaagaagcccggcuccuccgucaccgucuccugcaaggccuacggcgucaacaccuucggccucuacgccgucaacuggguccgccaggcccccggccagucccucgaguacaucggccagaucuggcgcuggaaguccuccgccucccaccacuuccgcggccgcguccucaucuccgccgucgaccucaccggcuccuccccccccaucuccucccucgagaucaagcucaccuccgacgacaccgccgucuacuucugcaccaccaccuccaccuacgacaagugguccggccuccaccacgacggcgucauggccuucuccucccgcggccagggcacccucaucuccgucuccgccgccuccaccaagggc

SEQ ID NO: 19848 - RNA, 408 nt, Artificial Sequence
  derived and/or modified sequence opt2 from anti-HIV_HeavyChain
cagauccaccucguccaguccggcaccgaggucaagaagcccggcuccuccgucaccgucuccugcaaggccuacggcgucaacaccuucggccucuacgccgucaacuggguccgccaggcccccggccagggccucgaguacaucggccagaucuggcgcuggaaguccuccgccucccaccacuuccgcggccgcguccucaucuccgccgucgaccucaccggcuccuccccccccaucuccucccucgagaucaaggucaccuccgacgacaccgccgucuacuucugcaccaccaccuccaccuacgacgagugguccgaccuccaccacgacggcgucauggccuucuccuccuggggccagggcacccucaucuccgucuccgccgccuccaccaagggc

SEQ ID NO: 19849 - RNA, 408 nt, Artificial Sequence
  derived and/or modified sequence opt2 from anti-HIV_HeavyChain
cagauccaccucguccaguccggcaccgaggucaagaagcccggcuccuccgucaccgucuccugcaaggccuacggcgucaacaccuucggccucuacgccgucaacuggguccgccaggcccccggccagucccucgaguacaucggccagaucuggcgcuggaaguccuccgccucccaccacuuccgcggccgcguccucaucuccgccgucgaccucaccggcuccuccccccccaucuccucccucgagaucaagcucaccuccgacgacaccgccgucuacuucugcaccaccaccuccaccuacgaccgcugguccggccuccaccacgacggcgucauggccuucuccuccuggggccagggcacccucaucuccgucuccgccgccuccaccaagggc

SEQ ID NO: 19850 - RNA, 408 nt, Artificial Sequence
  derived and/or modified sequence opt2 from anti-HIV_Chain
ugcaacccccgcguccacuccgagguccagcucgucgaguccggcgccgaggucaagaagcccggcgccuccgucaaggucgccugcaaggucuccggcaagaagcucuccgaccucuccauccacuggguccgccaggcccccggcaagggccucgaguggaugggcggcuucgacgaggaggacggcaagaucuccuacgagcgcaaguuccagggccgcgucuccaugaccgaggacaccgcccgcgacaccgccuucauggagauguccucccuccgcuccgacgacaccgccgucuacuucugcgccgccgccccccgccucgaccucggcgagcucuccuccggcuuccacuucuggggccucggcacccucgucaccgucuccuccgccuccaccaagggc

SEQ ID NO: 19851 - RNA, 408 nt, Artificial Sequence
  derived and/or modified sequence opt2 from anti-HIV_Chain
aucugggccccccucaucgccgucaccuuccucguccuccacugcgagucccucggcaccugcugcugcugccaggccuccggcggcaccuucaacaccuucgccaucaacuggguccgccaggcccccggccagggccucgagugggucggcggcaucauccccgucuucggcaccgccuccuacgcccagaaguuccagggccgcgucaccgucaccaccgacgagucccgcggcaccgccuacauggagcucaacucccuccgcuccgaggacaccgccgucuacuacugcgcccgcggccagaccgaccucaacgacgaccucugguccgacuacuccacccccggcuucgacuacuggggccagggcacccucgucaccgucuccuccgccuccaccaagggc

SEQ ID NO: 19852 - RNA, 408 nt, Artificial Sequence
  derived and/or modified sequence opt2 from anti-HIV_Chain
cuccagccccgcguccacuccgagguccagcucgucgaguccggcgccgaggucaagaagcccggcgccuccgucaaggucuccugcaaggucuccggcuacacccucuccgaccucuccaugcacuggguccgccaggcccccggcaagggccucgaguggaugggcggcuucgacgaggaggacggcgagaucaccuacgcccagaaguuccagggccgcgucuccaugaccgaggacaccucccgcgacaccgccuacauggagcucuccucccuccgcuccgaggacaccgccgucuacuacugcgccaccgccccccgccucgagcucggcgagcucuccuccggcuuccacuacuggggccucggcacccucgucaccgucuccuccgccuccaccaagggc

SEQ ID NO: 19853 - RNA, 408 nt, Artificial Sequence
  derived and/or modified sequence opt2 from anti-HIV_Chain
cagucccagguccaccucguccaguccggcgccgaggucaagaagcccggcuccuccgucaaggucuccugccaggccuccggcggcaccuucaacaccuucgccaucaacuggguccgccaggcccccggccagggccucgagugggucggcggcaucauccccgucuucggcaccgccuccuacgcccagaaguuccagggccgcgucaccgucaccaccgacgagucccgcggcaccgccuacauggagcucaacucccuccgcuccgaggacaccgccgucuacuacugcgcccgcggccagaccgaccucaacgacgaccucugguccgacuacuccacccccggcuucgacuacuggggccagggcacccucgucaccgucuccuccgccuccaccaagggc

SEQ ID NO: 19854 - RNA, 408 nt, Artificial Sequence
  derived and/or modified sequence opt2 from anti-HIV_Chain
ggcuccgagguccagcucgucgaguccggcgccgaggucaagaagcgcggcgccuccgucaaggucuccugcaaggucuccggcuacucccucaccgagcucuccaugcacuggguccgccaggcccccggcaagggccucgaguggaugggcuccuucgacccccucgacggcgacaccaucuacgcccagaaguuccagggccgcgucaccaugaccgucgacaccuccaccgacaccgccuacauggaccucuccucccuccgcuucgaggacaccgccgucuacuacugcgccacccccuccaaggccuacuacuacgacucccccaacuacgagggcgacuucuacauggacgucuggggcaagggcaccaccgucaucgucuccuccgccuccaccaagggc

SEQ ID NO: 19855 - RNA, 408 nt, Artificial Sequence
  derived and/or modified sequence opt2 from anti-HIV_Chain
cagguccagcucguccaguccggcggcgaggucaagaagcccggcgccuccgucaaggucuccugcaaggucuccggcuacucccucaccgagcucuccaugcacuggguccgccaggcccccggcaagggccucgaguggaugggcgucuucgacccccucgagggcgacggcgucuacguccagaaguuccgcggccgcgucaucaugaccgaggacaccuccaccgacaccgccuacauggagcucaccucccuccgcuccgaggacaccgccaucuacuacugcgccaccaaggccaaggacuacuacuacgaguccuccgacuacucccccuacuacuacuacuacauggacgucuggggcaagggcaccaccgucaccgucuccuccgccuccaccaagggc

SEQ ID NO: 19856 - RNA, 408 nt, Artificial Sequence
  derived and/or modified sequence opt2 from anti-HIV_Chain
gagguccagcucguccaguccggcgccgaggucaagaagcccggcgccuccgucaaggucuccugcaaggucuccggcuacacccucaccgagcucuccaugcacuggguccgccaggcccccggcaagggccucgaguggaugggcgucuucgacccccucgagggcgacggcgucuacgccgagaaguuccgcggccgcgucaucaugaccgaggacaccuccaccgacaccggcuacauggagcucaccucccuccgcuccgaggacaccgccaucuacuacugcgccaccaaggccaaggacuacuacuacgaguccuccgacuacucccccuacuacuacuacuacauggacgucuggggcaagggcaccaccgucaccgucuccuccgccuccaccaagggc

SEQ ID NO: 19857 - RNA, 408 nt, Artificial Sequence
  derived and/or modified sequence opt2 from anti-HIV_Chain
cagguccagcucguccaguccggcgccgaggucaagaagcccggcgccuccgucaaggucuccugcaaggccuccggcuacaccuucacccgcuaccacauccacuggguccgccacgcccccggccagggccucgaguggaugggcaagaucaaccccucccgcgccuccaccaaguacgccaagaaguuccaggaccgcgucaccaugacccgcgacaccuccaccuccaccgucuacauggagcucuccucccuccgcggcgacgacaccgccgucuacuacugcggccgcgagaugggcaccuucacccuccucggcgucgucaucgaccacuacgacuucuaccccauggacgucuggggccagggcacccccgucaccgucuccuccgccuccaccaagggc

SEQ ID NO: 19858 - RNA, 408 nt, Artificial Sequence
  derived and/or modified sequence opt2 from anti-HIV_Chain
ucccgcccccccuccugccuccucggcugcuggugcugcuccggcuuccuccuccccgccgucauccuccccaaccuccacucccccugccucucccuccucgagucccagccccccucccucgccgaccucgucuccgccuucgccgucauggacauccccaucuacaucggcaccuaccgcucccaggccucccuccacuccuccuccaccaaguuccccaccgacuuccucggcucccagaccggcuccgucgccgucggccagggccagaucucccaccuccgcuccgucgaguggcgccuccgcaugugggaguucaucaccgcccucaagguccacauguuccucucccgcuccgaccgcggcccccgcuggaagaacgucuccucccuccucaacucccgc

SEQ ID NO: 19859 - RNA, 411 nt, Artificial Sequence
  derived and/or modified sequence opt2 from anti-HIV_HeavyChain
cagauccaccucguccaguccggcaccgaggucaagaagcccggcuccuccgucaccgucuccugcaaggccuacggcgucaacaccuucggccucuacgccgucaacuggguccgccaggcccccggccagucccucgaguacaucggccagaucuggcgcuggaaguccuccgccucccaccacuuccgcggccgcgucaucaucuccgccgucgaccucaccggcuccuccccccccaucuccccccucgagaucaagaaccucaccuccgacgacaccgccgucuacuucugcaccaccaccuccaccuccgaccgcugguccggccuccaccacgacggcgucauggccuucuccuccuggggccagggcacccucaucuccgucuccgccgccuccaccaagggc

SEQ ID NO: 19860 - RNA, 411 nt, Artificial Sequence
  derived and/or modified sequence opt2 from anti-HIV_HeavyChain
cagauccaccucguccaguccggcaccgaggucaagaagcccggcuccuccgucaccgucuccugcaaggccuacggcgucaacaccuucggccucuacgccgucaacuggguccgccaggcccccggccagucccucgaguacaucggccagaucuggcgcuggaaguccuccgccucccaccacuuccgcggccgcgucaucaucuccgccgucgaccucaccggcuccuccccccccaucuccucccucgagaucaagaaccucaccuccgacgacaccgccgucuacuucugcaccaccgccuccaccuacgacaagugguccggccuccaccacgacggcgucauggccuucuccuccuggggccagggcacccucaucuccgucuccgccgccuccaccaagggc

SEQ ID NO: 19861 - RNA, 411 nt, Artificial Sequence
  derived and/or modified sequence opt2 from anti-HIV_HeavyChain
cagauccaccucguccaguccggcaccgaggucaagaagcccggcuccuccgucaccgucuccugcaaggccuacggcgucaacaccuucggccucuacgccgucaacuggguccgccaggcccccggccagucccucgaguacaucggccagaucuggcgcuggaaguccuccgccucccaccacuuccgcggccgcguccucaucuccgccgucgaccucaccggccccuccccccccaucuccucccucgagaucaagaaccucaccuccgacgacaccgccgucuacuucugcaccaccaccuccaccuacgacaagugguccggccuccaccacgacggcgucauggccuucuccuccuggggccagggcacccucaucuccgucuccgccgccuccaccaagggc

SEQ ID NO: 19862 - RNA, 411 nt, Artificial Sequence
  derived and/or modified sequence opt2 from anti-HIV_HeavyChain
cagauccaccucguccaguccggcaccgaggucaagaagcccggcuccuccgucgccgucuccugcaaggccuacggcgucaacaccuucggccucuacgccgucaacuggguccgccaggcccccggccagucccucgaguacaucggccagaucuggcgcuggaaguccuccgccucccacgacuuccgcggccgcgucaucaucuccgccgucgaccucaccggcuccuccccccccaucuccucccucgagaucaagaaccucaccuccgacgacaccgccgucuacuucugcaccgccaccuccacccccgacuacugguccggccuccaccacgacggcgucauggccuucuccuccuggggccagggcacccucaucuccgucuccgccgccuccaccaagggc

SEQ ID NO: 19863 - RNA, 411 nt, Artificial Sequence
  derived and/or modified sequence opt2 from anti-HIV_HeavyChain
cagauccaccucguccaguccggcaccggcgucaagaagcccggcuccuccgucaccgucuccugcaaggccuacggcgucaacaccuucggccucuacgccgucaacuggguccgccaggcccccggccagggccucgaguacaucggccagaucuggcgcuggaaguccuccgccucccaccacuuccgcggccgcguccucaucuccgccgucgaccucaccggcuccuccccccccaucaccucccucgagaucaagaacgucaccuccgacgacaccgccgucuacuucugcaccaccaccuccaccuacgacaagugguccggccucuaccacgacggcgucauggccuucuccuccuggggccagggcacccucaucuccgucuccgccgccuccaccaagggc

SEQ ID NO: 19864 - RNA, 411 nt, Artificial Sequence
  derived and/or modified sequence opt2 from anti-HIV_HeavyChain
cagauccaccucguccaguccggcaccgaggucaagaagcccggcuccuccgucaccgucuccugcaaggccuacggcgucaacaccuucggccucuacgccgucaacuggguccgccaggcccccggccagucccucgaguacaucggccagaucuggcgcuggaaguccuccgccucccaccacuuccgcggccgcgucaucaucuccgccgucgaccucaccggcuccuccccccccaucuccucccucgagaucaagaaccucaccuccgacgacaccgccgucuacuucugcaccaccaccuccaccuccgacuacugguccggccuccaccacgacggcgucauggccuucuccuccuggggccagggcacccucaucuccgucuccgccgccuccaccaagggc

SEQ ID NO: 19865 - RNA, 411 nt, Artificial Sequence
  derived and/or modified sequence opt2 from anti-HIV_HeavyChain
cagauccaccucguccaguccggcaccgaggucaagaagcccggcuccuccgucaccgucuccugcaaggccuacggcgucaacaccuucggccucuacgccgucaacuggguccgccaggcccccggccagucccucgaguacaucggccagaucuggcgcuggaaguccuccgccucccaccacuuccgcggccgcguccucaucuccgccgucgaccucaccggcuccuccccccccaucuccucccucgagaucaagaaccucaccuccgacgacaccgccgucuacuucugcaccaccaccuccaccuacgaccgcugguccggccuccaccacgacggcgucauggccuucuccuccuggggccagggcacccucaucuccgucuccgccgccuccaccaagggc

SEQ ID NO: 19866 - RNA, 411 nt, Artificial Sequence
  derived and/or modified sequence opt2 from anti-HIV_HeavyChain
cagauccaccucguccaguccggcaccgagguccgcaagcccggcuccuccgucaccgucuccugcaaggccuacggcgucaacaccuucggccucuacgccgucaacuggguccgccaggcccccggccagucccucgaguacaucggccagaucuggcgcuggaaguccuccgccucccaccacuuccgcggccgcguccucaucuccgccgucgaccucaccggcuccuccccccccaucuccucccucgagaucaagaaccucaccuccgacgacaccgccgucuacuucugcaccaccaccuccaccuacgacaagugguccggccuccaccacgacggcgucauggccuucuccuccuggggccagggcacccucaucuccgucuccgccgccuccaccaagggc

SEQ ID NO: 19867 - RNA, 411 nt, Artificial Sequence
  derived and/or modified sequence opt2 from anti-HIV_HeavyChain
cagauccaccucguccaguccggcaccgaggucaagaagcccggcuccuccgucaccgucuccugcaaggccuacggcgucaacaccuucggccucuacgccgucaacuggguccgccaggcccccggccagucccucgaguacaucggccagaucuggcgcuggaaguccuccgccucccaccacuuccgcggccgcguccucaucuccgccgucgaccucaccggcuccuccccccccaucuccucccucgagaucaagaaccucaccuccgacgacaccgccgucuacuucugcaccaccaccuccaccuacgaccagugguccggccuccaccacgacggcgucauggccuucuccuccuggggccagggcacccucaucuccgucuccgccgccuccaccaagggc

SEQ ID NO: 19868 - RNA, 411 nt, Artificial Sequence
  derived and/or modified sequence opt2 from anti-HIV_HeavyChain
cagauccaccucguccaguccggcaccgaggucaagaagcccggcuccuccgucaccgucuccugcaaggccuacggcgucaacaccuucggccucuacgccgucuccuggguccgccaggcccccggccagcgccucgaguacaucggccagauccgccgcuggaaguccuccgccucccaccacuuccgcggccgcgucaccgucuccgccgucgaccccaccggcuccuccccccccaucuccucccucgagauccgcgaccucaccaccgacgacaccgccgucuacuucugcaccaccaccuccaccuccgacuacugguccggccuccacaacgagcgcggcaccgccuucuccuccuggggccagggcacccucaucuccgucuccgccgccuccaccaagggc

SEQ ID NO: 19869 - RNA, 411 nt, Artificial Sequence
  derived and/or modified sequence opt2 from anti-HIV_HeavyChain
cagauccaccucguccaguccggcaccgaggucaagaagcccggcuccuccgucaccgucuccugcaaggccuacggcgucaacaccuucggccucuacgccgucaacuggguccgccaggcccccggccagggccucgaguacaucggccagaucuggcgcuggaaguccuccgccucccaccacuuccgcggccgcguccucaucuccgccaucgaccucaccggcuccuccccccccaucuccucccucgagaucaagaacgucaccuccgacgacaccgccgucuacuucugcaccaccauguccaccuacgacaagugguccggccuccaccacgacggcgucauggccuucuccuccuggggccagggcacccucaucuccgucuccgccgccuccaccaagggc

SEQ ID NO: 19870 - RNA, 411 nt, Artificial Sequence
  derived and/or modified sequence opt2 from anti-HIV_HeavyChain
cagauccaccucguccaguccggcaccgaggucaagaagcccggcuccuccgucaccgucuccugcaaggccuacgaggucaacaccuucggccucuacgccgucaacuggguccgccaggcccccggccagucccucgaguacaucggccagaucuggcgcuggaaguccuccgccucccaccacuuccgcggccgcguccucaucuccgccgucgaccucaccggcuccuccccccccaucuccucccucgagaucaagaacgucaccuccgacgacaccgccgucuacuucugcaccaccaccuccacccacgacaagugguccggccuccaccacgacggcgucauggccuucuccuccuggggccagggcacccucaucuccgucuccgccgccuccaccaagggc

SEQ ID NO: 19871 - RNA, 411 nt, Artificial Sequence
  derived and/or modified sequence opt2 from anti-HIV_HeavyChain
cagauccaccucguccaguccggcaccgaggucaagaagcccggcuccuccgucaccgucuccugcaaggccuacggcgucaacaccuucggccucuacgccgucaacuggguccgccaggcccccggccagggccucgaguacaucggccagaucuggcgcuggaaguccuccgccucccaccacuuccgcggccgcguccucaucuccgccgucgaccucaccggcuccuccccccccaucuccucccucgagaucaagaacgucaccuccgacgacaccgccgucuacuucugcaccaccaccuccaccuacgacaagugguccggccuccaccacgacggcgucgucgccuucuccuccuggggccagggcacccucaucuccgucuccgccgccuccaccaagggc

SEQ ID NO: 19872 - RNA, 411 nt, Artificial Sequence
  derived and/or modified sequence opt2 from anti-HIV_Chain
caggucacccucguccaguccggcgccgaggucaagaagcccggcgccuccguccgcaucuccugccgcgccuccggcuucaccuucgacgacuacuccgacuacuccuucauccccaccaccuaccucauccacugguuccgccaggcccccggccagggccucgaguggauggccuggaucaacuccgucaacggcggccgcaacaucgcccgccaguuccagggccgcgucaccgucgcccgcgaccgcuccaacuccaucgccuuccucgaguucuccggccuccgccacgacgacaccgccgucuacuucugcgcccgcgaccgccgcgacgacgaccgcgccuggcuccucgaccccuggggccagggcacccgcgucaccgucuccuccgccuccaccaagggc

SEQ ID NO: 19873 - RNA, 411 nt, Artificial Sequence
  derived and/or modified sequence opt2 from anti-HIV_Chain
cagauccaccucguccaguccggcaccgaggucaagaagcccggcuccuccgucaccgucuccugcaaggccuacggcgucaacaccuucggccucuacgccgucaacuggguccgccaggcccccggccagucccucgaguacaucggccagaucuggcgcuggaaguccuccgccucccaccacuuccgcggccgcguccucaucuccgccgucgaccucaccggcuccuccccccccaucuccucccucgagaucaagaaccucaccuccgacgacaccgccgucuacuucugcaccaccaccuccaccuacgacaagugguccggccuccaccacgacggcgucauggccuucuccuccuggggccagggcacccucaucuccgucuccgccgccuccaccaagggc

SEQ ID NO: 19874 - RNA, 414 nt, Artificial Sequence
  derived and/or modified sequence opt2 from anti-HIV_Chain
gucguccagcucguccaguccggcgccgagguccgcaagcccggcuccucccucaaggucuccugcaaguccuccggcggcaccuucucccgcuucgucgucaacuggguccgccaggcccccggccagggccucgaguggaugggcggcaugauccccaucuucggcaucgccaaguacgcccagaaguuccaggaccgcgucaccaugaccgccgacgaguccaagaacaccgucuaccucgacuucuccucccuccgcuccgacgacaccgccgucuacuacugcgcccgcgaccgcggcgacacccgccuccucgacuacggcgacuacgaggacgagcgcuacuacuacggcauggacgucuggggccagggcaccaccgucaucgucuccuccgccuccaccaagggc

SEQ ID NO: 19875 - RNA, 414 nt, Artificial Sequence
  derived and/or modified sequence opt2 from anti-HIV_Chain
cagguccagcucguccaguccggcgccgagguccgcaagcccggcuccucccucaaggucuccugcaaguccuccggcggcaccuucucccgcuucgucgucaacuggguccgccaggcccccggccagggccucgaguggaugggcggcaugauccccaucuucggcaucgccaaguacgcccagaaguuccaggaccgcgucaccaugaccgccgacgaguccaagaacaccgucuaccucgacuucuccucccuccgcuccgacgacaccgccgucuacuacugcgcccgcgaccgcggcgacacccgccuccucgacuacggcgacuacgaggacgagcgcuacuacuacggcauggacgucuggggccagggcaccaccgucaucgucuccuccgccuccaccaagggc

SEQ ID NO: 19876 - RNA, 414 nt, Artificial Sequence
  derived and/or modified sequence opt2 from anti-HIV_Chain
gagguccagcucgucgaguccggcgccgagguccgcaagcccggcuccucccucaaggucuccugcaaguccuccggcggcaccuucucccgcuucgucgucaacuggguccgccaggcccccggccagggccucgaguggaugggcggcaugauccccaucuucggcaucgccaaguacgcccagaaguuccaggaccgcgucaccaugaccgccgacgaguccaagaacaccgucuaccucgacuucuccucccuccgcuccgacgacaccgccgucuacuacugcgcccgcgaccgcggcgacacccgccuccucgacuacggcgacuacgaggacgagcgcuacuacuacggcauggacgucuggggccagggcaccaccgucaucgucuccuccgccuccaccaagggc

SEQ ID NO: 19877 - RNA, 414 nt, Artificial Sequence
  derived and/or modified sequence opt2 from anti-HIV_Chain
cagguccagcucgucgaguccggcgccgagguccgcaagcccggcuccucccucaaggucuccugcaaguccuccggcggcaccuucucccgcuacgucgucaacuggguccgccaggcccccggccagggccucgaguggaugggcggcaucauccccaucuucggcaucgccaaguacgcccagaaguuccaggaccgcgucaccaugaccgccgacgagcccaagaacaccgucuaccucgacuucaacucccuccgcuccgacgacaccgccgucuacuacugcgcccgcgaccgcggcgacacccgccuccucgacuacggcgacuacgaggacgagcgcuacuacuacggcauggacgucuggggccagggcaccaccgucaucgucuccuccgccuccaccaagggc

SEQ ID NO: 19878 - RNA, 414 nt, Artificial Sequence
  derived and/or modified sequence opt2 from anti-HIV_Chain
cagguccagcucguccaguccggcgccgagguccgcaagcccggcuccucccucaaggucuccugcaaguccuccggcggcaccuucucccgcuacgucgucaacuggguccgccaggcccccggccagggccucgaguggaugggcggcaugauccccaucuucggcaucgccaaguacgcccagaaguuccaggaccgcgucaccaugaccgccgacgaguccaagaacaccgucuaccucgacuucuccucccuccgcuccgacgacaccgccgucuacuacugcgcccgcgaccgcggcgacacccgccuccucgacuacggcgacuacgaggacgagcgcuacuacuacggcauggacgucuggggccagggcaccaccgucaucgucuccuccgccuccaccaagggc

SEQ ID NO: 19879 - RNA, 414 nt, Artificial Sequence
  derived and/or modified sequence opt2 from anti-HIV_Chain
cagguccagcucguccaguccggcgccgagguccgcaagcccggcuccucccucaaggucuccugcaaguccuccggcggcaccuucucccgcuacgucgucaacuggguccgccaggcccccggccagggccucgaguggaugggcggcaucauccccaucuucggcaucgccaaguacgcccagaaguuccaggaccgcgucaccaugaccgccgacgaguccaagaacaccgucuaccucgacuucuccucccuccgcuccgacgacaccgccgucuacuacugcgcccgcgaccgcggcgacacccgccuccucgacuacggcgacuacgaggacgagcgcuacuacuacggcauggacgucuggggccagggcaccaccgucaucgucuccuccgccuccaccaagggc

SEQ ID NO: 19880 - RNA, 414 nt, Artificial Sequence
  derived and/or modified sequence opt2 from anti-HIV_Chain
cagguccagcucgucgaguccggcgccgagguccgcaagcccggcuccucccucaaggucuccugcaaguccuccggcggcaccuucucccgcuacgucgucaacuggguccgccaggcccccggccagggccucgaguggaugggcggcaucauccccaucuucggcaucgccaaguacgcccagaaguuccaggaccgcgucaccaugaccgccgacgaguccaagaacaccgucuaccucgacuucuccucccuccgcuccgacgacaccgccgucuacuacugcgcccgcgaccgcggcgacacccgccuccucgacuacggcgacuacgaggacgagcgcuacuacuacggcauggacgucuggggccagggcaccaccgucaucgucuccuccgccuccaccaagggc

SEQ ID NO: 19881 - RNA, 414 nt, Artificial Sequence
  derived and/or modified sequence opt2 from anti-HIV_Chain
cagguccagcucguccaguccggcgccgagguccgcaagcccggcuccucccucaaggucuccugcaaguccuccggcggcaccuucucccgcuacgucgucaacuggguccgccaggcccccggccagggccucgaguggaugggcggcaucauccccaucuucggcaucgccaaguacgcccagaaguuccaggaccgcgucaccaugaccgccgacgagcccaagaacaccgucuaccucgacuucaacucccuccgcuccgacgacaccgccgucuacuacugcgcccgcgaccgcggcgacacccgccuccucgacuacggcgacuacgaggacgagcgcuacuacuacggcauggacgucuggggccagggcaccaccgucaucgucuccuccgccuccaccaagggc

SEQ ID NO: 19882 - RNA, 414 nt, Artificial Sequence
  derived and/or modified sequence opt2 from anti-HIV_Chain
gucguccagcucguccaguccggcgccgagguccgcaagcccggcuccucccucaaggucuccugcaaguccuccggcggcaccuucucccgcuacgucgucaacuggguccgccaggcccccggccagggccucgaguggaugggcggcaugauccccaucuucggcaucgccaaguacgcccagaaguuccaggaccgcgucaccaugaccgccgacgaguccaagaacaccgucuaccucgacuucuccucccuccgcuccgacgacaccgccgucuacuacugcgcccgcgaccgcggcgacacccgccuccucgacuacggcgacuacgaggacgagcgcuacuacuacggcauggacgucuggggccagggcaccaccgucaucgucuccuccgccuccaccaagggc

SEQ ID NO: 19883 - RNA, 414 nt, Artificial Sequence
  derived and/or modified sequence opt2 from anti-HIV_Chain
uucaucugcuucuccgucgucguccgccuccucgaguucggcggccgccucguccagcccggcggcucccuccgccucuccugcuccgccuccggcuucaccuucuccaacuccgccauguccuggguccgccaggcccccggcaagggccucgagugggucuccuccauccucuccuccggcgucggcaccuucuacgccgacuccgucaagggccgcuucaccgucucccgcgacaacucccgcaacacccucuaccuccagaugaagucccuccgcgccgaggacaccgcccucuacuacugcgccaagguccagauccagcagcucaacuucggcgucaucaccgacgccggccucgacgucuggggcaagggcaccacccucaucgucuccuccgccuccaccaagggc

SEQ ID NO: 19884 - RNA, 414 nt, Artificial Sequence
  derived and/or modified sequence opt2 from anti-HIV_Chain
cagguccagcucguccaguccggcgccgagguccgcaagcccggcuccucccucaaggucuccugcaaguccuccggcggcaccuucucccgcuacgucgucaacuggguccgccaggcccccggccagggccucgaguggaugggcggcaucauccccaucuucggcaucgccaaguacgcccagaaguuccaggaccgcgucaccaugaccgccgacgaguccaagaacaccgucuaccucgacuucuccucccuccgcuccggcgacaccgccgucuacuacugcgcccgcgaccgcggcgacacccgccuccucgacuacggcgacuacgaggacgagcgcuacuacuacggcauggacgucuggggccagggcaccaccgucaccgucuccuccgccuccaccaagggc

SEQ ID NO: 19885 - RNA, 417 nt, Artificial Sequence
  derived and/or modified sequence opt2 from anti-HIV_Chain
cagguccagcucgucgaguccggcgccgaggucaagaagcccggcuccuccgucaaggucuccugcaaggccuccggcggcaccuucaacaucuucgccuucuccuggguccgccaggcccccggccagggccucgaguggaugggcggcaucauccccaucuucgccucccccaacuacgcccagcgcuuccagggccgcgucaccaucaccgccgacgaguccaccuccaccguccacauggagcucuccucccuccgcuccgaggacaccgccaucuacuacugcgccaaggacgcccacaugcacaucgaggagccccgcgacuacgacuacaucuggggcaccucccccuacuacuucgacuacuggggccagggcacccucgucaccgucuccuccgccuccaccaagggc

SEQ ID NO: 19886 - RNA, 417 nt, Artificial Sequence
  derived and/or modified sequence opt2 from anti-HIV_Chain
cagguccagcucgucgaguccggcgccgaggucaagaagcccggcgccuccgucaaggucuccugcaaggccuccggcuacaccuucaccucccacgacaucaacuggguccgccaggccaccggccagggccucgaguggaugggcuggaugaaccccaacuccggcgacaccggcuacgcccacaaguuccagggccgcgucaccaugacccgcaacacccccaucuccaccgccuacauggagcucuccucccuccgcuccgaggacaccgccgucuacuacugcgcccgcggccgcgccaccucccgcaacacccccugggcccacuacuacgacuccuccggcuacuacggcgccggcgacuacuggggccagggcacccucgucaccgucuccuccgccuccaccaagggc

SEQ ID NO: 19887 - RNA, 417 nt, Artificial Sequence
  derived and/or modified sequence opt2 from anti-HIV_Chain
cagguccagauccgccaguccggccccggccucgucaagccccucgagacccucucccucuccugcaucgucuucggcggcuccuucaucgccuaccacuggaccuggauccgccaggccccccucaagggccucgaguggaucggcgacaucgaccagggcggcgacaucaccuacucccccucccucaagucccgcgucaccauguccgucgaccgcuccaagucccaguucucccucaagcucuccuccgucaccgccgccgacgccgccgucuacuacugcguccgcggcccccccaaccgcuacgccgucaccuccuucaccuccggcacccaccgcgagcgcuccuccuacuacuucgacuacuggggccccggcacccucgucaccgucuccuccgccuccaccaagggc

SEQ ID NO: 19888 - RNA, 423 nt, Artificial Sequence
  derived and/or modified sequence opt2 from anti-HIV_Chain
aacggcggcucccuccgccucuccugccgcgucuccggcuucggcuuccaccucuacgagaugaacuggguccgccaggcccccggcaagggccucgaguggaucuccuccaucuccggcuccggcgaguccacccacuacuccgacuccaucaccggccgcuucuccaugucccgcgacgaggccaaggacucccucuaccuccagaugaacaaccuccgcgucgaggacaccgccgucuacuacugcacccgcggcuucuccaugggcgacggcaccggcuucuccuucgacaccuggggccgcggcaccauggucaccgucuccuccggccucgacaccgucucccucgccuccaccaagggccccuccgucuucccccucgcccccugcucccgcuccaccuccgacgcccgccucucc

SEQ ID NO: 19889 - RNA, 423 nt, Artificial Sequence
  derived and/or modified sequence opt2 from anti-HIV_Chain
cagguccagcucguccaguccggcgccgaggucaagaagcccggcuccuccgucaaggucuccugcaaggccuccggcggcaccuucuccaccuacgccaucuccuggguccgccaggcccccggccagggccucgaguggaugggcggcaucauccccuccuucuccauguccaacuacgcccaggacuuccagggccgccucaccaucaccgccgacgaguccaccuccuccgucuacauggagcucaacucccuccgcuccgaggacaccgccgucuacuacugcgcccgcgacuucccccgcuuccaccgccucgucggcaacuacgacuucuggcgcggcacccucgaccgcuucuccuacauggaccucuggggccgcggcaccgccgucaccgucuccuccgccuccaccaagggc

SEQ ID NO: 19890 - RNA, 423 nt, Artificial Sequence
  derived and/or modified sequence opt2 from anti-HIV_Chain
cucguccagcucgucgaguccggcggcggcgucguccagcccggccgcucccuccgccucuccugcgccgccuccggcuucaccuucuccaccuacgccaugcacuggguccgccaggcccccggcaagggccucgagugggucgccgucaucuccuacgacggcuccaacaaguucuacgccgacuccgucaagggccgcuucaccaucucccgcgacaacuccaagaacacccucuaccuccagaugaacucccuccgcgccgaggacaccgccgucuacuacugcgcccgccccaaguuccuccccggcgccgacaucgucgucgucgucgccgccacccccuucgacuacuggggccagggcaaccccggccaccgccuccucuccuuccaccagggccccaucggccucccccccggc

SEQ ID NO: 19891 - RNA, 423 nt, Artificial Sequence
  derived and/or modified sequence opt2 from anti-HIV_HeavyChain
auggagugguccggcgucuucaucuuccuccucuccgucaccgccggcguccacuccgagguccagcucgucgaguccggcggcggccucgucaagcccggcggcucccuccgccucuccugcgccgccuccggcuacaccuucuccaacuacuggaucggcuggguccgccaggcccccggcaagggccucgaguggaucggcgacaucuaccccggcggcaacuacauccgcaacaacgagaaguucaaggacaagaccacccucuccgccgacaccuccaagaacaccgccuaccuccagaugaacucccucaagaccgaggacaccgccgucuacuacugcggcuccuccuucggcuccaacuacgucuucgccugguucaccuacuggggccagggcacccucgucaccgucuccucc

SEQ ID NO: 19892 - RNA, 423 nt, Artificial Sequence
  derived and/or modified sequence opt2 from anti-HIV_HeavyChain
auggagugguccggcgucuucaucuuccuccucuccgucaccgccggcguccacucccagguccagcucguccaguccggccccgacgucaagaagcccggcaccuccaugaagauguccugcaagaccuccggcuacaccuucuccaacuacuggaucggcuggguccgccaggcccccggccagggccucgaguggaucggcgacaucuaccccggcggcaacuacauccgcaacaacgagaaguucaaggacaagaccacccucaccgccgacaccuccaccuccaccgccuacaugcagcucggcucccuccgcuccgaggacaccgccgucuacuacugcggcuccuccuucggcuccaacuacgucuucgccugguucaccuacuggggccagggcacccucgucaccgucuccucc

SEQ ID NO: 19893 - RNA, 429 nt, Artificial Sequence
  derived and/or modified sequence opt2 from anti-HIV_Chain
caggucuucguccagcucguccaguccggcggcggccucguccagcccggcggcuccguccgccucuccugcaccgccuccggcuuccucuucuccaccuacuccaugaacuggguccgccaggcccccggcaagggccucgagugggucuccuccaucuccaccaccuccaacuacaucuacuacgccgacuccgucaagggccgcuucaccaucucccgcuccaacggccagggcucccucuaccuccagcucaacucccuccgcgucgaggacaccgccgucuacuacugcgcccgcgacaccaaggucggcgccccccgccaggacugcuacgccauggaccucuggggccagcgcgaccacggccaccgccuccucuccuuccaccagggccccaucggccucccccccggcgcccuccuccag

SEQ ID NO: 19894 - RNA, 432 nt, Artificial Sequence
  derived and/or modified sequence opt2 from anti-HIV_Chain
aucauccucuuccucgucgccaccgccaccggcguccacuccgacauccagaugacccagucccccuccucccucuccgccuccgucggcgaccgcgucaccaucaccugccgcgccucccaguccaucgaccgcuaccucaacugguaccagcacaagcccggcaaggcccccaagcuccucaucuacgccgccuccaaccuccacaccgacguccccucccgcuucuccggcuccggcgccggcaccuacuucacccucaccaucaccucccuccagcccgaggacuucgccaccuacuacugccagcagucccacucccccuccuucggccaggaguccuacuccaucgccuucggccagggcacccgccucgagaucaagcgcaccgucgccgcccccuccgucuucaucuucccccccuccgacgag

SEQ ID NO: 19895 - RNA, 432 nt, Artificial Sequence
  derived and/or modified sequence opt2 from anti-HIV_Chain
cuccagcagcuccaggucccccgccucuccauguggcgcgucuucaaggucgccgccgccaccggcgcccagacccucaccgucgaggagcccggcuccuccgucaaggucuccugcaaggccuccggcggcuccuccaccgccuacggcuacuccuggguccgccaggcccccggccagggcuucgaguggaugggccgcaucauccccuucuacggcaucaucaccuacgcccccaaguuccagggccgcgucaccaucaccgccgaccgcuccaccuccaccgucuacauggagcucaccucccucaccuucgccgacaccgcccucuucuucugcgcccgcgacuucggcgacccccgcaacggcuacuacuucgacuccugggaccagggccucuggcucaccgucuccuccgccuccaccaagggc

SEQ ID NO: 19896 - RNA, 432 nt, Artificial Sequence
  derived and/or modified sequence opt2 from anti-HIV_Chain
cagguccgccucgagcaguccggcgucgccaugcgcaagcccggcgccuccgucacccucuccugccaggccuccggcuacaacuucgucaaguacaucauccacuggguccgccagaagcccggccucggcuucgagugggucggcaugaucgaccccuaccgcggccgccccugguccgcccacaaguuccagggccgccucucccucucccgcgacaccuccauggagauccucuacaugacccucaccucccucaaguccgacgacaccgccaccuacuucugcgcccgcgccgaggccgccuccgacauccacucccgccccaucauccucaccggccccggcgaguacggccucgaccucgagcacauggacuggaccuggcgcauccucugccuccucgccgucgcccccggcugccacucccag

SEQ ID NO: 19897 - RNA, 435 nt, Artificial Sequence
  derived and/or modified sequence opt2 from anti-HIV_Chain
auguuccucuuccucgucgccggcgccaccggcguccagucccaggucuaccucguccccuucggccccgaggucaagaagcccggcuccuccgucaaggucuccugcaaggccuccggcgacuccuucaccuccuccgucaucaccuggguccgccaggcccccggccagggccccgaguggaugggccgcgucauccccguccucggcgucgccgccuacgcccagaaguucuacggccgcgucaccaucaccgccgacaccuccuccaacaccgccuacauggaggucaacucccuccgcuucgaggacaccgccgucuacuacugcgcccgcgagaccggccgcggcggcaaccucgcccuccgccaguacuucuucgacuccuggggccagggcacccucgucaccgucuccucccccuccaccaagggc

SEQ ID NO: 19898 - RNA, 438 nt, Artificial Sequence
  derived and/or modified sequence opt2 from anti-HIV_Chain
cagguccagcuccaggaguccggccccggccucgucaagcccuccggcacccucucccucaccugcgccgucuccggcgccuccaucuccucccgcaacugguggaccuggguccgccagccccccggcaagggccucgaguggaucggcgagaucuacgaguccggcgccaccaacuacaaccccucccucaagucccgcgucaccaucuccgucgacaaguccaagaaccaguucucccuccgccucaccuccgucaccgccgccgacaccgccgucuacuucugcgcccgccucaugaccuucggcggccucaucggcacccucgacuacuggggccagggcacccucgucaccguccuccagccccccccccgcgcccaccgcuaccacccccgcaaccuccuccaggagcaccucugcgcccgcgucaugccc

SEQ ID NO: 19899 - RNA, 444 nt, Artificial Sequence
  derived and/or modified sequence opt2 from anti-HIV_HeavyChain
auggagugguccggcgucuucaucuuccuccucuccgucaccgccggcguccacuccgagguccagcucgucgaguccggcggcggccucgucaagcccggcggcucccuccgccucuccugcgccgccuccggcuacaccuucuccaacuacuggaucggcuggguccgccaggcccccggcaagggccucgaguggaucggcgacaucuaccccggcggcaacuacauccgcaacaacgagaaguucaaggacaagaccacccucuccgccgacaccuccaagaacaccgccuaccuccagaugaacucccucaagaccgaggacaccgccgucuacuacugcggcuccuccuucggcuccaacuacgucuucgccugguucaccuacuggggccagggcacccucgucaccgucuccuccggcgagucccucaagccccuc

SEQ ID NO: 19900 - RNA, 444 nt, Artificial Sequence
  derived and/or modified sequence opt2 from anti-HIV_HeavyChain
auggagugguccggcgucuucaucuuccuccucuccgucaccgccggcguccacucccagguccagcucguccaguccggccccgacgucaagaagcccggcaccuccaugaagauguccugcaagaccuccggcuacaccuucuccaacuacuggaucggcuggguccgccaggcccccggccagggccucgaguggaucggcgacaucuaccccggcggcaacuacauccgcaacaacgagaaguucaaggacaagaccacccucaccgccgacaccuccaccuccaccgccuacaugcagcucggcucccuccgcuccgaggacaccgccgucuacuacugcggcuccuccuucggcuccaacuacgucuucgccugguucaccuacuggggccagggcacccucgucaccgucuccuccggcgagucccucaagccccuc

SEQ ID NO: 19901 - RNA, 447 nt, Artificial Sequence
  derived and/or modified sequence opt2 from anti-HIV_Chain
caggcccgccucgaccaguggggcaccggccuccucaagcccuccgagacccucucccucaagugcgccgucuucggcguccucuucaccgacuacaacuggaccuggguccgccagucccccggcaagggccucgaguggaucggccaccucgaccaccgcggcggcggcaacuacaaccccucccucgagucccgcgucaccaucucccucgacuacuccaaggcccaguucucccuccaccucaaguccgucaccgucgccgacaccgcccucuacuacugcgccggcgccgucaagggcuucugguucgacgaggucuacaacugguucggccccggcguccgcgagcccuggcuccccuccccccagccccccccccgcgcccaccgcuccucccccuggcacccccccccccgcgccccccucgucaccgccaccgucccc

SEQ ID NO: 19902 - RNA, 447 nt, Artificial Sequence
  derived and/or modified sequence opt2 from anti-HIV_Chain
caggcccgccucgaccaguggggcaccggccuccucaagcccuccgagacccucucccucaagugcgccgucuucggcguccucuucaccgacuacaacuggaccuggguccgccagucccccggcaagggccucgaguggaucggccaccucgaccaccgcggcggcggcaacuacaaccccucccucgagucccgcgucaccaucucccucgacuacuccaaggcccaguucucccuccaccucaaguccgucaccgucgccgacaccgcccucuacuacugcgccggcgccgucaagggccucugguucgacgagaccuacaccugguucggccccuggucccagggcacccgcgucaccgucgccuccgccuccaccaagggccccuccgucuucccccucgcccccuccuccaaguccaccuccggcacccgcgaccucucc

SEQ ID NO: 19903 - RNA, 447 nt, Artificial Sequence
  derived and/or modified sequence opt2 from anti-HIV_Chain
gccgcccgccucgaccaguggggcaccggccucgucaagcccuccgagacccucucccucaagugcgccgucuucggcgucgacuuccccgacuacaccuggaccugggcccgccaggcccccggcaagggccucgaguggaucggccaccgcgaccaccgcggcggcuccuccuacaaccccucccucuccggccgcgccaccaucucccucgacaccuccaaggcccaguucucccuccacaucaaguccgucaccgucgccgacaccgccaccuacuacugcgccggcgccgucgccggccucugguucgaggacgccuacaacugguucggccccuggucccagggcacccucgucaccgucgccgccgccuccaccaagggccccuccgucuucccccucgcccccuccuccaaguccaccuccggccacgccuccguccuc

SEQ ID NO: 19904 - RNA, 450 nt, Artificial Sequence
  derived and/or modified sequence opt2 from anti-HIV_Chain
cucgcccagcucgagcaguccggcggcggcgucgucaagcccggcggcucccuccgccuccccugcgccgccuccggcuucaccuucaucgacuacuacauggccuggauccgccucgcccccggcaagggccucgaguggcucuccuacaucuccaagaacggcgacuacaccaaguacuccgagucccucaagggccgcuucaccaucucccgcgacaacgccaagaaccucgucauccuccagcucaaccgccuccgcgccgacgacaccgccaucuacuucugcgcccgcgccgacggccucaccuacuucggcgagcuccuccaguacaucuucgaccucuggggccagggcgcccgcgucaucgucuccuccgccuccaccaagggccccuccgucuucccccucgcccccuccuccaaguccaccuccggccacgccuccguc

SEQ ID NO: 19905 - RNA, 459 nt, Artificial Sequence
  derived and/or modified sequence opt2 from anti-HIV_Chain
cagguccagcucguccaguccggcgccgaggucaagaagcccggcgccuccgucaaggucuccugcaaggucuccggcuacacccucaccgagcucuccauccacuggguccgccaggcccccggcaagggccucgaguggaugggcggcuucgacuccgaggacggcgaggccaucuacaagcagaacuuccagggccgcgucaccaugaccgaggacaccuccaccgacaccgccuacauggagcucucccgccuccgcuccgaggacaccgccgucuacuacugcgccaccgccgaccgcuucaaggucgcccaggacgagggccucuucgucaucuucgacuacuggggccagggcaaccccggccaccgccuccucucccuccaccagggccccaucggccucccccccggcacccucccccccaaggccaccuccggccacgccgcccgccgc

SEQ ID NO: 19906 - RNA, 462 nt, Artificial Sequence
  derived and/or modified sequence opt2 from anti-HIV_Chain
cucguccagcucguccaguccggcgccgaggucaagaagcccggcgccuccgucaaggucuccugcaaggucuccggcuacucccucaccgagcucuccauccacuggguccgccaggcccccggcaagggccucgaguggaugggcggcuucgacuccgaggacggcgaggccaucuacaagcagaacuuccagggccgcgucaccaugaccgaggacaccuccaccgacaccgccuacauggagcucucccgccuccgcuccgaggacaccgccgucuacuacugcgccaccgccgaccccuucaaggucgcccaggacgagggccucuucgucaucuucgacuacuggggccagggcaccaccggccaccgccuccucucccuccaccagggcccccaccgccucuacucccucggcacccuccucucccgcgcccccaucguccagacccacauggcc

SEQ ID NO: 19907 - RNA, 471 nt, Artificial Sequence
  derived and/or modified sequence opt2 from anti-HIV_Chain
cagauccaccucguccaguccggcaccgacgucaagaagcccggcuccuccgucaccgucuccugcaaggccuacggcgucaacaccuucggccucuacgccgucaacuggguccgccaggcccccggccagucccucgaguacaucggccagaucuggcgcuggaaguccuccgccucccaccacuuccgcggccgcguccucaucuccgccgucgaccucaccggcuccuccccccccaucuccucccucgagaucaagaaccucaccuccgacgacaccgccgucuacuucugcaccaccaccuccaccuacgaccagugguccggccuccaccacgacggcgucauggccuucuccucccgcggccagggcacccucaucuccgucuccgccgccuccaccaagggccccuccgucuucccccucgcccccuccuccaaguccaccuacggccucgcccacguccuc

SEQ ID NO: 19908 - RNA, 477 nt, Artificial Sequence
  derived and/or modified sequence opt2 from anti-HIV_Chain
cagcaccagcucguccccugcgucgccgagguccgcaagcccggcgccuccgucaaggucuccugcaaggucuccggcuacacccucaccgagaucuccaugcacuggguccgccaggcccccggcaagggccucgaguggaugggcggcuucgaccgcgaggacggcgagaccaucuacgcccagaaguuccagggccgcgucaccaugaccgaggacaccuccaccgacaccgccuacauggagcucuccucccuccgcuccgaggacaccgccgucuacuacugcgccaccaccuaccucgccgucguccccgacggcuucgacggcuacuccuccuccugguacugguucgaccccuggggccagggcacccucgucaccgucuccuccgccuccaugcagggccccaugcuccucucccccaccggcacccuccucccccgcgccccccucguccagacccgccccggcccc

SEQ ID NO: 19909 - RNA, 642 nt, Artificial Sequence
  derived and/or modified sequence opt2 from anti-HIV_LightChain
gacaucgucaucacccaguccaccaaguucauguccaccuccgucggcgaccgcgucuccaucaccugcaaggccucccaggacgucuccaccgccgucgccugguaccagcagaagcccggccagucccccaagcuccucaucuacugggccuccacccgccacaccggcguccccgaccgcuucaccggcuccggcuccggcaccgacuacacccucaccaucucccgcguccaggccgaggaccucgcccucuacuacugccagcagcacuacaccacccccuggaccuucggcggcggcaccaagcucgagaucaagcgcaccgucgccgcccccuccuucgucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 19910 - RNA, 651 nt, Artificial Sequence
  derived and/or modified sequence opt2 from anti-HIV_Chain
caguccguccucacccagccccccuccgucuccgccgcccccggccagaaggucaccaucuccugcuccggcuccuccuccaacaucggcaacaacuacguccucugguaccagcaguuccccggcaccgcccccaagcuccucaucuacggcaacaacaagcgccccuccggcauccccgaccgcuucuccggcuccaaguccggcaccuccgccacccucggcaucaccggccuccagaccggcgacgaggccgacuacuucugcgccaccugggacuccggccucuccgccgacugggucuucggcggcggcaccaagcucaccguccucucccagcccaaggccgcccccuccgucacccucuucccccccuccuccgaggagcuccaggccaacaaggccacccucgucugccucaucuccgacuucuaccccggcgccgucaccgucgccuggaaggccgacuccucccccgucaaggccggcgucgagaccaccacccccuccaagcaguccaacaacaaguacgccgccuccuccuaccucucccucacccccgagcaguggaagucccaccgcuccuacuccugccaggucacccacgagggcuccaccgucgagaagaccgucgcccccaccgagugcucc

SEQ ID NO: 19911 - RNA, 657 nt, Artificial Sequence
  derived and/or modified sequence opt2 from anti-HIV_Chain
gacaucgucaugacccagucccccgacucccucgccgucucccucggcgagcgcgucaccaugaacugcaaguccucccagucccuccucuacuccaccaaccagaagaacuaccucgccugguaccagcagaagcccggccagucccccaagcuccucaucuacugggccaacuccaccgaguccggcguccccgaccgcuucuccggcuccggcuccggcaccgacuucacccucaccaucuccuccguccaggccgaggacgucgccgucuacuacugccagcaguacuacuccuaccgcaccuucggcggcggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 19912 - RNA, 753 nt, Artificial Sequence
  derived and/or modified sequence opt2 from anti-HIV_SingleChain
augcagguccagcucgagcaguccggcgccgaggucaagaagcccggcgccuccgucaaggucuccugccaggccuccggcuaccgcuucuccaacuucaccguccacuggguccgccaggcccccggccagcgcuucgaguggaugggcuggaucaaccccuacaacggcaacaaggaguucuccgccaaguuccaggaccgcgucaccuucaccgccgacaccuccgccaacaccgccuacauggagcuccgcucccuccgcuccgccgacaccgccgucuacuacugcgcccgcgucggcgaguggggcugggacgacuccccccaggacaacuacuacauggacgucuggggcaagggcaccaccgucaucgucuccuccggcggcggcggcuccggcggcggcggcuccggcggcggcggcuccgacaucgagcucacccagucccccggcacccucucccucucccccggcgagcgcgccaccuucuccugccgcuccucccacuccauccgcucccgccgcgucgccugguaccagcacaagcccggccaggccccccgccucgucauccacggcgucuccaaccgcgccuccggcaucuccgaccgcuucuccggcuccggcuccggcaccgacuucacccucaccaucacccgcgucgagcccgaggacuucgcccucuacuacugccaggucuacggcgccuccuccuacaccuucggccagggcaccaagcucgagcgcaag

SEQ ID NO: 19913 - RNA, 1338 nt, Artificial Sequence
  derived and/or modified sequence opt2 from anti-HIV_LightChain
gaggucaagcucgaggaguccggcggcggccucguccagcccggcggcucccgcaagcucuccugcgccgccuccggcuucaccuucuccuccuucggcaugcacuggguccgccaggcccccgagaagggccucgagugggucgccuacaucuccuccggcuccuccacccuccacuacgccgacaccgucaagggccgcuucaccaucucccgcgacaaccccaagaacacccucuuccuccagaugaagcuccccucccucugcuacggccuccucggcucccgcaaccucucccaccgccuccucucccagaacgacacccccaucugccucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 19914 - RNA, 1380 nt, Artificial Sequence
  derived and/or modified sequence opt2 from anti-HIV_Chain
gagguccagcucgucgaguccggcggcggccucgucaagcccggcggcucccuccgccucaccugcgucgccuccggcuucaccuucuccgacgucuggcucaacuggguccgccaggcccccggcaagggccucgagugggucggccgcaucaagucccgcaccgacggcggcaccaccgacuacgccgccuccgucaagggccgcuucaccaucucccgcgacgacuccaagaacacccucuaccuccagaugaacucccucaagaccgaggacaccgccgucuacuccugcaccaccgacggcuucaucaugauccgcggcgucuccgaggacuacuacuacuacuacauggacgucuggggcaagggcaccaccgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggc

SEQ ID NO: 19915 - RNA, 1413 nt, Artificial Sequence
  derived and/or modified sequence opt2 from anti-HIV_Chain
auggagugguccggcgucuucauguuccuccucuccgucaccgccggcguccacucccagguccagcuccagcaguccggccccgaggucgucaagcccggcgccuccgucaagauguccugcaaggccuccggcuacaccuucaccuccuacgucauccacuggguccgccagaagcccggccagggccucgacuggaucggcuacaucaaccccuacaacgacggcaccgacuacgacgagaaguucaagggcaaggccacccucaccuccgacaccuccaccuccaccgccuacauggagcucuccucccuccgcuccgaggacaccgccgucuacuacugcgcccgcgagaaggacaacuacgccaccggcgccugguucgccuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgaguucgagggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgccuccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 19916 - RNA, 645 nt, Artificial Sequence
  derived and/or modified sequence opt2 from anti-influenza_Fab
aucguccucacccagucccccgccacccucuccgucucccccggcgagcgcgccacccucuccugccgcgccucccaggucaucucccacaaccucgccugguaccagcagaagcccggccaggccccccgccuccucaucuacggcgccuccacccgcgccuccggcauccccgcccgcuucuccggcuccggcuccggcaccgacuacacccucaccaucaccucccuccagcccgaggacuucgccgucuacuacugccagcacuacuccaacuggcccccccgccucaccuucggcggcggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 19917 - RNA, 681 nt, Artificial Sequence
  derived and/or modified sequence opt2 from anti-influenza_Fab
guccagcucgucgaguccggcggcggcgucguccagcccggcaaguccccccgccucuccugcgccgccuccggccccaccuucuccuccuacgccguccacuggguccgccaggcccccggcaagggccucgagugggucacccucaucuccuacgacggcgccaaccaguacuacgccgacuccgucaagggccgcuucaccaucucccgcgacaacuccaagaacaccgucuaccuccagaugaacucccuccgccccgaggacaccgccgucuacuacugcgccguccccggccccgucuucggcaucuucccccccugguccuacuucgacaacuggggccagggcauccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugc

SEQ ID NO: 19918 - RNA, 1515 nt, Artificial Sequence
  derived and/or modified sequence opt2 from anti-influenza_Fab
gccggcuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaagaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcagaccgucucccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcuccggccgccucgucccccgc

SEQ ID NO: 19919 - RNA, 657 nt, Artificial Sequence
  derived and/or modified sequence opt2 from anti-influenza_Fab
cagguccagcucguccaguccggcggcggcgucguccagcccggccgcucccuccgccucuccugcgccgccuccgaguucaccuuccgcauguacgccacccacuggguccgccaggcccccggcaagggccucgagugggucgcccucaucuccuacgacggcuccaacaaguacuacgccgacuccgucaagggccgcuucaccaucucccgcgacaacuccaugaacaccgucuaccuccagaugaacacccuccgccccgaggacaccgccgucuacuacugcgcccgcgaccucggcggcuacuucauccgcggcaucauggacgucuggggccagggcacccucgucaccgucuccuccgccuccaccaagggccccuccgucuucccccucgcccccuccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaag

SEQ ID NO: 19920 - RNA, 642 nt, Artificial Sequence
  derived and/or modified sequence opt2 from anti-influenza_Fab
gagcuccagaugacccagucccccuccuccgucuccgccuccgucggcgaccgcgucaccaucaccugccgcgccucccagggcaucuccuccuggcucgccugguaccagcagaagcccggcaaggcccccaagcuccucaucuacgccgccuccucccuccaguccggcguccccucccgcuucuccggcuccggcuccggcaccgacuucacccucaccaucuccucccuccagcccgaggacuucgccaccuacuacugccagcaggccaacuccuucccccucaccuucggcggcggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 19921 - RNA, 993 nt, Artificial Sequence
  derived and/or modified sequence opt2 from anti-influenza_Fab
gccgaccccggcgacaccaucugcaucggcuaccacgccaacaacuccaccgacaccgucgacaccguccucgagaagaacgucaccgucacccacuccgucaaccuccucgaggacucccacaacggcaagcucugcaagcucaagggcaucgccccccuccagcucggcaagugcaacaucgccggcuggcuccucggcaaccccgagugcgaccuccuccucaccgccuccuccugguccuacaucgucgagaccuccaacuccgagaacggcaccugcuaccccggcgacuucaucgacuacgaggagcuccgcgagcagcucuccuccgucuccuccuucgagaaguucgagaucuuccccaagaccuccuccuggcccaaccacgagaccaccaagggcgucaccgccgccugcuccuacgccggcgccuccuccuucuaccgcaaccuccucuggcucaccaagaagggcuccuccuaccccaagcucuccaaguccuacgucaacaacaagggcaaggagguccucguccucuggggcguccaccacccccccaccggcaccgaccagcagucccucuaccagaacgccgacgccuacgucuccgucggcuccuccaaguacaaccgccgcuucacccccgagaucgccgcccgccccaagguccgcgaccaggccggccgcaugaacuacuacuggacccuccucgagcccggcgacaccaucaccuucgaggccaccggcaaccucaucgcccccugguacgccuucgcccucaaccgcggcuccggcuccggcaucaucaccuccgacgcccccguccacgacugcaacaccaagugccagaccccccacggcgccaucaacuccucccuccccuuccagaacauccaccccgucaccaucggcgagugccccaaguacguccgcuccaccaagcuccgcauggccaccggccuccgcaacauccccuccauccagucccgc

SEQ ID NO: 19922 - RNA, 537 nt, Artificial Sequence
  derived and/or modified sequence opt2 from anti-influenza_Fab
ggccucuucggcgccaucgccggcuucaucgagggcggcuggaccggcaugaucgacggcugguacggcuaccaccaccagaacgagcagggcuccggcuacgccgccgaccagaaguccacccagaacgccaucgacggcaucaccaacaaggucaacuccgucaucgagaagaugaacacccaguucaccgccgucggcaaggaguucaacaaccucgagcgccgcaucgagaaccucaacaagaaggucgacgacggcuuccucgacaucuggaccuacaacgccgagcuccucguccuccucgagaacgagcgcacccucgacuuccacgacuccaacguccgcaaccucuacgagaaggucaagucccagcucaagaacaacgccaaggagaucggcaacggcugcuucgaguucuaccacaagugcgacgacgccugcauggaguccguccgcaacggcaccuacgacuaccccaaguacuccgaggaguccaagcucaaccgcgaggagaucgacggcgucuccggccgc

SEQ ID NO: 19923 - RNA, 642 nt, Artificial Sequence
  derived and/or modified sequence opt2 from anti-influenza_Apo
caguccguccucacccagccccccuccgucuccgucgcccccggccagaccgcccgcaucaccugcggcggcaacgacaucggccgcaaguccguccacuggaaccagcagaagcccggccaggcccccguccucgucgucugcuacgacuccgaccgccccuccggcauccccgagcgcuucuccggcuccaacuccggcaacaccgccacccucaccaucucccgcgucgaggccggcgacgaggccgacuacuacugccaggucugggacuccuccuccgaccacgucaucuucggcggcggcaccaagcucaccguccucggccagcccaaggccgcccccuccgucacccucuucccccccuccuccgaggagcuccaggccaacaaggccacccucgucugccucaucuccgacuucuaccccggcgccgucaccgucgccuggaaggccgacuccucccccgucaaggccggcgucgagaccaccacccccuccaagcaguccaacaacaaguacgccgccuccuccuaccucucccucacccccgagcaguggaagucccaccgcuccuacuccugccaggucacccacgagggcuccaccgucgagaagaccgucgcccccaccgagugcucc

SEQ ID NO: 19924 - RNA, 687 nt, Artificial Sequence
  derived and/or modified sequence opt2 from anti-influenza_Apo
gagguccagcucguccaguccggcgccgaggucaagaagcccggcgccuccgucaaggucuccugcaaggccuccggcuacaccuucaccgacuaccacaucaacuggguccgccaggcccccggccagggccucgaguggaugggcuggauccaccccaacuccggcgacaccaacuacgcccagaaguuccagggcugggucaccaugacccgcgacaccgccaucuccaccgccuacauggaggucaacggccucaaguccgacgacaccgccgucuacuacugcgcccgcggcggccucgagccccgcuccgucgacuacuacuacuacggcauggacgucuggggccagggcaccaccgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugc

SEQ ID NO: 19925 - RNA, 333 nt, Artificial Sequence
  derived and/or modified sequence opt2 from anti-influenza-A_kappa_LightChain_V-Region
gacaucgucaugacccagucccccgacucccucgccgucucccucggcgcccgcgccaccaucaacugcaaguccucccaguccgucaccuucaacuacaagaacuaccucgccugguaccagcagaagcccggccagccccccaagguccucaucuacugggccuccgcccgcgaguccggcguccccgaccgcuucuccggcuccggcuccggcaccgacuucacccucaccaucuccucccuccaggccgaggacgucgccgucuacuacugccagcagcacuaccgcaccccccccaccuucggccagggcaccaaggucgagaucaag

SEQ ID NO: 19926 - RNA, 333 nt, Artificial Sequence
  derived and/or modified sequence opt2 from anti-influenza-A_kappa_LightChain_V-Region
gacaucgucaugacccagucccccgacucccucgccgucucccucggcgagcgcgccaccaucaacugcaaguccucccaguccgucuccuccaacaacaagaacuaccucgccugguaccagcagaagcccggccagccccccaagguccucaucuacugggccuccgcccgcgaguccggcguccccgaccgcuucuccggcuccggcuccggcaccgacuucacccucaccaucuccucccuccaggccgaggacgucgccgucuacuacugccagcagcacuaccgcaccccccccaccuucggccagggcaccaaggucgagaucaag

SEQ ID NO: 19927 - RNA, 333 nt, Artificial Sequence
  derived and/or modified sequence opt2 from anti-influenza-A_kappa_LightChain_V-Region
gacaucgucaugacccagucccccgacucccucgccgucucccucggcgagcgcgccaccaucaacugccgcuccucccaguccgucuccuccaacaacaagaacuuccucgccugguaccaggagaagcccggccagccccccaagguccucaucuacugggccuccgcccgcgaguccggcguccccgaccgcuucuccggcuccggcuccggcaccgacuucacccucaccaucuccggccuccaggccgaggacgucgccgucuacuacugccagcagcacuaccgcaccccccccaccuucggccagggcaccaaggucgagaucaag

SEQ ID NO: 19928 - RNA, 333 nt, Artificial Sequence
  derived and/or modified sequence opt2 from anti-influenza-A_kappa_LightChain_V-Region
gacaucgucaugacccagucccccgacucccucgccgucucccucggcgagcgcgccaccaucaacugcaaguccucccaguccgucaccuucaacuacaagaacuaccucgccugguaccagcagaagcccggccagccccccaagcuccucaucuacugggccuccacccgcgaguccggcguccccgaccgcuucuccggcuccggcuccggcaccgacuucacccucaccaucuccucccuccaggccgaggacgucgccgucuacuacugccagcagcacuaccgcaccccccccaccuucggccagggcaccaaggucgagaucaag

SEQ ID NO: 19929 - RNA, 339 nt, Artificial Sequence
  derived and/or modified sequence opt2 from anti-influenza-A_kappa_LightChain_V-Region
gacaucgucaugacccagucccccgacucccucgccgucucccucggcgagcgcgccaccaucaacugcaaguccucccaguccguccucuacuccuccaacaacaagaacuaccucgccugguaccagcagaagcccggccagccccccaagcuccucaucuacugggccuccacccgcgaguccggcguccccgaccgcuucuccggcuccggcuccggcaccgacuucacccucaccaucuccucccuccaggccgaggacgucgccgucuacuacugccagcaguacuacuccaccccccccaccuucggccagggcaccaaggucgagaucaag

SEQ ID NO: 19930 - RNA, 333 nt, Artificial Sequence
  derived and/or modified sequence opt2 from anti-influenza-A_kappa_LightChain_V-Region
gacauccagaugacccagucccccgacucccucgccgucucccucggcgcccgcgccaccaucaacugcaaguccucccaguccgucaccuucaacuacaagaacuaccucgccugguaccagcagaagcccggccagccccccaagguccucaucuacugggccuccgcccgcgaguccggcguccccgaccgcuucuccggcuccggcuccggcaccgacuucacccucaccaucuccucccuccaggccgaggacgucgccgucuacuacugccagcagcacuaccgcaccccccccaccuucggccagggcaccaaggucgagaucaag

SEQ ID NO: 19931 - RNA, 387 nt, Artificial Sequence
  derived and/or modified sequence opt2 from anti-influenza-A_HeavyChain_V-Region
cagguccagcucgucgaguccggcggcggcgucguccagcccggccgcucccuccgccucuccugcgccgccuccggcuucaccuucuccuccuacggcaugcacuggguccgccaggcccccggcaagggccucgagugggucgccgucaucuccuacgacggcuccaacaaguacuacgccgacuccgucaagggccgcuucaccaucucccgcgacaacuccaagaacacccucuaccuccagaugaacucccuccgcgccgaggacaccgccgucuacuacugcgccaaggacucccagcuccgcucccuccucuacuucgacuggcucucccagggcuacuucgacuacuggggccagggcacccucgucaccgucuccucc

SEQ ID NO: 19932 - RNA, 387 nt, Artificial Sequence
  derived and/or modified sequence opt2 from anti-influenza-A_HeavyChain_V-Region
cagguccagcucguccaguccggcggcggcgucguccagcccggccgcucccuccgccucuccugcgucgccuccggcuucaccuucuccaccuacgccaugcacuggguccgccaggcccccggccgcggccucgagugggucgccgucaucuccuacgacggcaacuacaaguacuacgccgacuccgucaagggccgcuucuccaucucccgcgacaacuccaacaacacccuccaccucgagaugaacacccuccgcaccgaggacaccgcccucuacuacugcgccaaggacucccagcuccgcucccuccucuacuucgaguggcucucccagggcuacuucgaccccuggggccagggcacccucgucaccgucuccucc

SEQ ID NO: 19933 - RNA, 387 nt, Artificial Sequence
  derived and/or modified sequence opt2 from anti-influenza-A_HeavyChain_V-Region
cagguccagcucguccaguccggcggcggcgucguccagcccggccgcucccuccgccucuccugcgccgccuccggcuucaccuucuccaccuacggcaugcacuggguccgccaggcccccggcaagggccucgagugggucgccgucaucuccuacgacggcaacuacaaguacuacgccgacuccgucaagggccgcuucaccaucucccgcgacaacuccaagaacacccucuaccucgagaugaacucccuccgcaccgaggacaccgcccucuacuacugcgccaaggacucccagcuccgcucccuccucuacuucgacuggcucucccagggcuacuucgaccacuggggccagggcacccucgucaccgucuccucc

SEQ ID NO: 19934 - RNA, 387 nt, Artificial Sequence
  derived and/or modified sequence opt2 from anti-influenza-A_HeavyChain_V-Region
cagguccagcucguccaguccggcggcggcgucgucccccccggccgcucccuccgccucuccugcgccgccuccggcuucaccuucuccaccuacggcaugcacuggguccgccaggcccccggcaagggccucgagugggucgccgucaucuccuacgacggcaacuacaaguacuacgccgacuccguccgcggccgcuucaccaucucccgcgacaacuccaagaacacccucaaccucgacaugaacucccuccgcaccgaggacaccgcccucuacuacugcgccaaggacucccagcuccgcucccuccucuacuucgacuggcucucccagggcuacuucgaccacuggggccagggcacccucgucaccgucuccucc

SEQ ID NO: 19935 - RNA, 387 nt, Artificial Sequence
  derived and/or modified sequence opt2 from anti-influenza-A_HeavyChain_V-Region
cagguccagcucgucgaguccggcggcggcgucguccagcccggccgcucccuccgccucuccugcgccgccuccggcuucaccuucuccaccuacgccaugcacuggguccgccaggcccccggcaagggccucgagugggucgccgucaucuccuacgacgccaacuacaaguacuacgccgacuccgucaagggccgcuucaccaucucccgcgacaacuccaagaacacccucuaccuccagaugaacucccuccgcgccgaggacaccgccgucuacuacugcgccaaggacucccagcuccgcucccuccucuacuucgaguggcucucccagggcuacuucgacuacuggggccagggcacccucgucaccgucuccucc

SEQ ID NO: 19936 - RNA, 387 nt, Artificial Sequence
  derived and/or modified sequence opt2 from anti-influenza-A_HeavyChain_V-Region
cagguccagcucgucgaguccggcggcggcgucguccagcccggccgcucccuccgccucuccugcgccgccuccggcuucaccuucuccaccuacgccaugcacuggguccgccaggcccccggcaagggccucgagugggucgccgucaucuccuacgacggcaacuacaaguacuacgccgacuccgucaagggccgcuucaccaucucccgcgacaacuccaagaacacccucuaccuccagaugaacucccuccgcgccgaggacaccgccgucuacuacugcgccaaggacucccagcuccgcucccuccucuacuucgaguggcucucccagggcuacuucgaccccuggggccagggcacccucgucaccgucuccucc

SEQ ID NO: 19937 - RNA, 387 nt, Artificial Sequence
  derived and/or modified sequence opt2 from anti-influenza-A_HeavyChain_V-Region
cagguccagcucguccaguccggcggcggcgucguccagcccggccgcucccuccgccucuccugcgucgccuccggcuucaccuucuccaccuacgccaugcacuggguccgccaggcccccggccgcggccucgagugggucgccgucaucuccuacgacggcaacuacaaguacuacgccgacuccgucaagggccgcuucuccaucucccgcgacaacuccaacaacacccuccaccucgagaugaacacccuccgcaccgaggacaccgcccucuacuacugcgccaaggacucccagcuccgcucccuccucuacuucgaguggcucucccagggcuacuucgaccccuggggccagggcacccucgucaccgucaccucc

SEQ ID NO: 19938 - RNA, 330 nt, Artificial Sequence
  derived and/or modified sequence opt2 from anti-influenza-A_LightChain_V-Region
aacuucaugcucacccagccccccuccgccuccggcacccccggccagcgcgucaccaucuccugcuccggcuccuccuccaacaucggcggcaacaccguccacugguuccagcagcuccccggcaccgcccccaagcuccucaucuacaccaacucccuccgccccuccggcguccccgaccgcuucuccggcuccaaguccggcaccuccgccucccucgccaucuccggccuccaguccgaggacgaggccgacuacuacugcgccgccugggacgacucccucaacggccaggucuucggcggcggcaccaagcucaccguccuc

SEQ ID NO: 19939 - RNA, 390 nt, Artificial Sequence
  derived and/or modified sequence opt2 from anti-influenza-A_HeavyChain_V-Region
cagguccagcuccucgaguccggcggcggcgucguccagcccggccgcucccuccgccucuccugcgccgccuccggcuucaccuucuccaacuacggcaugcacuggguccgccaggcccccggcaagggccucgagugggucgccaucaucuccuucgacggcuccaagaaguacuacgccaacuccgucaagggccgcuccaccaucucccgcgacaacuccaagaacacccucucccuccagaugaacucccucggccccgaggacaccgcccucuacuacugcgccaagcuccccucccccuacuacuucgacucccgcuucgucugggucgccgccuccgccuuccacuucuggggccagggcauccucgucaccgucuccucc

SEQ ID NO: 19940 - RNA, 132 nt, Artificial Sequence
  derived and/or modified sequence opt2 from anti-influenza_Chain
aacguccccgagugguccuacaucgucgagaaggccaaccccgccaacgaccucugcuaccccggcaacuucaacgacuacgaggagcucaagcaccuccucucccgcaucaaccacuucgagaagauccag

SEQ ID NO: 19941 - RNA, 162 nt, Artificial Sequence
  derived and/or modified sequence opt2 from anti-influenza_Chain
uccggccgccucgucccccgcggcucccccggcuccggcuacauccccgaggccccccgcgacggccaggccuacguccgcaaggacggcgaguggguccuccucuccaccuuccucggcaagcccauccccaacccccuccucggccucgacuccaccggc

SEQ ID NO: 19942 - RNA, 291 nt, Artificial Sequence
  derived and/or modified sequence opt2 from anti-influenza_Chain
augucccuccucaccgaggucgagacccccauccgcaacgaguggggcugccgcugcaacggcuccuccgacccccucgccaucgccgccaacaucaucggcauccuccaccucauccucuggauccucgaccgccucuucuucaagugcaucuaccgccgcuucaaguacggccucaagggcggccccuccaccgagggcguccccaaguccaugcgcgaggaguaccgcaaggagcagcaguccgccgucgacgccgacgacggccacuucgucuccaucgagcucgag

SEQ ID NO: 19943 - RNA, 300 nt, Artificial Sequence
  derived and/or modified sequence opt2 from anti-influenza_Chain
augaacaacgccaccuucaacugcaccaacaucaaccccaucacccacauccgcggcuccaucaucaucaccaucugcgucucccucaucgucauccucaucgucuucggcugcaucgccaagaucuucaucaacaagaacaacugcaccaacaacgucauccgcguccacaagcgcaucaagugccccgacugcgagcccuucugcaacaagcgcgacgacaucuccaccccccgcgccggcgucgacauccccuccuucauccuccccggccucaaccucuccgagggcacccccaac

SEQ ID NO: 19944 - RNA, 300 nt, Artificial Sequence
  derived and/or modified sequence opt2 from anti-influenza_Chain
gagcucacccagucccccuccucccucuccgccuccgucggcgacuccgucaccaucaccugccgcaccuccgagcgcaucuccaccuaccucaacugguaccagcagaagcccggcaaggccccccgccuccucgucuccggcgccuccacccuccagggcggcguccccucccgcuucuccggcuccggcuccggcaccgccuucacccucaccaucaacucccuccagcccgaggacuucgccaccuacuacugccagcaguccuacuccaccccccucaccuucggcggcggcacc

SEQ ID NO: 19945 - RNA, 300 nt, Artificial Sequence
  derived and/or modified sequence opt2 from anti-influenza_Chain
augacccagucccccuccuccauguccgucucccucggcgacaccgucuccaucaccugccacgccucccaggacaucuccggccacaucggcuggcuccagcagaagcccggcaaguccuucaagggccucaucuaccacggcaccaaccucgaggacggcguccccucccgcuucuccggcuccggcuccggcgccgacuucucccucaccaucuccucccucgaguccgaggacuucgccgacuacuacugcguccaguacguccaguuccccuggaccuucggcggcggcaccaag

SEQ ID NO: 19946 - RNA, 306 nt, Artificial Sequence
  derived and/or modified sequence opt2 from anti-influenza_Chain
gacauccaggucacccagucccccuccucccucuccgccuccgucggcgaccgcgucaccaucuccugccgcgcccagucccucuccuccuaccuccacugguaccagcagaagcccggccagccccccaagcuccucaucuacgccgccaccacccuccaguccggcguccccucccgcuucuccggcuccggcuccggcaccgacuucacccucaccaucuccaccuuccaggccgaggacgucgccaccuacuacugccagcagucccgcaccuucggccagggcaccaaggucgagaucaag

SEQ ID NO: 19947 - RNA, 306 nt, Artificial Sequence
  derived and/or modified sequence opt2 from anti-influenza_Chain
gacauccagaugacccagucccccuccucccucuccgccuccgucggcgaccgcgucaccaucuccugccgcgcccagucccucuccuccuaccuccacugguaccagcagaagcccggccagccccccaagcuccucaucuacgccgccaccacccuccaguccggcguccccucccgcuucuccggcuccggcuccggcaccgacuucacccucaccaucuccaccuuccaggccgaggacgucgccaccuacuacugccagcagucccgcaccuucggccagggcaccaaggucgagaucaag

SEQ ID NO: 19948 - RNA, 309 nt, Artificial Sequence
  derived and/or modified sequence opt2 from anti-influenza_Chain
gacauccagaucacccagucccccuccucccucuccgccuccgucggcgaccgcgucaccaucaccugccgcaccucccagucccucuccuccuaccuccacugguaccagcagaagcccggcaaggcccccaagcuccucaucuacgccgccuccucccuccaguccggcguccccucccgcuucuccggcuccggcuccggcaccgacuucacccucaccaucuccucccuccagcccgaggacuucgccaccuacuacugccagcagucccgcaccuucggccagggcaccaaggucgagaucaag

SEQ ID NO: 19949 - RNA, 309 nt, Artificial Sequence
  derived and/or modified sequence opt2 from anti-influenza_Chain
gacauccagaugacccagucccccuccucccucuccgccuccgucggcgaccgcgucaccaucaccugccgcaccucccagucccucuccuccuaccuccacugguaccagcagaagcccggcaaggcccccaagcuccucaucuacgccgccuccucccuccaguccggcguccccucccgcuucuccggcuccggcuccggcaccgacuucacccucaccaucuccucccuccagcccgaggacuucgccaccuacuacugccagcagucccgcaccuucggccagggcaccaaggucgagaucaag

SEQ ID NO: 19950 - RNA, 309 nt, Artificial Sequence
  derived and/or modified sequence opt2 from anti-influenza_Chain
gacauccaggucacccagucccccuccucccucuccgccuccgucggcgaccgcgucaccaucuccugccgcgccucccagcgccucaacuccuaccuccacugguaccagcagacccccggccaggcccccaagcuccucaucuacgccaccuccacccuccaguccggcgucuccccccgcuucuccggcuccggcuccggcaccgacuucacccucaccaucuccucccuccagcccgaggacgucgccaccuacuacugccagcucucccgcaccuucggccacggcaccaaggucgagaucaag

SEQ ID NO: 19951 - RNA, 309 nt, Artificial Sequence
  derived and/or modified sequence opt2 from anti-influenza_Chain
gacauccagaugacccagucccccuccucccucuccgccuccgucggcgaccgcgucaccaucuccugccgcgccucccagcgccucaacuccuaccuccacugguaccagcagacccccggccaggcccccaagcuccucaucuacgccaccuccacccuccaguccggcgucuccccccgcuucuccggcuccggcuccggcaccgacuucacccucaccaucuccucccuccagcccgaggacgucgccaccuacuacugccagcucucccgcaccuucggccacggcaccaaggucgagaucaag

SEQ ID NO: 19952 - RNA, 309 nt, Artificial Sequence
  derived and/or modified sequence opt2 from anti-influenza_Chain
gacauccaggucacccagucccccuccucccucuccgccuccgucggcgaccgcaucaccaucuccugccgcaccucccagucccuccgcuccuaccuccacugguaccagcagaagcccggcaaggcccccaagcuccucaucuacgccuccuccacccuccaguccggcguccccucccgcuucuccggcuccggcuccggcaccgacuucacccucaccaucuccaaccuccagcccgaggacuucgccaccuacuacugccagcucucccgcaccuucggccagggcaccaaggucgagaucaag

SEQ ID NO: 19953 - RNA, 309 nt, Artificial Sequence
  derived and/or modified sequence opt2 from anti-influenza_Chain
gacauccagaugacccagucccccuccucccucuccgccuccgucggcgaccgcaucaccaucuccugccgcaccucccagucccuccgcuccuaccuccacugguaccagcagaagcccggcaaggcccccaagcuccucaucuacgccuccuccacccuccaguccggcguccccucccgcuucuccggcuccggcuccggcaccgacuucacccucaccaucuccaaccuccagcccgaggacuucgccaccuacuacugccagcucucccgcaccuucggccagggcaccaaggucgagaucaag

SEQ ID NO: 19954 - RNA, 309 nt, Artificial Sequence
  derived and/or modified sequence opt2 from anti-influenza_Chain
gacauccagaugacccagucccccuccucccucuccgccuccgucggcgaccgcgucaccaucaccugccgcaccucccagucccucuccuccuacacccacugguaccagcagaagcccggcaaggcccccaagcuccucaucuacgccgccuccucccgccucuccggcguccccucccgcuucuccggcuccggcuccggcaccgacuucacccucaccaucuccucccuccagcccgaggacuucgccaccuacuacugccagcagucccgcaccuucggccagggcaccaaggucgagaucaag

SEQ ID NO: 19955 - RNA, 309 nt, Artificial Sequence
  derived and/or modified sequence opt2 from anti-influenza_Chain
gacauccagaugacccagucccccuccucccucuccgccuccgucggcgaccgcgucaccaucaccugccgcaccucccagucccucuccuccuacacccacugguaccagcagaagcccggcaaggcccccaagcuccucaucuacgccgccuccucccgcggcuccggcguccccucccgcuucuccggcuccggcuccggcaccgacuucacccucaccaucuccucccuccagcccgaggacuucgccaccuacuacugccagcagucccgcaccuucggccagggcaccaaggucgagaucaag

SEQ ID NO: 19956 - RNA, 309 nt, Artificial Sequence
  derived and/or modified sequence opt2 from anti-influenza_Chain
gacauccagaugacccagucccccuccucccucuccgccuccgucggcgaccgcgucaccaucaccugccgcaccucccagucccucuccuccuacgaccacugguaccagcagaagcccggcaaggcccccaagcuccucaucuacgccgccuccucccgccucuccggcguccccucccgcuucuccggcuccggcuccggcaccgacuucacccucaccaucuccucccuccagcccgaggacuucgccaccuacuacugccagcagucccgcaccuucggccagggcaccaaggucgagaucaag

SEQ ID NO: 19957 - RNA, 318 nt, Artificial Sequence
  derived and/or modified sequence opt2 from anti-influenza_Chain
gagaucgucaugacccagucccccgacacccucuccgucucccccggcgagcgcgccacccucuccugccgcgccucccaguccgucaaccgccgccucgccugguaccagcagaagcccggccaggccccccgccuccucauccacgacgccuccacccgcgccaccggcauccccgcccgcuucuccggcuccggcuccggcaccgaguucacccucaccaucuccucccuccaguccgaggacuucgccgucuacuacugccagcaguacgacaacuggcucuccuucggccagggcacccgccucgagaucaag

SEQ ID NO: 19958 - RNA, 318 nt, Artificial Sequence
  derived and/or modified sequence opt2 from anti-influenza_Chain
gacauccagcucacccagucccccuccucccucuccgccuccgucggcgaccgcgucaccaucaccugccgcgccucccagggcauccucaacugccucgccugguaccagcagaagcccggcaagguccccaaccuccucauguacgccgccuccacccuccaguccggcguccccucccgcuucuccggcuccggcuucggcaccgacuucacccucaccaucuccucccuccagcccgaggacgucgccaccuacuacugccagaccuacggcggcgucuccaccuucggcggcggcaccaaggucgagauccgc

SEQ ID NO: 19959 - RNA, 318 nt, Artificial Sequence
  derived and/or modified sequence opt2 from anti-influenza_Chain
uccuacguccucacccagccccccuccgucuccgucgcccccggccagaccgcccgcaucuccugcggcggcuccaacaucggcggcaaguccguccacugguaccagcagaagcccggccaggcccccguccucgucgucuacgacgacuccggccgccccuccggcauccccgagcgcuucuccggcuccaacuccggcgacaccgccacccucaccaucucccgcgucgaggccggcgacgaggccgacuacuucugccaggucugggacaacuucggcggcgucuucggcaccggcaccaaggucaccguccuc

SEQ ID NO: 19960 - RNA, 318 nt, Artificial Sequence
  derived and/or modified sequence opt2 from anti-influenza_Chain
gacauccagaugacccagucccccuccucccucuccgccuccgucggcgaccgcgucaccaucaccugccgcaccucccaguccaucuccuccuaccucaacugguaccagcagaagcccggcaaggcccccaagcuccucaucuacgccgccuccucccuccaguccggcguccccucccgcuucuccggcuccggcuccggcaccgacuucacccucaccaucuccggccuccagcccgaggacuucgccaccuacuacugccagcaguccuacuccaugcccgccuucggccagggcaccaagcucgagaucaag

SEQ ID NO: 19961 - RNA, 318 nt, Artificial Sequence
  derived and/or modified sequence opt2 from anti-influenza_Chain
gacauccagaugacccaguccccccucuccgucuccgucuccgucggcgaccgcgucaccaucgccugccgcgccucccaguccaucgacaaguuccucaacugguaccagcagaagcccggcaaggcccccaagcuccucaucuacggcgccuccaaccuccacuccggcgcccccucccgcuucuccgccuccggcuccggcaccgacuucacccucaccaucaccaacauccagaccgaggacuucgccaccuaccucugccagcaguccuucuccguccccgccuucggcggcggcaccaaggucgagaucaag

SEQ ID NO: 19962 - RNA, 318 nt, Artificial Sequence
  derived and/or modified sequence opt2 from anti-influenza_Chain
gacauccagaugacccagucccccuccucccucuccgccuccgucggcgaccgcgucaccaucaccugccgcgccucccaguccaucuccaccuaccucaacugguaccagaagcgccccggcaaggcccccaagcuccucgucuacggcgccuccacccuccaguccggcguccccucccgcuucuccggcuccggcuccggcaccgacuucacccucaccaucgccucccuccagcccgaggacuccgccaccuacuacugccagcagaccuacuccaucccccucuucggccagggcacccgccucgagaucaag

SEQ ID NO: 19963 - RNA, 318 nt, Artificial Sequence
  derived and/or modified sequence opt2 from anti-influenza_Chain
gacauccagaugacccagucccccuccucccucuccgccuccgucggcgaccgcgucaccaucaccugccgcgccucccaguccaucuccaccuaccucaacugguaccagaagcgccccggcaaggcccccaagcuccucgucuacggcgccuccucccuccaguccggcguccccucccgcuucuccggcuccggcuccggcaccgacuucacccucaccaucgccucccuccagcccgaggacuccgccgucuacuacugccagcagaccuacuccaucccccucuucggccagggcacccgccucgagaucaag

SEQ ID NO: 19964 - RNA, 318 nt, Artificial Sequence
  derived and/or modified sequence opt2 from anti-influenza_Chain
gacauccagaugacccagucccccuccucccucuccgccuccgucggcgaccgcgucaccaucaccugccgcgccucccaguccaucucccgcuaccucaacugguaccagcagaagcccggcaaggcccccaagcuccucaucuacggcgccuccacccuccagaacggcgcccccucccgcuucuccggcuccggcuccggcaccgacuucacccucaccaucuccucccuccagcccgaggacuccgccaccuaccucugccagcaguccuacuccguccccgccuucggcggcggcaccaaggucgaggucaag

SEQ ID NO: 19965 - RNA, 318 nt, Artificial Sequence
  derived and/or modified sequence opt2 from anti-influenza_Chain
ggcauccagaugacccagucccccuccucccucuccgccuccgucggcgaccgcgucaccaucaccugccgcgccucccaguccaucucccgcuaccucaacugguaccuccagaagcccggcaaggcccccaagcuccucaucuccggcgccuccucccuccaguccggcguccccucccgcuucuccggcaccggcuccggcaccgaguucacccucaccaucuccucccuccagcccgaggacuucgccaccuacuacugccagcagaccuucuccaucccccucuucggccagggcaccaaggucgagaucaag

SEQ ID NO: 19966 - RNA, 321 nt, Artificial Sequence
  derived and/or modified sequence opt2 from anti-influenza_Chain
gacauccagaugacccagucccccuccucccucuccgccuccgucggcgaccgcgucuccaucaccugccaggccucccaggacaucucccgcuaccucaacugguaccagcagaagcccggcgaggcccccaagcuccucaucuacgacgccuccaaccucgagaccggcguccccucccgcuucuccggcuccggcuccggcaccgacuucaccuucaccaucuccucccuccagcccgaggacaucgccaccuacuucugccagcaguacggcuaccucccccucaccuucggccccggcaccaaggucgacuccaag

SEQ ID NO: 19967 - RNA, 321 nt, Artificial Sequence
  derived and/or modified sequence opt2 from anti-influenza_Chain
gacauccagaugacccagucccccuccuccuucuccgucucccucggcgaccgcgucaccaucaccugcaaggccuccgaggacaucuacaaccgccucgccugguaccagcagaagcccggcaacgccccccgccuccucaucuccgacaccaccaaccucuggaucggcguccccucccgcuucuccggcuccggcuccggcaaggacuacacccucuccaucaccucccuccaguccgaggacgucgccaccuacuacugccagcaguacugguccucccgcaccuucggcggcggcaccaagcucgagaucaagcgc

SEQ ID NO: 19968 - RNA, 321 nt, Artificial Sequence
  derived and/or modified sequence opt2 from anti-influenza_Chain
gacauccagaugacccagucccccuccuccuucuccgucucccucggcgaccgcgucaccaucaccugcaaggccuccgaggacaucuacaaccgcgucgccugguaccagcagaagcccggcaacgccccccgccuccucauguccgacgccaccucccucggcgccggcguccccucccgcuucuccggcuccggcuccggcaaggaccacacccucuccaucaccucccuccagaccgaggacgucgccaccuacuacugccagcaguacuggaacacccgcaccuucggcggcggcaccaagcucgagaucaagcgc

SEQ ID NO: 19969 - RNA, 321 nt, Artificial Sequence
  derived and/or modified sequence opt2 from anti-influenza_Chain
gacauccagaugacccagucccccuccucccucuccgccuccgucggcgaccgcgucaccaucaccugccgcgccucccaguccaucuccaccuaccucaacugguaccagcagaagcccggcaucccccccaagcuccucaucaacgucgccuccucccuccaguccggcguccccucccgcuucuccggcuccggcuccggcaccgacuucacccucaccaucuccucccuccagcccgaggacuucgccuccuacuacugccagcagaccuacuccuccccccccaccuucggccagggcaccaaggucgagaucaag

SEQ ID NO: 19970 - RNA, 321 nt, Artificial Sequence
  derived and/or modified sequence opt2 from anti-influenza_Chain
gacauccagaugacccagucccccuccacccucuccggcuccgucggcgaccgcgucaccaucaccugccgcgccucccagaacaucggccccuggcucgccugguaccagcaggaguccggcaaggcccccaagcuccucaucucccgcgccuccauccucgaguccggcguccccucccgcuucuccggcaccggcaccggcaccgaguucacccucaccaucuccucccuccagcccgacgacuucgccaccuacuacugccagcacuacaacgccuacuggggcaccuucggccagggcaccaaggucgagaucaac

SEQ ID NO: 19971 - RNA, 321 nt, Artificial Sequence
  derived and/or modified sequence opt2 from anti-influenza_Chain
gucaucuggaugacccagucccccucccuccucuccgccuccaccggcgaccgcgucaccaucuccugccgcaugucccagggcaucuccuccuaccucgccugguaccagcagaagcccggcaaggcccccgagcuccucauccacaccgccuacacccucaaguccggcguccccucccgcuucuccggcuccggcuccggcaaggacuucacccucaccaucuccggccuccaguccgaggacuucgccaccuacuacugccagcaguacuacuccuuccccuacaccuucggccagggcaccaaggucgagaucaag

SEQ ID NO: 19972 - RNA, 321 nt, Artificial Sequence
  derived and/or modified sequence opt2 from anti-influenza_Chain
gacauccagaugacccagucccccuccuccgucuccgccuccgucggcgaccgcgucaccaucaccugccgcgccucccaggacgucuccaccuggcucgccugguaccagcucaagcccggcaaggcccccaagcuccucaucuacgccgccuccucccuccaguccggcguccccucccgcuucuccggcuccggcuccggcaccgacuucacccucaccgucuccucccuccagcccgaggacuucgccaccuacuacugccagcaggccaacuccuuccccuucaccuucggccccggcaccaaggucgacaucaag

SEQ ID NO: 19973 - RNA, 321 nt, Artificial Sequence
  derived and/or modified sequence opt2 from anti-influenza_Chain
gacauccagcucacccagucccccuccuuccucuccgccuccgucggcgacggcgucaccaucaccugccgcgccucccaggacaucuacaucuaccucgccugguaccagcagaagcccggcaaggcccccaagcuccucaucuacgccgccuccacccuccagggcggcguccccucccgcuucuccggcuccggcuccggcaccgaguucacccucaccaucaacaaccuccagcccgaggacuucgccaccuacuucugccagcagcucaacggcuacccccucaccuucggcggcggcaccaaggucgagaucaag

SEQ ID NO: 19974 - RNA, 321 nt, Artificial Sequence
  derived and/or modified sequence opt2 from anti-influenza_Chain
gacauccagcucacccagucccccuccucccucuccgccuccgucggcgaccgcgucacccucaccugccaggccucccaggacauccgcaaguuccucaacugguaccagcagaagcccggcaagggccccaagcuccucaucuacgacgccuccaaccuccagcgcggcguccccucccgcuucuccggcggcggcuccggcaccgacuucacccucaucaucuccucccuccagcccgaggacgucggcaccuacuacugccagcaguacgacggccuccccuucaccuucggcggcggcaccaagcucgagaucaag

SEQ ID NO: 19975 - RNA, 321 nt, Artificial Sequence
  derived and/or modified sequence opt2 from anti-influenza_Chain
gacauccagcucacccagucccccuccucccucuccgccuccaucggcgaccgcgucaccaucaccugccaggccucccaggacauccgcaacucccucaacugguacgagcacaagcccggcaaggcccccaagcuccucauccacgacgccuccaaccucgagaccggcguccccucccgcuucuccggcggcggcuccggcaccgacuucacccucaccaucuccucccuccagcccgaggacuucgccaccuacuacugccagcaggccaacuccuucccccucaccuucggcggcggcaccaaggucgagaucaag

SEQ ID NO: 19976 - RNA, 321 nt, Artificial Sequence
  derived and/or modified sequence opt2 from anti-influenza_Chain
gacauccagcucacccagucccccuccucccucuccgccuccgucggcgaccgcgucaccaucaccugccgcgccucccagggcauccgcaacgaccucggcugguaccagcagaagcccggcaacgcccccaagcgccucaucuucggcgccuccucccuccaguccggcguccccucccgcuucuccggcuccggcuccggcaccgaguucacccucaccaucuccucccuccagcccgaggacuucgccaccuacuacugccuccagcacaacuccuaccccuacaccuucggccagggcaccaagcucgagaucaag

SEQ ID NO: 19977 - RNA, 321 nt, Artificial Sequence
  derived and/or modified sequence opt2 from anti-influenza_Chain
gacauccagcucacccagucccccuccucccucuccgccuccgucggcgaccgcgucaccaucaccugccgcgccucccaguccaucucccgcuaccucaacugguaccagcagaagcccggcaaggcccccaagcuccuccucuucgccgccuccacccuccucgacggcguccccucccgcuucuccggcuccggcuccggcaccgacuucacccucaccaucuccucccuccagcccgaggacuucgccaccuacuacugccagcgcaaccacucccccuccuggaccuucggccagggcacccgcgucgagaucaag

SEQ ID NO: 19978 - RNA, 321 nt, Artificial Sequence
  derived and/or modified sequence opt2 from anti-influenza_Chain
gacauccagaugacccagucccccuccucccucuccgccuccgucggcgaccgcgucaccaugaccugccgcgccucccagaacauccgcuccuaccucaacugguaccagcagcgccccggcaccgcccccaagcuccucaucuacgccgccuccacccuccacuccggcguccccucccgcuucuccggcggcggcuccggcaccgacuucacccucaccaucaacaaccuccagcccgaggacuucgccuccuacuacugccagcaguccuacgacaacccccagaccuucggccagggcaccaaggucgagaucaag

SEQ ID NO: 19979 - RNA, 321 nt, Artificial Sequence
  derived and/or modified sequence opt2 from anti-influenza_Chain
gacauccagaugacccagucccccuccucccucuccgccuccgucggcgaccgcgucaccaucaccugccgcgccaaccaggacaucggcaucuaccucaacugguaccagcagaaccccggcaagguccccaagcuccuccuccacggcgccuccucccuccagggcggcguccccucccgcuucuccgccuccggcuccggcaccgacuucacccucaccauccacucccuccagcccgaggaccucgccaccuacuacugccagcagucccgccgccuccccuacaccuucggccagggcacccgcgucgagcucaag

SEQ ID NO: 19980 - RNA, 321 nt, Artificial Sequence
  derived and/or modified sequence opt2 from anti-influenza_Chain
gacauccagaugacccagucccccuccacccucuccgccuccaucggcgaccgcgucaccaucaccugccgcgccucccaguccaucgccuccuggcucgccugguaccagcagaagcccggcaaggcccccaagcuccucaucuacgaggccgucaaccucgaguccggcguccccucccgcuucuccggcuccggcuccggcaccgacuucacccucaccaucuccucccuccagcccgacgacuucgccaccuacuucugccagcacuacggcaccaucucccagaccuucggcggcggcaccaaggucgagaucaag

SEQ ID NO: 19981 - RNA, 321 nt, Artificial Sequence
  derived and/or modified sequence opt2 from anti-influenza_Chain
gacauccagaugacccagucccccuccucccucuccgccuccgucggcgaccgcgucaccaucaccugccgcgccucccaguccaucuccuccuaccucaacugguaccagcacaagcccggcaaggcccccaagguccucauguacgccgucuccauccuccaguccggcguccccucccgcuucuccggcuccggcuccggcgccgacuucacccucaccaucuccucccuccagcccgaggacuucgccaccuacuacugccagcaguccuacuccuccccccucaccuucggcggcggcaccaaggucgagaucaag

SEQ ID NO: 19982 - RNA, 321 nt, Artificial Sequence
  derived and/or modified sequence opt2 from anti-influenza_Chain
gacauccagaugacccagucccccuccucccucuccgccuccgucggcgaccgcgucaccaucaccugccgcgccucccagaacaucaagcgcuacuucaacugguaccagcagaagcccggcaaggcccccaagcuccucaucuacgccgccuccaaccucgagaacggcguccccucccgcuucuccggcuccggcuccggcaccgacuucacccucaccaucuccucccuccagcccgaggacuucgccaccuacuacugccagcaguccuucuccaaguccuggaccuucggccagggcaccaacgucgacaucaag

SEQ ID NO: 19983 - RNA, 321 nt, Artificial Sequence
  derived and/or modified sequence opt2 from anti-influenza_Chain
gacauccagaugacccagucccccuccucccucuccgccuccgucggcgaccgcgucaccaucaccugccgcgccucccagaacaucuacaaguaccucaacugguaccagcagcgccccggcaaggcccccaagggccucaucuccgccgccuccggccuccaguccggcguccccucccgcuucuccggcuccggcuccggcaccgacuucacccucaccaucaccucccuccagcccgaggacuucgccaccuacuacugccagcaguccuacucccccccccucaccuucggcggcggcacccgcgucgagaucaag

SEQ ID NO: 19984 - RNA, 321 nt, Artificial Sequence
  derived and/or modified sequence opt2 from anti-influenza_Chain
gacauccagaugacccagucccccuccucccucuccuccuccgucggcgaccgcgucaccaucaccugccgcgccucccaguccaucggcgccuacgucaacugguaccagcagaaggccggcaaggccccccagguccucaucuucggcgccuccaaccuccaguccggcguccccucccgcuucuccggcuccggcuccggcaccgacuucacccucaccaucuccucccuccagcccgaggacuucgccaccuacuucugccagcagaccuacuccacccccaucaccuucggccagggcacccgccucgagaucaag

SEQ ID NO: 19985 - RNA, 321 nt, Artificial Sequence
  derived and/or modified sequence opt2 from anti-influenza_Chain
gacauccagaugacccagucccccuccucccucuccgccuccgucggcgaccgcgucaccaucuccugccgcgccucccaguccaucuccaccuaccucaacugguaccagcagcagcccggcaaggcccccaagguccucaucuucggcgccaccaaccuccaguccggcguccccucccgcuucuccggcuccggcuccggcaccgacuucacccucaccaucuccucccuccagcccgaggacuucgccaccuacuacugccagcaguccuacaacaccccccucaucuucggccagggcaccaagcucgagaucaag

SEQ ID NO: 19986 - RNA, 321 nt, Artificial Sequence
  derived and/or modified sequence opt2 from anti-influenza_Chain
gacauccagaugacccagucccccuccucccucuccgccuccgucggcgaccgcgucaccaucuccugccgcgccucccaguccaucuccaccuaccucaacugguaccagcagcagcccggcaaggcccccaagguccucaucuccggcgccaccaaccuccaguccggcguccccucccgcuucuccggcuccggcuccggcaccgacuucacccucaccaucuccucccuccagcccgaggacuucgccaccuacuacugccagcaguccuacaacaccccccucaucuucggccagggcaccaagcucgagaucaag

SEQ ID NO: 19987 - RNA, 321 nt, Artificial Sequence
  derived and/or modified sequence opt2 from anti-influenza_Chain
gacauccagaugacccagucccccuccucccucuccgccuccgucggcgaccgccucaccaucaccugccgcgccucccaguccaucuccaccuaccuccacugguaccagcagaagcccggcaaggcccccaagcuccucaucuacgccgccuccucccuccaguccggcguccccucccgcuucuccggcucccgcuccggcaccgacuucacccucaccaucuccucccuccagcccgacgacuucgccaccuacuacugccagcaguccuacucccccccccucaccuucggccccggcaccaaggucgacaugaag

SEQ ID NO: 19988 - RNA, 321 nt, Artificial Sequence
  derived and/or modified sequence opt2 from anti-influenza_Chain
gacauccagaugacccagucccccuccucccucuccgccuccgucggcgaccgcgucaccaucaccugccgcgccucccaguccaucuccaacuaccucaacugguaccagcacaagcccggcgaggcccccaagcuccucaacuacgccgccuccucccuccaguccggcguccccucccgcuucuccgccuccggcuccggcaccgacuucacccucaccaucuccucccuccagcccgaggacuucgccaccuacuacugccagcaguccuacaacacccccaucaccuucggccagggcacccgccucgagaucaag

SEQ ID NO: 19989 - RNA, 321 nt, Artificial Sequence
  derived and/or modified sequence opt2 from anti-influenza_Chain
gacauccagaugacccagucccccuccucccucuccgccuccgucggcgaccgcgucaccaucaccugccgcgccucccaguccaucuccaacuaccucaacugguaccagcacaagcccggcgaggcccccaagcuccucaacuacgccgccuccucccuccaguccggcguccccucccgcuucuccgccuccggcuccggcaccgacuucacccucuccaucuccggccuccagcccgaggacuucgccaccuacuacugccagcaguccuacaacacccccaucaccuucggccccggcacccgccucgagaucaag

SEQ ID NO: 19990 - RNA, 321 nt, Artificial Sequence
  derived and/or modified sequence opt2 from anti-influenza_Chain
gacauccagaugacccagucccccuccucccucuccgccuccgucggcgaccgcgucaccaucaccugccgcgccucccaguccaucuccaccuaccucaacugguaccagcagaagcccggcaaggcccccaagcuccucaucuacgccgccuccucccuccacuccggcguccccucccgcuucuccggcuccggcuccggcaccgacuucgcccucaccaucuccucccuccagcccgaggacuucgccaccuacuacugccagcaguccuacuccccccccaucaccuucggccagggcacccgccucgagaucaag

SEQ ID NO: 19991 - RNA, 321 nt, Artificial Sequence
  derived and/or modified sequence opt2 from anti-influenza_Chain
gacauccagaugacccagucccccuccucccucuccgccuccgucggcgaccgcgucaccaucaccugccgcgccucccagaccaucuccaccuaccucaacugguaccagcagaaguccggcaaggcccccaagcuccucaucuacgccgccuccggccuccaguccggcguccccucccgcuucuccggcuccggcuccggcaccgacuucacccucaccaucuccucccuccagcccgaggacuucgccaccuacuucugccagcaguccuacaacaccccccucaccuucggccagggcaccaaggucgagaucaag

SEQ ID NO: 19992 - RNA, 321 nt, Artificial Sequence
  derived and/or modified sequence opt2 from anti-influenza_Chain
gacauccagaugacccagucccccuccucccucuccgccuccgucggcgaccgcgucaccaucuccugccgcgccucccaguccaucuccaccuaccucaacugguaccagcagcagcccggcaaggcccccaagguccucaucuccggcgccaccgaccuccaguccggcguccccucccgcuucuccggcuccggcuccggcaccgacuucacccucaccaucuccucccuccagcccgaggacuucgccaccuacuacugccagcaguccuacaacaccccccucaucuucggccagggcaccaagcucgagaucaag

SEQ ID NO: 19993 - RNA, 321 nt, Artificial Sequence
  derived and/or modified sequence opt2 from anti-influenza_Chain
gacauccaggucacccagucccccuccucccucuccgccuccgucggcgaccgcgucaccaucaccugccgcgccucccagaacaucuacaaguaccucaacugguaccagcagcgccccggcaaggcccccaagggccucaucuccgccgccuccggccuccaguccggcguccccucccgcuucuccggcuccggcuccggcaccgacuucacccucaccaucaccucccuccagcccgaggacuucgccaccuacuacugccagcaguccuacucccccccccucaccuucggcggcggcacccgcgucgacaucaag

SEQ ID NO: 19994 - RNA, 321 nt, Artificial Sequence
  derived and/or modified sequence opt2 from anti-influenza_Chain
caguccguccucacccagccccccuccgaguccgucucccccggccagaccgccuccgucaccugcuccggccacaagcucggcgacaaguacgucuccugguaccagcagaagcccggccagucccccguccuccucaucuaccaggacaaccgccgccccuccggcauccccgagcgcuucaucggcuccaacuccggcaacaccgccacccucaccaucuccggcacccaggcccucgacgaggccgacuacuacugccaggccugggacuccuccaccgccgucuucggcggcggcaccaagcucaccguccucggc

SEQ ID NO: 19995 - RNA, 321 nt, Artificial Sequence
  derived and/or modified sequence opt2 from anti-influenza_Chain
gacauccagcucacccagucccccuccucccucuccgccuccgucggcgaccgcgucaccaucaccugccgcgccucccagggcaucuccaccuaccucgccugguaccagcagaagcccggcaagguccccaagcuccucaucuacgccgccuccacccuccaguccggcguccccucccgcuucuccggcuccggcuccggcaccgacuucacccucaccaucuccucccuccagcccgaggacgucgccaccuacuacugccagaaguacaacuccgcccccuccuucggccccggcaccaaggucgacaucaagcgc

SEQ ID NO: 19996 - RNA, 321 nt, Artificial Sequence
  derived and/or modified sequence opt2 from anti-influenza_Chain
uccguccucacccagccccccuccgccuccggcucccgcggccaguccaucaccaucuccugcaccggcuccaccuccgacaucggcuccuacaacuacgucuccugguaccagcagcaccccggcaccgcccccaaggucauccucuacgaggucucccagcgccccuccggcguccccgaccgcuucuccggcuccaaguccggcaacaccgccuuccucaccgucuccggccuccaggccgaggacgaggccgacuacuacugcgccuccuacgccggcaacaacaucuacgucuucggcuccggcaccaaggucacc

SEQ ID NO: 19997 - RNA, 321 nt, Artificial Sequence
  derived and/or modified sequence opt2 from anti-influenza_Chain
uccgcccucacccagccccccuccgccuccggcucccgcggccaguccaucaccaucuccugcaccggcuccaccuccgacaucggcuccuacaacuacgucuccugguaccagcagcaccccggcaccgcccccaaggucauccucuacgaggucucccagcgccccuccggcguccccgaccgcuucuccggcuccaaguccggcaacaccgccuuccucaccgucuccggccuccaggccgaggacgaggccgacuacuacugcgccuccuacgccggcaacaacaucuacgucuucggcuccggcaccaaggucacc

SEQ ID NO: 19998 - RNA, 321 nt, Artificial Sequence
  derived and/or modified sequence opt2 from anti-influenza_Chain
gagaucguccucacccagucccccgccacccucucccucucccccggcgagcgcgccacccucuccugccgcgccucccaguccgucuccaccuuccucgccugguaccagcagaagcccggccaggccccccgccuccucauguacgacgccuccaaccgcgccaccggcauccccgcccgcuucuccggcuccggcuccggcaccgacuucacccucaccaucuccucccucgagcccgaggacuucgccaucuacuacugccagcagcgcucccacuggccccccaucuucggccagggcacccgccucgagaucaag

SEQ ID NO: 19999 - RNA, 321 nt, Artificial Sequence
  derived and/or modified sequence opt2 from anti-influenza_Chain
gacauccagaugacccagucccccgccucccucuccgucuccgucggcgagaccgucaccaucaccugccgcgccuccgagaagaucuacuccaaccucgccugguaccagcagaaggagggcaaguccccccagcuccucgucuacgccgccauccgccucgccgacggcguccccucccgcuucuccggcuccggcuccggcacccaguucucccucaagaucaacucccuccaguccgaggacuucggcaccuacuacugccagcacuucuggggcaccccccucaccuucggcgccggcaccaagcucgagcucaag

SEQ ID NO: 20000 - RNA, 321 nt, Artificial Sequence
  derived and/or modified sequence opt2 from anti-influenza_Chain
gacauccagaugacccagucccccuccuccgucuccgccuccgucggcgaccgcgucaccaucaccugccgcgccucccaggacaucuccaccuggcucgccugguaccagcagaagcccggcaaggcccccaagcuccucaucuacgccgccuccucccuccaguccggcguccccucccgcuucuccggcuccggcuccggcaccgacuucacccucaccaucuccucccuccagcccgaggacuucgccaccuacuucugccagcaggccaacuccuucccccccaccuucggccagggcaccaagcucgagaucaag

SEQ ID NO: 20001 - RNA, 321 nt, Artificial Sequence
  derived and/or modified sequence opt2 from anti-influenza_Chain
gacauccagaugacccagucccccuccuccgucuccgccuccgucggcgaccgcgucaccaucaccugccgcgccucccaggacaucuccaccuggcucgccugguaccagcagaagcccggcaaggcccccaagcuccucaucuacgccgccuccucccuccaguccggcguccccucccgcuucuccggcuccggcuccggcaccgacuucacccucaccaucuccucccuccagcccgaggacuucgccaccuacuucugccagcaggccaacuccuucccccccaccuucggcugcggcaccaagcucgagaucaag

SEQ ID NO: 20002 - RNA, 321 nt, Artificial Sequence
  derived and/or modified sequence opt2 from anti-influenza_Chain
gacauccagaugacccagucccccuccuccgucuccgccuccgucggcgaccgcgucaccaucaccugccgcgccucccaggacaucuccaccuggcucgccugguaccagcagaagcccggcaagugccccaagcuccucaucuacgccgccuccucccuccaguccggcguccccucccgcuucuccggcuccggcuccggcaccgacuucacccucaccaucuccucccuccagcccgaggacuucgccaccuacuucugccagcaggccaacuccuucccccccaccuucggccagggcaccaagcucgagaucaag

SEQ ID NO: 20003 - RNA, 321 nt, Artificial Sequence
  derived and/or modified sequence opt2 from anti-influenza_Chain
gacauccagaugacccagucccccuccuccgucuccgccuccgucggcgaccgcgucaccaucaccugccgcgccucccaggacaucuccaccuggcucgccugguaccagcagaagcccggcaaggcccccaagcuccucaucuacgccgccuccucccuccaguccggcguccccucccgcuucuccggcuccggcuccggcaccgacuucacccucaccaucuccucccuccagcccgaggacuucgccaccuacuacugccagcaggccaacuccuucccccccaccuucggccagggcaccaagcucgagaucaag

SEQ ID NO: 20004 - RNA, 321 nt, Artificial Sequence
  derived and/or modified sequence opt2 from anti-influenza_Chain
gacauccagaugacccagucccccuccuccgucuccgccuccgucggcgaccgcgucaccaucaccugccgcgccucccaggacaucuccaccuggcucgccugguaccagcagaagcccggcaaggcccccaagcuccucaucuacgccgccuccucccuccaguccggcguccccucccgcuucuccggcuccggcuccggcaccgacuucacccucaccaucuccucccuccagcccgaggacuucgccaccuacuacugccagcaggccaacuccuucccccccaccuucggcugcggcaccaagcucgagaucaag

SEQ ID NO: 20005 - RNA, 321 nt, Artificial Sequence
  derived and/or modified sequence opt2 from anti-influenza_Chain
gacauccagaugacccagucccccuccuccgucuccgccuccgucggcgaccgcgucaccaucaccugccgcgccucccaggacaucuccaccuggcucgccugguaccagcagaagcccggcaagugccccaagcuccucaucuacgccgccuccucccuccaguccggcguccccucccgcuucuccggcuccggcuccggcaccgacuucacccucaccaucuccucccuccagcccgaggacuucgccaccuacuacugccagcaggccaacuccuucccccccaccuucggccagggcaccaagcucgagaucaag

SEQ ID NO: 20006 - RNA, 321 nt, Artificial Sequence
  derived and/or modified sequence opt2 from anti-influenza_Chain
gagaucguccucacccagucccccgccacccucucccucucccccggcgagcgcgccacccucuccugccgcgccucccgcuccaucaccaccuuccucgccugguaccagcagaagcccggccaggccccccgccuccucaucuacgacgccuccaaccgcgccaccggcguccccgcccgcuucuccggcuccggcuccggcaccgacuucacccucaccaucaacucccucgagcccgacgacuucgccaucuacuacugccagcagcgcgaccacuggccccccaucuucggccagggcacccgccucgagaucaag

SEQ ID NO: 20007 - RNA, 321 nt, Artificial Sequence
  derived and/or modified sequence opt2 from anti-influenza_Chain
gagaucguccucacccagucccccgccacccucucccucucccccggcgagcgcgccacccucuccugccgcgccucccgcuccaucaccaccuuccucgccugguaccagcagaagcccggccaggccccccgccuccucaucuacgacgccuccaaccgcgccaccggcguccccgcccgcuucuccggcuccggcuccggcaccgacuucacccucaccaucaacucccucgagcccgacgacuucgccaucuacuacugccagcagcgcgaccacuggccccccaucuucggcugcggcacccgccucgagaucaag

SEQ ID NO: 20008 - RNA, 324 nt, Artificial Sequence
  derived and/or modified sequence opt2 from anti-influenza_Chain
gagaucguccucacccagucccccggcacccucucccucucccccggcgagcgcgccacccucuccugccgcgccucccagaccgucuccuccuccuaccucgccugguaccagcagaagcccggccaggccccccgccuccucaucuacggcgccuccucccgcgccaccggcauccccgaccgcuucuccggcuccggcuccggcaccgacuucacccucaccaucucccgccucgagcccgaggacuucgccgucuacuacugccagcaguacggcaacucccccuacaccuucggccagggcaccaagcucgagaucaag

SEQ ID NO: 20009 - RNA, 324 nt, Artificial Sequence
  derived and/or modified sequence opt2 from anti-influenza_Chain
gagaucguccucacccagucccccggcacccucuccgucucccccggcgagcgcgccacccucuccugccgcgccucccaguccaucuccuccggcuaccucgccugguaccagcagaagcccggccaggccccccgccuccucaucuacggcgccuccucccgcgccaccggcauccccgaccgcuucuccggcuccggcuccggcaccgacuucacccucaccaucucccgccucgagcccgaggacuucgccgucuacuacugccagcaguacggcaccuccccccagaccuucggccagggcaccaaggucgagaucaag

SEQ ID NO: 20010 - RNA, 324 nt, Artificial Sequence
  derived and/or modified sequence opt2 from anti-influenza_Chain
gaggucguccucacccagucccccggcacccucucccucucccccggccagcgcgccacccucuccugccgcgccucccaguccgucuccuccuccuaccucgccugguaccagcagaagcccggccaggccccccgccuccucaucuacgacgccuccaaccgcgccaccggcauccccgaccgcuucuccggcuccggcuccggcaccgacuucacccucaccaucucccgccucgagcccgaggacuucgccgucuacuacugccagcaguacggcuccucccccuacaccuucggccagggcaccaagcucgagaucaag

SEQ ID NO: 20011 - RNA, 324 nt, Artificial Sequence
  derived and/or modified sequence opt2 from anti-influenza_Chain
gacauccagcucacccagucccccuccucccucuccgccuccgucggcgaccgcgucaccaucaccugccgcgccucccagggcaucaucaccuaccucaacugguaccagcagaagcccggcaaggcccccaagcuccucaucuacgccaccuacucccuccagaacggcguccccucccgcuucuccggcuccggcuccggcaccgacuucacccucaccaucuccucccuccagcccgaggacuucgccaccuacuacugccagcaguccuacuccucccucauguucaccuucggccagggcaccaagcucgacaucaag

SEQ ID NO: 20012 - RNA, 324 nt, Artificial Sequence
  derived and/or modified sequence opt2 from anti-influenza_Chain
gagaccguccucacccagucccccggcacccucucccucacccccggcgagcgcgccacccucuccugccgcgucggccaguccgucuccggcucccaccucgccugguaccagcagaagcccggccaggccccccgccuccucaucuacggcgccuccucccgcgccaccggcauccccgaccgcuucggcggcuccgucuccggcaccgacuucacccucaccaucucccgccucgagcccgaggacuccgccgucuacuacugccagcaguacggcgacucccgcuacaccuucggccagggcaccaagcucgagaucaag

SEQ ID NO: 20013 - RNA, 324 nt, Artificial Sequence
  derived and/or modified sequence opt2 from anti-influenza_Chain
gagaucguccucacccagucccccggcacccucucccucucccccggcgagcgcgccacccucuccugccgcgccucccaguccgucuccuccucccagcucgccugguaccagcagaagcccggccaggccccccgccucaucaucuacggcgccuccacccgcgccaccggcauccccgaccgcuucuccggcuccggcuccggcaccgacuucacccucaccaucggccgccucgagcccgaggacuucgccgucuucuucugccagcaguacuccaccuccccccccaccuucggccagggcaccaaggucgacuucaag

SEQ ID NO: 20014 - RNA, 324 nt, Artificial Sequence
  derived and/or modified sequence opt2 from anti-influenza_Chain
gacaucguccucacccagucccccggcacccucucccucucccccggcgagcgcgccacccucuccugccgcgccucccaguccgucuccuccuccuaccucgccugguaccagcagaagcccggccaggccccccgccucgucauguacggcgccgccacccgcgccaccggcauccccgaccgcuucuccggcuccggcuccggccccgacuucacccucaccaucucccgccucgagcccgaggacuucgccauguacuacugccagcaguacggcaacucccccaucaccuucggccagggcacccgccucgagaucaag

SEQ ID NO: 20015 - RNA, 324 nt, Artificial Sequence
  derived and/or modified sequence opt2 from anti-influenza_Chain
gagaucguccucacccagucccccgccacccucucccucucccccggcgagcgcgccacccucuccugccgcgccucccaguccgucuccuccuaccucgccugguaccagcagaagcccggccaggccccccgccuccucaucuacgacgccuccaaccgcgccaccggcauccccgcccgcuucuccggcuccggcuccggcaccgacuucacccucaccaucuccucccucgagcccgaggacuucgccgucuacuacugccagcagcgcucccacuggccccccaucaccuucggccagggcacccgccucgagaucaag

SEQ ID NO: 20016 - RNA, 324 nt, Artificial Sequence
  derived and/or modified sequence opt2 from anti-influenza_Chain
uccuacgagcucacccagccccccuccgucuccgucucccccggccagaccgcccgcaucaccugcuccggcgacgcccuccccaagcagaacgccuacugguaccagcagaagcccggccaggcccccguccuccucaucuacaaggacuccgagcgccccuccggcauccccgagcgcuucuccggcuccuccuccggcaccaccgucacccucaccaucuccggcguccaggccgaggacgaggccgacuacuacugccaguccgccgacuccuccggcaccuccugggucuucggcggcggcaccaagcucaccguccuc

SEQ ID NO: 20017 - RNA, 324 nt, Artificial Sequence
  derived and/or modified sequence opt2 from anti-influenza_Chain
uccuacguccucacccaggcccccuccgucuccgucgcccccggccagaccgcccgcaucaccugcggcggcaacgccaucggcuccaagaagguccacugguaccagcacaaggccggccaggcccccguccucgucgucuacgacgacaccgaccgccccuccggcauccccgagcgcuucuccggcuccaacuccugguccaccgccacccucaccaucaaccgcgucgaggccggcgacgaggccgacuacuacugccaggucugggacuucaccaucgaccacgucgucuucggcggcggcaccaagcucaccguccuc

SEQ ID NO: 20018 - RNA, 324 nt, Artificial Sequence
  derived and/or modified sequence opt2 from anti-influenza_Chain
gagaucguccucacccagucccccggcacccucucccucucccccggcgagcgcgccacccucuccugccgcgccucccaguccgucuccuccuccuaccucgccugguaccagaagaagcccggccaggccccccgccuccucaucuacggcgccuccacccgcgccaccggcauccccgaccgcuucaccggcuccggcuccggcaccgacuucacccucuccaucucccgccucgagcccgaggacuucgccgucuacuacugccagcacuucggcaccuccgucuucaccuucggcggcggcaccaaggucgagaucaag

SEQ ID NO: 20019 - RNA, 324 nt, Artificial Sequence
  derived and/or modified sequence opt2 from anti-influenza_Chain
gagaucgucaugacccagucccccgccacccucuccgucucccccggcgagcgcgccacccucuccugccgcgccucccaguccgucggcaacucccucgccugguaccagcagcgccccggccaggccccccgccuccucaucuacggcgccuccacccgcgccaccggcauccccccccgcuucuccggcuccggcuccggcaccgaguucacccucaccaucuccucccuccagaccgaggacuucgccgucuacuacugccagcaguacaucaacuggcgcccccucuccuucggcggcggcaccaaggucgagaucaag

SEQ ID NO: 20020 - RNA, 324 nt, Artificial Sequence
  derived and/or modified sequence opt2 from anti-influenza_Chain
caggaguccggcgccgagcucguccgccccggcgccuccgucaagcucuccugcaaggacuccggcuacaccuucaccaccuacuggaugaacugggucaagcagcgccccgagcagggccucgaguggaucggccgcaucgaccccuacgacuccgagacccacuacaaccagaaguucaaggacaaggccauccucaccgucgacaaguccuccaacaccgccuacaugcagcucuccucccucaccuccgaggacuccgccgucuacuacugcguccgcggcggcuccaccgucgccuacuucggcgucuggggccagggc

SEQ ID NO: 20021 - RNA, 324 nt, Artificial Sequence
  derived and/or modified sequence opt2 from anti-influenza_Chain
gagaucguccucacccagucccccggcacccucucccucucccccggcgagcgcgccacccucuccugccgcgccucccagcgcgucuccuccuaccucgccugguaccagcagaagcccggccaggccccccgccuccucaucuacggcgccuccacccgcgccgccggcauccccgaccgcuucuccggcuccggcuccggcaccgacuucacccucaccaucucccgccucgagcccgaggacuccgccgucuacuacugccagcaguacggccgcaccccccucaccuucggcggcggcaccaaggucgagaucaagcgc

SEQ ID NO: 20022 - RNA, 324 nt, Artificial Sequence
  derived and/or modified sequence opt2 from anti-influenza_Chain
gagaucgucaugacccagucccccggcacccucucccucucccccggcgagcgcgccacccucuccugccgcgccucccaguccgucuccuccuccuaccucgccugguaccagcagaagcccggccaggccccccgccuccucaucuucggcgccuccucccgcgccaccggcauccccgaccgcuucuccggcuccggcuccggcaccgacuucacccucaccaucucccgccucgagcccgaggacuucgccgucuacuacugccagcaguacggcuccucccucaccuucggcggcggcaccaagcucgagaucaagcgc

SEQ ID NO: 20023 - RNA, 324 nt, Artificial Sequence
  derived and/or modified sequence opt2 from anti-influenza_Chain
gagaucguccucuaccagucccccggcacccucucccucucccccggcgagcgcgccacccucuccugccgcgccucccagcgcgucuccuccuaccucgccugguaccagcagaagcccggccaggccccccgccuccucaucuacggcgccuccacccgcgccgccggcauccccgaccgcuucuccggcuccggcuccggcaccgacuucacccucaccaucucccgccucgagcccgaggacuccgccgucuacuacugccagcaguacggccgcaccccccucaccuucggcggcggcaccaaggucgagaucaagcgc

SEQ ID NO: 20024 - RNA, 324 nt, Artificial Sequence
  derived and/or modified sequence opt2 from anti-influenza_Chain
gacaucguccucacccaggcccccuccgucuccgucucccccggccagaccgccuccaucaccugcuccggcgaccgccucggcgagaaguucgccuccugguaccagcagaagcccggccagucccccguccucgucaucuacgaggacuccaagcgccccuccggcauccccgaccgcuucuccggcuccaacuccggcaacaccgccacccucaccaucuccggcacccagaucauggacgagggcgacuucuucugccaggccugggacuccuccaccgucgucuucggcggcggcaccaagcucaccguccucggccag

SEQ ID NO: 20025 - RNA, 324 nt, Artificial Sequence
  derived and/or modified sequence opt2 from anti-influenza_Chain
gacaucgagcucacccagucccccuccgucuccgucucccccggccagaccgccuccaucaccugcuccggcgacaagcucggcgacaaguucgucugcugguaccagcagaaggccggccagucccccaucgucgucaucuaccaggacgacaagcgccccuccggcauccccgagcgcuucuccggcuccaacuccggcaacaccgccacccucaccaucuccggcacccaggccauggacgaggccgacuacuucugccaggccugggacuccaccaccgucgucuucggcggcggcaccaagcucaccguccucggccag

SEQ ID NO: 20026 - RNA, 324 nt, Artificial Sequence
  derived and/or modified sequence opt2 from anti-influenza_Chain
caguccguccucacccagccccccuccgccuccggcucccgcggccaguccaucaccaucuccugcaccggcuccaccuccgacaucggcuccuacaacuacgucuccugguaccagcagcaccccggcaccgcccccaaggucauccucuacgaggucucccagcgccccuccggcguccccgaccgcuucuccggcuccaaguccggcaacaccgccuuccucaccgucuccggccuccagaccgacgacgaggccgacuacuacugcgccuccuacgccggcaacaacaucuacgucuucggcuccggcaccaaggucacc

SEQ ID NO: 20027 - RNA, 327 nt, Artificial Sequence
  derived and/or modified sequence opt2 from anti-influenza_Chain
aacuucaugcucacccagccccacuccgucuccgagucccccggcaagaccgucaccaucuccugcaccggcuccggcggcaacaucgcccgcaacuacguccagugguaccagcagcgccccggcuccgcccccgucaccgucauccucgaggacgacaagcgccccuccggcauccccgaccgcuucuccggcuccaucgaccgcuccuccaacuccgccucccucaccaucuccggccuccgcaccgaggacgaggcccucuacuacugccaguccuacgacgacuccgaccucgucgucuucggcggcggcaccaagcucacc

SEQ ID NO: 20028 - RNA, 327 nt, Artificial Sequence
  derived and/or modified sequence opt2 from anti-influenza_Chain
augcucgagccccuccagauccucuccaucugcuccuucauccucuccgcccuccacuucauggccuggaccaucggccaccucaaccagaucaagcgcggcgucaaccucaagauccagauccgcaaccccaacaaggaggccaucaaccgcgaggucuccauccuccgccacaacuaccagaaggagauccaggccaaggagaccaugaagaagauccucuccgacaacauggagguccucggcgaccacaucgucgucgagggccucuccaccgacgagaucaucaagaugggcgagaccguccucgaggucgaggagcuccag

SEQ ID NO: 20029 - RNA, 327 nt, Artificial Sequence
  derived and/or modified sequence opt2 from anti-influenza_Chain
gacauccgccucacccagucccccgccacccucuccgucucccccggcgagcgcgccacccucuccugccgcgccucccacuccgucucccgcaaccucgccugguaccagcagaagcccggccgcgccccccgccuccucgucuacgacaccuccucccgcgccaccggcauccccgcccgcuucuccggcuccggcuccggcaccgaguucacccucaccaucuccucccuccaguccgaggacuucgccgucuacuacugccagcaguacaacaacuggccccgcaccuucggccagggcaccaaggucgacaucaagcgcacc

SEQ ID NO: 20030 - RNA, 327 nt, Artificial Sequence
  derived and/or modified sequence opt2 from anti-influenza_Chain
gagaucgucaugacccagucccccggcacccucucccucucccccggcgagcgcgccacccucuccugccgcgccucccaguccgucuccuccuccuaccucgccugguaccagcagaagcccggccaggccccccgccuccucaucuacggcgccuccacccgcgccaccggcguccccgaccgcuuccacggcggcggcuccggcaccgacuucacccucaccaucucccgccucgagcccgaggacuucgccgucuacuacugccagcaguacgacaccuccuccggccucaccuucggcggcggcaccaaggucgagaucaag

SEQ ID NO: 20031 - RNA, 327 nt, Artificial Sequence
  derived and/or modified sequence opt2 from anti-influenza_Chain
gagaucgucaugacccaguuccccgccacccucuccgucucccccggcgagcgcgucacccucuccugccgcgccucccaguccgucuccaacaaccucgccugguaccagcagaagcccggccagcccccccgccuccucaucuacgacgccuccacccgcgccaccggcguccccgccaaguucuccggcaccggcuccggcaccgaguucacccucuccaucuccucccuccaguccgaggacuucgccgucuacuacugccagcaguaccacaacuggccccccuccuacuccuucggccucggcaccaagcucgagaucaag

SEQ ID NO: 20032 - RNA, 327 nt, Artificial Sequence
  derived and/or modified sequence opt2 from anti-influenza_Chain
gagaucauccucgcccagucccccggcacccucucccucucccccggcgagcgcgccacccucuccugccgcgccucccaguucgucuccacccgcucccucgccugguaccagcagcgccccggccaggccccccgccuccucaucuacggcgccuccucccgcgccaccggcauccccgaccgcuucuccggcuccggcuccggcaccgacuucacccucaccaucucccgccucgagcccgaggacuucgccgucuacuacugccagcacuacggcuacuccccccgcuacgccuucggccagggcuccaaggucgagaucaag

SEQ ID NO: 20033 - RNA, 327 nt, Artificial Sequence
  derived and/or modified sequence opt2 from anti-influenza_Chain
gagaucguccucacccagucccccggcacccucucccucucccccggcgagcgcgccacccucuccugccgcgccucccacuucgucaacuaccgcucccucgccugguaccagcagacccccggccaggucccccgccuccucaucuacggcgccuccacccgcgccaccggcauccccgaccgcuucuccggcuccggcuccggcaccgacuucacccucaccaucucccgccucgagcccgaggacuucgccgucuacuucugccagcaguacggcggcuccccccgcuacaccuucggccagggcacccgccucgagaucaag

SEQ ID NO: 20034 - RNA, 327 nt, Artificial Sequence
  derived and/or modified sequence opt2 from anti-influenza_Chain
gagaucguccucacccagucccccggcacccucucccucucccccggcgagcgcgccacccucuccugccgcgccucccacuucgucaucggccgcgccgucgccugguaccagcagaagcccggccaggccccccgccuccucaucuacggcgccuccucccgcgccaccggcauccccgaccgcuucuccggcuccggcuccggcaccgacuucacccucaccaucucccgccucgagaccgaggacuucgccgucuucuacugccagcacuacggcuccuccccccgcuacgccuucggccagggcaccaagcucgagaucaag

SEQ ID NO: 20035 - RNA, 327 nt, Artificial Sequence
  derived and/or modified sequence opt2 from anti-influenza_Chain
gagaucguccucacccagucccccgccacccucucccucucccccggcgagcgcgccacccucuccugccgcgccucccaguccgucggcaacuaccucgccugguaccagcagaagcccggccaggccccccgccuccucaucuacgacuccuccaaccgcgcccccggcauccccgcccgcuucuccggcuccggcuccggcaccgacuucacccucaccaucuccucccucgcccccgaggacuucgccgucuacuacugccagcagcgcuccaaguggccccccauguacuccuucggccacggcaccaagcucgagaucaag

SEQ ID NO: 20036 - RNA, 327 nt, Artificial Sequence
  derived and/or modified sequence opt2 from anti-influenza_Chain
caggccgucgucacccaggagcccucccucaccgucucccccggcggcaccgucacccucaccugcggcuccuccaccggccccgucaccuccggccacuaccccuacugguuccagcagaagcccggccaggccccccgcacccucaucuccgccaccuccaacacccacuccuggacccccgcccgcuucuccggcucccuccucggcggccgcgccgcccucacccucuccggcgcccagcccgaggacgaggccgacuacuacugcuuccucuccuacuccggcgccugggucuucggcggcggcaccacccucaccguccuc

SEQ ID NO: 20037 - RNA, 327 nt, Artificial Sequence
  derived and/or modified sequence opt2 from anti-influenza_Chain
gccauccagaugacccagucccccuccucccucuccgccuccgucggcgaccgcgucaccaucaccugccgcgccucccagaacauccgcuccuaccucaacugguaccagcagaagcccggcaaggcccccaaccuccucaucuacggcaccaccucccucgaguccggcguccccucccgcuucuccggcuccggcuccggcaccgacuucacccucaccaucuccucccuccagcccgaggacuucgccaccuacuacugccagcaguccuaccacaccccccagaccuucggccagggcaccaaggucgagaucaagcgcacc

SEQ ID NO: 20038 - RNA, 327 nt, Artificial Sequence
  derived and/or modified sequence opt2 from anti-influenza_Chain
gacauccagaugacccagucccccuccucccucuccgccuccgucggcgaccgcaucaccaucaccugccgcgccucccagggcaucgacaacuaccucgccugguuccagcagaagcccggcaagguccccgagcuccucaucuacgccgccuccacccuccaguccggcguccccucccgcuucuccggcuccggcuccggcaccggcuucacccucaccaucuccucccuccagcccgaggacgucgccaccuacuacugccagaaguacgacuccgccccccucaccuucggcggcggcaccaaggucgacaucaagcgcacc

SEQ ID NO: 20039 - RNA, 327 nt, Artificial Sequence
  derived and/or modified sequence opt2 from anti-influenza_Chain
gacauccagcucacccagucccccuccucccucuccgccuccgucggcgaccgcgucaccaucaccugccgcgccucccagggcaucaccgacuaccucgccugguaccagcagaagcccggcaccauccccaagcuccucaucuacgccgccuccacccuccaguccggcguccccucccgcuucuccggcggcggcuacggcaccgacuucacccucaccaucuccucccuccagcccgaggacgucgccaccuacuacugccagaaguacaacuccgccccccucaccuucggcggcggcaccaaggucgagaucaagcgcacc

SEQ ID NO: 20040 - RNA, 327 nt, Artificial Sequence
  derived and/or modified sequence opt2 from anti-influenza_Chain
gacaucgucaugacccagucccccuucucccucucccucucccccggcgagcgcgccacccucuccugccgcgccucccaguccaucuccaacuaccucgccugguaccagcagaagcccggccaggccccccgccuccucaucuacgacuccuccaaccgcgccaccggcguccccgcccgcuucuccggcuccggcuccggcaccgacuucacccucaccaucuccucccucgagcccgaggacuucgccgucuacuacugccagcagcgcuccaacuggauguacaccuucggccagggcaccaaggucgagaucaagcgcacc

SEQ ID NO: 20041 - RNA, 327 nt, Artificial Sequence
  derived and/or modified sequence opt2 from anti-influenza_Chain
gacauccagaugacccagucccccuccucccucuccgccuccgucggcgaccgcgucaccaucaccugccgcgccucccagggcaucuccuccuaccucgccugguaccagcagaagcccggcaagguccccacccuccucaucuacgacgccuccacccuccgcuccggcguccccucccgcuucuccggcuccggcuccgccaccgacuucacccucaccaucuccucccuccagcccgaggacgucgccaccuacuacugccagcgcuacaacuccgccccccccaucaccuucggccagggcacccgccucgagaucaagcgc

SEQ ID NO: 20042 - RNA, 327 nt, Artificial Sequence
  derived and/or modified sequence opt2 from anti-influenza_Chain
gagaucgucaugacccagucccccggcacccucucccucucccccggcgagcgcgccacccucuccugccgcgccucccaguccgucuccuccuccuaccucgccugguaccagcagaagcccggccaggccccccgccuccucaucuacgacgccuccucccgcgccaccgacauccccgaccgcuucuccggcuccggcuccggcaccgacuucacccucaccaucucccgccucgagcccgaggacuucgccgucuacuacugccagcaguacggcuccucccucuggaccuucggccagggcaccaaggucgagaucaagcgc

SEQ ID NO: 20043 - RNA, 327 nt, Artificial Sequence
  derived and/or modified sequence opt2 from anti-influenza_Chain
uccuacguccucacccagccccccuccgucuccgucgcccccggccagaccgcccgcaucaccugcggcggcaacaacaucggcuccaaguccguccacugguaccagcagaagcccggccaggcccccguccucgucgucuacgacgacuccgaccgccccuccggcauccccgagcgcuucuccggcuccaacuccggcaacaccgccacccucaccaucucccgcgucgaggccggcgacgaggccgacuacuacugccaggucugggacuccuccuccgaccacgccgucuucggcggcggcacccagcucaccguccucggc

SEQ ID NO: 20044 - RNA, 327 nt, Artificial Sequence
  derived and/or modified sequence opt2 from anti-influenza_Chain
gagaucguccucacccagucccccggcacccucucccucucccccggcgagcgcgccacccucuccugccgcgccucccaguccgucuccuccuccuaccucgccugguaccagcagaagcccggccaggccccccgccuccucaucuacggcgccuccucccgcgccaccggcauccccgaccgcuucuccggcuccggcuccggcaccgacuucacccucaccaucucccgccucgagcccgaggacuucgccgucuacuacugccagcaguacggcuccuccccccgcaccuucggcggcggcaccaaggucgagaucaagcgc

SEQ ID NO: 20045 - RNA, 327 nt, Artificial Sequence
  derived and/or modified sequence opt2 from anti-influenza_Chain
uccuacguccucacccagccccccuccgucuccgucgcccccggccagaccgcccgcaucaccugcggcggcaacaacaucggcuccaagggcguccacugguaccagcagaagcccggccaggcccccguccucgucgucuacgacgacuccgaccgccccuccggcauccccgagcgcuucuccggcuccaacuccggcaacaccgccacccucaccaucucccgcgucgaggccggcgacgaggccgacuacuacugccaggucugggacuccuccuccgaccacgucgucuucggcggcggcaccaagcucaccguccucggc

SEQ ID NO: 20046 - RNA, 327 nt, Artificial Sequence
  derived and/or modified sequence opt2 from anti-influenza_Chain
gagaucguccucacccagucccccggcacccucucccucucccccggcgagcgcgccacccucuccugccgcgccucccaguccgucuccuccaacuaccucggcuggacccagcagaagcccggccaggccccccgccuccucaucuacggcgccuccucccgcgccuccggcauccccgaccgcuucuccggcggcggcuccggcaccgacuucacccucaccaucucccgccucgagcccgaggacuucgccgucuacuacugccagcaguacggcuccuccccccucaccuucggcggcggcaccaaggucgagaucaagcgc

SEQ ID NO: 20047 - RNA, 327 nt, Artificial Sequence
  derived and/or modified sequence opt2 from anti-influenza_Chain
caguccgucgucacccagccccccuccgucuccgucgcccccggccagaccgcccgcaucaccugcggcggcaacaacaucggcuccaaguccguccacugguaccagcagaagcccggccaggcccccguccucgucgucuacgacgacuccgaccgccccuccggcauccccgagcgcuucuccggcuccaacuccggcaacaccgccacccucaccaucucccgcgucgaggccggcgacgaggccgacuacuacugccaggucugggacuccuccuccgaccacuacgucuucggcaccggcaccaaggucaccguccucggc

SEQ ID NO: 20048 - RNA, 327 nt, Artificial Sequence
  derived and/or modified sequence opt2 from anti-influenza_Chain
uccuacguccucacccagccccccuccgaguccgucgcccccggccagaccgcccgcaucaccugcggcggcaacaacaucggccgcaacuccguccacugguaccagcagaagcccggccaggcccccguccucgucgucuacgacgacuccgaccgccccuccggcauccccgagcgcuucuccggcuccaaguccggcaacaccgccacccucaucaucucccgcgucgaggucggcgacgaggccgacuacuacugccaggucuggcacuccuccuccgaccacuacgucuucggcaccggcaccaaggucaccguccucggc

SEQ ID NO: 20049 - RNA, 327 nt, Artificial Sequence
  derived and/or modified sequence opt2 from anti-influenza_Chain
gagaucgucaugacccagucccccggcacccucucccucucccccggccagcgcgccacccucuccugccgcgccucccaguccgucuccuccuccuaccucgccugguaccagcagaagcccggccaggccccccgccuccucauguacggcgccuccucccgcgccaccggcauccccgaccgcuucuccggcuccggcuccggcaccgacuucacccucaccaucucccgccucgagcccgaggacuucgccgucuacuacugccagcaguacggcuccuccucccucaccuucggcggcggcaccaagcucgagaucaagcgc

SEQ ID NO: 20050 - RNA, 327 nt, Artificial Sequence
  derived and/or modified sequence opt2 from anti-influenza_Chain
caggccggccucacccagccccccuccgucuccgucgcccccggccagaccgcccgcaucaccugcggcggcaacaacaucggcuccaaguccguccacugguaccagcagaagcccggccaggcccccguccucgucgucuacgacgacuccgaccgccccuccggcauccccgagcgcuucuccggcuccaacuccggcaacaccgccacccucaccaucucccgcgucgaggccggcgacgaggccgacuacuacugccaggucugggacuccuccuccgaccacgucgucuucggcggcggcaccaagcucaccguccucggc

SEQ ID NO: 20051 - RNA, 327 nt, Artificial Sequence
  derived and/or modified sequence opt2 from anti-influenza_Chain
caguccgucgucacccagccccccuccgaguccgucgcccccggccagaccgcccgcaucaccugcggcggccacaacaucggcuccaacuccguccacugguaccagcagaagcccggccaggcccccguccucgucgucuacgacaacuccgaccgccccuccggcauccccgagcgcuucuccggcuccaacuccggcaacaccgccacccucaccaucucccgcgucgaggccggcgacgaggccgacuacuacugccaggucuggggcuccuccuccgaccacuacgucuucggcaccggcaccaaggucaccguccucggc

SEQ ID NO: 20052 - RNA, 327 nt, Artificial Sequence
  derived and/or modified sequence opt2 from anti-influenza_Chain
gagaucguccucacccagucccccggcacccucucccucucccccggcgagcgcgccacccucuccugccgcgccucccaguccgucuccuccaacuaccucggcugguaccagcagaagcccggccaggccccccgccuccucaucuacggcgccuccucccgcgccuccggcauccccgaccgcuucuccggcggcggcuccggcaccgacuucacccucaccaucucccgccucgagcccgaggacuucgccgucuacuacugccagcaguacggcuccuccccccucaccuucggcggcggcaccaaggucgagaucaagcgc

SEQ ID NO: 20053 - RNA, 327 nt, Artificial Sequence
  derived and/or modified sequence opt2 from anti-influenza_Chain
gagaucguccucacccagucccccgccacccucuccgucucccccggcgagcgcgccacccucuccugccgcgccucccaguccgucgacuccaaccucgccugguaccagcagaagcccggccaggccccccgccuccucgucuacuccgccuccacccgcgccaccggcauccccgcccgcuucuccggcuccggcuccggcaccgaguucacccucgccaucuccucccuccaguccgaggacuucgccgucuacuacugccagcacuacaccaacuggcccccccgccucaccuucggcggcggcuccaaggucgagaucaag

SEQ ID NO: 20054 - RNA, 327 nt, Artificial Sequence
  derived and/or modified sequence opt2 from anti-influenza_Chain
gagaucguccucacccagucccccgccacccucuccgucucccccggcgagcgcgccacccucuccugccgcgccucccaguccgucucccacaaccucgccugguaccagcagaagcccggccaggccccccgccuccucgucuacuccgccuccacccgcgccaccggcauccccgcccgcuucuccggcuccggcuccggcaccgaguucacccucgccaucuccucccuccaguccgaggacuucgccgucuacuacugccagcacuacaccaacuaccccccccgccucaccuucggcggcggcuccaaggucgagaucaag

SEQ ID NO: 20055 - RNA, 327 nt, Artificial Sequence
  derived and/or modified sequence opt2 from anti-influenza_Chain
gagaucgucaugacccagucccccgccacccucuccgucucccccggcgagcgcgccacccucuccugccgcgccucccaguccgucgacuccaaccucgccugguaccagcagaagcccggccaggccccccgccuccucgucuacuccgccuccacccgcgccaccggcauccccgcccgcuucuccggcuccggcuccggcaccgaguucacccucgccaucuccucccuccaguccgaggacuucgccgucuacuacugccagcacuacaccaacuggcccccccgccucaccuucggcggcggcuccaaggucgagaucaag

SEQ ID NO: 20056 - RNA, 327 nt, Artificial Sequence
  derived and/or modified sequence opt2 from anti-influenza_Chain
gagaucguccucacccagucccccgccacccucuccgucucccccggcgagcgcgccacccucuccugccgcgccucccaguccgucuccuccaaccucgccugguaccagcagaagcccggccaggccccccgccuccucgucuacuccgccuccacccgcgccaccggcauccccgcccgcuucuccggcuccggcuccggcaccgaguucacccucgccaucuccucccuccaguccgaggacuucgccgucuacuacugccagcacuacaccaacuggcccccccgccucaccuucggcggcggcuccaaggucgagaucaag

SEQ ID NO: 20057 - RNA, 327 nt, Artificial Sequence
  derived and/or modified sequence opt2 from anti-influenza_Chain
gagaucguccucacccagucccccgccacccucuccgucucccccggcgagcgcgccacccucuccugccgcgccucccaguccgucgaccacaaccucgccugguaccagcagaagcccggccaggccccccgccuccucgucuacuccgccuccacccgcgccaccggcauccccgcccgcuucuccggcuccggcuccggcaccgaguucacccucgccaucuccucccuccaguccgaggacuucgccgucuacuacugccagcacuacaccaacuggcccccccgccucaccuucggcggcggcuccaaggucgagaucaag

SEQ ID NO: 20058 - RNA, 327 nt, Artificial Sequence
  derived and/or modified sequence opt2 from anti-influenza_Chain
gagaucguccucacccagucccccgccacccucuccgucucccccggcgagcgcgccacccucuccugccgcgccucccaguccgucucccacaaccucgccugguaccagcagaagcccggccaggccccccgccuccucgucuacuccgccuccacccgcgccaccggcauccccgcccgcuucuccggcuccggcuccggcaccgaguucacccucgccaucuccucccuccaguccgaggacuucgccgucuacuacugccagcacuacaccaacuggcccccccgccucaccuucggcggcggcuccaaggucgagaucaag

SEQ ID NO: 20059 - RNA, 327 nt, Artificial Sequence
  derived and/or modified sequence opt2 from anti-influenza_Chain
gagaucguccucacccagucccccgccacccucuccgucucccccggcgagcgcgccacccucuccugccgcgccucccaguccgucucccacaaccucgccugguaccagcagaagcccggccaggccccccgccuccucgucuacuccgccuccacccgcgccaccggcauccccgcccgcuucuccggcuccggcuccggcaccgaguucacccucgccaucuccucccuccaguccgaggacuucgccgucuacuacugccagcacuacaccaacuuccccccccgccucaccuucggcggcggcuccaaggucgagaucaag

SEQ ID NO: 20060 - RNA, 327 nt, Artificial Sequence
  derived and/or modified sequence opt2 from anti-influenza_Chain
gagaucguccucacccagucccccgccacccucuccgucucccccggcgagcgcgccacccucuccugccgcgccucccaguccgucgacuccaaccucgccugguaccagcagaagcccggccaggccccccgccuccucgucuacuccgccuccacccgcgccaccggcauccccgcccgcuucuccggcuccggcuccggcaccgaguucacccucgccaucuccucccuccaguccgaggacuucgccgucuacuacugccagcacuacaccaacuuccccccccgccucaccuucggcggcggcuccaaggucgagaucaag

SEQ ID NO: 20061 - RNA, 327 nt, Artificial Sequence
  derived and/or modified sequence opt2 from anti-influenza_Chain
gagaucguccucacccagucccccgccacccucuccgucucccccggcgagcgcgccacccucuccugccgcgccucccaguccgucgacuccaaccucgccugguaccagcagaagcccggccaggccccccgccuccucgucuacuccgccuccacccgcgccaccggcauccccgcccgcuucuccggcuccggcuccggcaccgaguucacccucgccaucuccucccuccaguccgaggacuucgccgucuacuacugccagcacuacaccaacuaccccccccgccucaccuucggcggcggcuccaaggucgagaucaag

SEQ ID NO: 20062 - RNA, 327 nt, Artificial Sequence
  derived and/or modified sequence opt2 from anti-influenza_Chain
gagaccacccucacccagucccccgccacccucuccgucucccccggcgagcgcgccacccucuccugccgcgccucccaggucaucucccacaaccucgccugguaccagcagaagcccggccaggccccccgccuccucaucuacggcgccuccacccgcgccuccggcauccccgcccgcuucuccggcuccggcuccggcaccgacuacacccucaccaucaccucccuccaguccgaggacuucgccgucuacuacugccagcacuacuccaacuggcccccccgccucaccuucggcggcggcaccaaggucgagaucaag

SEQ ID NO: 20063 - RNA, 327 nt, Artificial Sequence
  derived and/or modified sequence opt2 from anti-influenza_Chain
gagaucguccucacccagucccccgccacccucuccgucucccccggcgagcgcgccacccucuccugccgcgccucccaggucaucucccacaaccucgccugguaccagcagaagcccggccaggccccccgccuccucaucuacggcgccuccacccgcgccuccggcauccccgcccgcuucuccggcuccggcuccggcaccgacuacacccucaccaucaccucccuccaguccgaggacuucgccgucuacuacugccagcacuacuccaacuggcccccccgccucaccuucggcggcggcaccaaggucgagaucaag

SEQ ID NO: 20064 - RNA, 327 nt, Artificial Sequence
  derived and/or modified sequence opt2 from anti-influenza_Chain
gagaucguccucacccagucccccgccacccucuccgucucccccggcgagcgcgccacccucuccugccgcgccucccaggucaucucccacaaccucgccugguaccagcagaagcccggccaggccccccgccuccucaucuacggcgccuccacccgcgccuccggcauccccgcccgcuucuccggcuccggcuccggcaccgacuacacccucaccaucaccucccuccagcccgaggacuucgccgucuacuacugccagcacuacuccaacuggcccccccgccucaccuucggcggcggcaccaaggucgagaucaag

SEQ ID NO: 20065 - RNA, 327 nt, Artificial Sequence
  derived and/or modified sequence opt2 from anti-influenza_Chain
gagaucgucaugacccagucccccgccacccucuccgucucccccggcgagcgcgccacccucuccugccgcgccucccaggucaucucccacaaccucgccugguaccagcagaagcccggccaggccccccgccuccucaucuacggcgccuccacccgcgccuccggcauccccgcccgcuucuccggcuccggcuccggcaccgacuacacccucaccaucaccucccuccaguccgaggacuucgccgucuacuacugccagcacuacuccaacuggcccccccgccucaccuucggcggcggcaccaaggucgagaucaag

SEQ ID NO: 20066 - RNA, 327 nt, Artificial Sequence
  derived and/or modified sequence opt2 from anti-influenza_Chain
gagaucguccucacccagucccccgccacccucuccgucucccccggcgagcgcgccacccucuccugccgcgccucccaggucaucucccacaaccucgccugguaccagcagaagcccggccaggccccccgccuccucaucuacggcgccuccacccgcgccuccggcauccccgcccgcuucuccggcuccggcuccggcaccgacuacacccucaccaucaccucccuccaguccgaggacuucgccgucuacuacugccagcacuacuccaacuuccccccccgccucaccuucggcggcggcaccaaggucgagaucaag

SEQ ID NO: 20067 - RNA, 327 nt, Artificial Sequence
  derived and/or modified sequence opt2 from anti-influenza_Chain
gagaucguccucacccagucccccgccacccucuccgucucccccggcgagcgcgccacccucuccugccgcgccucccaggucaucucccacaaccucgccugguaccagcagaagcccggccaggccccccgccuccucaucuacggcgccuccacccgcgccuccggcauccccgcccgcuucuccggcuccggcuccggcaccgacuacacccucaccaucaccucccuccaguccgaggacuucgccgucuacuacugccagcacuacuccaacuaccccccccgccucaccuucggcggcggcaccaaggucgagaucaag

SEQ ID NO: 20068 - RNA, 327 nt, Artificial Sequence
  derived and/or modified sequence opt2 from anti-influenza_Chain
gagaucguccucacccagucccccgccacccucuccgucucccccggcgagcgcgucacccucuccugccgcgccucccaguccgucgccaacaaccucgccugguaccagcagaagcccggccaguccccccgccuccucaucuacggcgccuccacccgcgacaccggcauccccgcccgcuucuccggcuccggcuccggcaccgaguucacccucaccaucuccucccuccaguccgaggacuucgccgucuacuacugccagcaguacaacaacuggccccccauguacaccuucggccagggcaccaagcucgagaucaag

SEQ ID NO: 20069 - RNA, 327 nt, Artificial Sequence
  derived and/or modified sequence opt2 from anti-influenza_Chain
gacaucgucaugacccagucccccuccacccucuccgccuccgucggcgaccgcgucaccaucaccugccgcgccucccaguccaucggcaacuggcucgccugguaccagcagaagcccggcaaggcccccaagcuccucaucuacaaggucuccacccucgaguccggcguccccucccgcuucuccggcuccggcuccggcaccgaguucacccucaccaucaacucccuccagcccgacgacuucgccaccuacuacugccagcgcuacaccuccaacucccagggcuucaccuucggccagggcaccaagcucgagaucaag

SEQ ID NO: 20070 - RNA, 327 nt, Artificial Sequence
  derived and/or modified sequence opt2 from anti-influenza_Chain
gacaucgucaugacccagucccccgccacccucuccgucucccccggcgagcgcgccacccucuccugccgcgccucccaggucgucggcaccaaccucgccugguaccagcagaagcccggccaggccccccgccuccucaucuacgccgccuccacccgcgccaccggcauccccgcccgcuucuccggcuccggcuucggcaccgacuucacccucaccaucuccucccuccaguccgaggacuucgccgucuacuacugccagcaguacaacaacuggccccucuccuucggcggcggcaccaaggucgagauccgccgcacc

SEQ ID NO: 20071 - RNA, 327 nt, Artificial Sequence
  derived and/or modified sequence opt2 from anti-influenza_Chain
gacauccagaugacccagucccccuccucccucuccgccuccgucggcgaccgcgucaccaucgucugccgcgccucccagggcaucaacacccaccuccacugguaccagcagaagcccggcaaggcccccaagcuccucaucuacuccgccuccacccuccacaccggcguccccucccgccucuccggcuccggcuccggcaccgacuucacccucuccaucuccucccuccagcccgaggacuucgccaccuacuacugccagcaguccuacaacuacccccgcaccuucggccagggcaccaacgucgacaucaagcgcacc

SEQ ID NO: 20072 - RNA, 327 nt, Artificial Sequence
  derived and/or modified sequence opt2 from anti-influenza_Chain
gacauccucaugacccagucccccuccucccucuccgccuccgucggcgaccgcgucaccaucaccugccgcgccucccaggacauccgcaaccgccucgccugguaccagcagaagcccggcaaggcccccaagcgccucaucuacgccgccuccucccuccaguccggcguccccucccgcuucuccggcuccggcuccggcaccgaguucacccucaccaucaacucccuccagcccgaggacuucgccaccuacuacugccuccagcacaacuccuaccccuggaccuucggccccggcaccaaggucgagaucaagcgcacc

SEQ ID NO: 20073 - RNA, 327 nt, Artificial Sequence
  derived and/or modified sequence opt2 from anti-influenza_Chain
gacaucgucaugacccagucccccgccacccucuccgucucccccggcgagggcgccacccucuccugccgcgccucccagggcaucggcuccaaccucgccugguaccagcacaagcccggccaggccccccgccuccucaucuacgccgccuccacccgcgccaccggcguccccgcccgcuucuccggcuccggcuccggcaccgaguucacccucaccaucuccucccuccaguccgaggaccucgccgucuacuucugccagcaguacaacaccuggccccucaccuucggcggcggcaccaaggucgagaucauccgcacc

SEQ ID NO: 20074 - RNA, 327 nt, Artificial Sequence
  derived and/or modified sequence opt2 from anti-influenza_Chain
gacaucgucaugacccagucccccuccacccucuccgccuccgucggcgaccgcgucaccaucaccugccgcgccucccagaccaucuaccgcuggcucgccugguaccagcagaagcccggcaaggcccccaagguccucaucuacaaggccuccacccucgaguccggcguccccucccgcuucuccggcuccggcuccggcaccgaguucacccucgccaucuccucccuccagcccgacgacuucgccaccuacuacugccagcaguacaacuccuuccccuaccgcuucggccagggcaccaaggucgagaucaagcgcacc

SEQ ID NO: 20075 - RNA, 327 nt, Artificial Sequence
  derived and/or modified sequence opt2 from anti-influenza_Chain
gacaucgucaugacccagucccccuccucccucuccgccuccgucggcgaccgcgucuccaucaccugccgcgccucccagaccaucacccgcuuccucaacugguaccagcagaagcccggcaagggccccaagcuccucaucuacgccgccuccaccguccaccgcggcguccccucccgcuucuccggcuccggcuccggcaccgacuucacccucaccaucuccucccuccagcccgaggacuucgccaccuacuacugccagcaguccuacuccgcccccuucaccuucggccccggcaccaccgucgacauccgccgcacc

SEQ ID NO: 20076 - RNA, 327 nt, Artificial Sequence
  derived and/or modified sequence opt2 from anti-influenza_Chain
gacaucgucaugacccagccccccgccacccucuccgucucccccggcgagcgcgccacccucuccugcggcgccucccagggccucggcuccaaccucgccugguaccagcagaagcccggccaggccccccgccuccucaucuacgccgccuccacccgcgccaccggcaucaccgcccgcuucuccggcuccggcuccggcaccgaguucacccucaccaucaacucccuccaguccgaggacuucgcccucuacuacugccagcaguacaccuacuggccccucaccuucggcggcggcaccaaggucgagaucaagcgcacc

SEQ ID NO: 20077 - RNA, 327 nt, Artificial Sequence
  derived and/or modified sequence opt2 from anti-influenza_Chain
gacaucguccucacccagucccccgccacccucuccgucucccccggcgagcgcgccacccucuccugccgcgccucccaguccgucaaccgcaaccucgccugguuccagcagauccccggccaggccccccgccuccucaucuucgacgccuccacccgcgccgccgacauccccgcccgcuucuccggcggcggcuccggcgccgaguucacccucaccgucuccucccuccagcccgaggacuucgccgucuacuacugccagcaguacgacaaguggccccccggcuucggccagggcaccaaggucgagaucaagcgcacc

SEQ ID NO: 20078 - RNA, 330 nt, Artificial Sequence
  derived and/or modified sequence opt2 from anti-influenza_Chain
caguccguccucacccagccccccuccgccuccggcgcccccggccagcgcgucacccucuccugcuccggcuccggcuccaacaucggcuccaacaccgucuccugguaccagcagcuccccggcaccgcccccaagcuccucgucuucaccaacaaccagcgccccuccggcguccccgaccgcuucuccggcuccaaguccggcaccuccgccucccucgccaucuccggccuccaguccgaggacgaggccgacuacuacugcgccgccugggacgacucccucaacggccagcucuucggcggcggcaccaagcucaccguccuc

SEQ ID NO: 20079 - RNA, 330 nt, Artificial Sequence
  derived and/or modified sequence opt2 from anti-influenza_Chain
caguccguccucacccagccccccuccgucuccgccgcccccggccagcgcgucaccaucuccugcuccggcaccuccuccaacaucggcaagaacuacgucuccugguaccagcagcuccccggcgccgcccccaagcuccucaucuacgacaacgacaagcgccccuccggcauccccgaccgcuucuccggcuccaaguccggcaccuccgccacccucggcaucaccggccuccagaccggcgacgaggccgacuacuacugcggcaccugggacuccucccucuccgucggcauguucggcggcggcacccgccucaccguccuc

SEQ ID NO: 20080 - RNA, 330 nt, Artificial Sequence
  derived and/or modified sequence opt2 from anti-influenza_Chain
gagaccacccucacccagucccccgccacccucuccgucucccccggcgagcgcgccacccucuccugccgcgccucccaguccgucucccgcaaccucgccugguaccagcagaagcccggccaggccccccgccuccucaucuacggcgccuccucccgcgccaccggcauccccgaccgcuucuccggcuccggcuccggcaccgacuucacccucaccaucucccgccucgagcccgaggacuucgccgucuacuacugccagcaguacggcuccuccuccaucaccuucggccagggcacccgccucgagaucaagcgcaccguc

SEQ ID NO: 20081 - RNA, 330 nt, Artificial Sequence
  derived and/or modified sequence opt2 from anti-influenza_Chain
caguccguccucacccagccccccuccgccuccggcacccccggccagcgcgucaccaucuccugcuccggcuccuccuccaacaucggcuccaacaccgucaacugguacaagcagcuccccggcaccgccccccgccuccucaucuacuccaacgaccagcgccccuccggcguccccgaccgcuucuccggcuccaaguccggcaccuccgccucccucgccaucuccggccuccaguccgaggacgaggccaacuacuacugcgccgccugggacgacucccucuccggcugggucuucggcggcggcaccaagcucaccguccuc

SEQ ID NO: 20082 - RNA, 330 nt, Artificial Sequence
  derived and/or modified sequence opt2 from anti-influenza_Chain
caguccgcccucacccagccccgcuccgucuccggcucccccggccaguccgucaccaucuccugcaccggcuccuccuccgacgucggcgccuccaacuccgucuccugguaccagcagcaccccggcaaggcccccaagcucgucaucuacgacgucaccgagcgccccuccggcgucccccaccgcuucuccggcuccaaguccggcaacaccgccucccucaccgucuccggccuccagcccgaggacgaggccgacuacuucugcugcgccuacggcggcaaguaccucgucgucuucggcggcggcaccaaggucaccguccuc

SEQ ID NO: 20083 - RNA, 330 nt, Artificial Sequence
  derived and/or modified sequence opt2 from anti-influenza_Chain
caguccgcccucacccagcccgccuccgucuccggcucccccggccaguccaucaccaucuccugcaccggcaccuccuccgacgucggcggcuacaacuacgucuccugguaccagcagcaccccggcaaggcccccaagcuccucaucuacgaggucaccaacuggcccuccggcgucuccaaccgcuucuccggcuccaaguccggcaacaccgccucccucaccaucuccggccuccaggccgaggacgaggccgacuacuacugcuccuccuacgccggcuccuccaccugggucuucggcggcggcacccgcgucaccguccuc

SEQ ID NO: 20084 - RNA, 330 nt, Artificial Sequence
  derived and/or modified sequence opt2 from anti-influenza_Chain
cagaccgucgucacccaggagcccucccucaccgucucccccggcggcaccgucacccucaccugcgccuccuccaccggcgccgucaccuccuccuacuuccccaacugguuccagcagaagcccggccaggccccccgcccccucaucuacuccaccaccauccgccacuccuggacccccgcccgcuucuccggcucccuccucggcggcaaggccgcccucacccucuccggcguccagcccgaggacgaggccgacuacuacugccuccucuacuccggcggcgaccccgucgccuucggcggcggcaccaagcucaccguccuc

SEQ ID NO: 20085 - RNA, 330 nt, Artificial Sequence
  derived and/or modified sequence opt2 from anti-influenza_Chain
caguccguccucacccagucccccuccgucuccgccgcccccggccagaaggucaccaucuccugcuccggcuccgacuccaacaucggcgacuacuucgucugcugguaccagcaccuccccggcaagcccccccagcuccucaucuacgagaacaacaagcgccccuccggcauccccgaccgcuucuccggcuccaaguccggcaccuccgccacccucggcaucaccggcauccagaccggcgacgaggccgacuacuacugcgccaccugggacggcucccucuccgccugggucuucggcggcggcaccaagcucaccguccuc

SEQ ID NO: 20086 - RNA, 330 nt, Artificial Sequence
  derived and/or modified sequence opt2 from anti-influenza_Chain
caguccgcccucacccagccccgcuccgucuccggcucccccggccaguccaucaccaucuccugcaccggcggcuccuccgacaucggcgccuccaacuccgucuccugguaccagcagcaccccggcaaggcccccaagcucgucaucuucgacgucaccgagcgccccuccggcgucccccaccgcuucuccggcuccaaguccggcaacaccgccucccucaccgucuccggccuccagcccgacgacgaggccgacuacuucugcugcgccuacggcggcaaguaccucgucgucuucggcggcggcaccaaggucaccguccuc

SEQ ID NO: 20087 - RNA, 330 nt, Artificial Sequence
  derived and/or modified sequence opt2 from anti-influenza_Chain
caggccgucgucacccaggagcccucccucgccgucucccccggcggcaccgucacccucaccugcggcuccuccaccggcgccgucacccgcggccacuaccccuacugguuccagcagaagcccggccaggccccccgcgcccucaucuacgacuccgccggcaaccgccacuccuggacccccgcccgcuucuccggcucccuccucggcggcaaggccgcccucacccucuccggcgcccagcccgaggacgaggccgaguacuacugccuccucuccuacuccggcgucugggucuucggcggcggcaccaagcucaccguccuc

SEQ ID NO: 20088 - RNA, 330 nt, Artificial Sequence
  derived and/or modified sequence opt2 from anti-influenza_Chain
gagaucgucaugacccagucccccgccacccucuccgucucccccggcgagcgcgucacccucuccugccgcgccucccaguccaucaccgacggccucgccugguaccagcagaaguccggccaggccccccgccuccucaucuacggcgccuccacccgcgccaccggcauccccgcccgcuucuccggcuccggcuccggcaccgaguucacccucaccaucuccucccuccaguccgaggacuucgccgucuacuacugccagcaguacaacaacuggccccccgucaccuucggccagggcaccaaggucgagaucaagcgcacc

SEQ ID NO: 20089 - RNA, 330 nt, Artificial Sequence
  derived and/or modified sequence opt2 from anti-influenza_Chain
uccuccgagcucacccagccccccuccgccuccggcacccccggccagcgcgucaccaucuccugcuccggcuccaccuccaacaucggcuacaaccccgucuccugguaccagcagguccccggcaccgcccccaagcuccucaucuacuccaacaccgagcgccccuccggcguccccgaccgcuucuccggcuccaaguccggcaccuccgccucccucgccaucuccggccuccaguccgaggacgaggccgacuacuacugcgccgccugggacgacacccucaacggccccgucuucggcggcggcaccaaggucaccguccuc

SEQ ID NO: 20090 - RNA, 330 nt, Artificial Sequence
  derived and/or modified sequence opt2 from anti-influenza_Chain
caguccgcccucacccagcccgccuccgucuccggcucccccggccaguccaucaccaucuccugcaccggcaccuccuccgacgucggcggcuacaacuacgucuccugguaccagcagcaccccggcgaggcccccaagcucaugaucuccgacgucuccaaccgccccuccggcgucuccaaccgcuucuccggcuccaaguccggcaacaccgccucccucaccaucuccggccuccaggccgaggacgaggccgacuacuacugcaccuccuacaccuccuccaacacccucgucuucggcggcggcaccaagcucaccguccuc

SEQ ID NO: 20091 - RNA, 330 nt, Artificial Sequence
  derived and/or modified sequence opt2 from anti-influenza_Chain
caguccguccucacccagccccccuccgucuccgccgcccccggccagaaggucaccaucuccugcuccggcuccuccuccaacaucggccacaacuucgucuccugguaccagcagcuccccgccaccgcccccaagcuccucaucuacgacaccgacaagcgccccuccggcauccccgaccgcuucuccggcuccaaguccggcaccuccgccacccucggcaucaccggccuccagaccggcgacgaggccgacuacuacugcggcaccugggacuccucccucuccuccgucaucuucggcggcggcaccaagcucaccguccuc

SEQ ID NO: 20092 - RNA, 330 nt, Artificial Sequence
  derived and/or modified sequence opt2 from anti-influenza_Chain
gacauccagaugacccagucccccuccacccucuccgccuccgucggcgaccgcgucaccaucaccugccgcgccucccagaccaucaacaacuaccucgccugguaccagcagaagcccggcaaggcccccaagcuccucaucuacaaggccuccucccucgaguccggcguccccucccgcuucuccggcuccggcuccggcaccgaguucacccucaccaucuccucccuccagcccgacgacuucgccaccuacuacugccaggaguacaacaacgacuccccccucaccuucggcggcggcaccaaggucgagaucaagcgcacc

SEQ ID NO: 20093 - RNA, 330 nt, Artificial Sequence
  derived and/or modified sequence opt2 from anti-influenza_Chain
gacaucgagcucacccaggaccccuccgucuccgucgcccccggccagaccgcccgcauccccugcguccgcuucaacaugggccccaccuccguccacugguaccagcagaagcccggccaggcccccguccucgucgucuacgacgacuccgaccgccccuccggcauccccgagcgcuucuccggcuccaacuccggcgacuccgccacccucaccaucucccgcgucgaggccggcgacgaggccgacuacuacugccaggucugggacauguccuccgaccgccgcgucuucggcggcggcaccacccucaccguccucggccag

SEQ ID NO: 20094 - RNA, 330 nt, Artificial Sequence
  derived and/or modified sequence opt2 from anti-influenza_Chain
gacaucgucaugacccagucccccggcacccucucccucucccccggcgagcgcgccacccucuacugccgcgccucccaguccguccgcuccggcuaccucgccugguaccagcacaagcccggccaggccccccuccuccucuucuacgacgccuccggccgcgccaccggcauccccgaccgcuucuccggcuccggcuccggcaccgacuucacccucaccaucucccgccucgagcccgaggacuucgccgucuacuacugccuccaguacggcuccuccccccgcaccuucggccagggcaccaaggucgagaucaagcgcacc

SEQ ID NO: 20095 - RNA, 330 nt, Artificial Sequence
  derived and/or modified sequence opt2 from anti-influenza_Chain
gacaucguccucacccagucccccuccuuccucuccgccuccgucggcgaccgcgucaccaucaccugccgcgccucccagcucaucuccuccuacuucgccugguaccagcagaagcccggcaagccccccaagcuccucaucuacgccgccuccacccuccaguccggcguccccucccgcuucuccggcuccggcuccggcacccaguucucccucaccaucuccucccuccagcccgaggacuucgccaccuacuacugccagcagcucaacuccuacccccccaucaccuucggccagggcacccgccucgagaucaagcgcacc

SEQ ID NO: 20096 - RNA, 330 nt, Artificial Sequence
  derived and/or modified sequence opt2 from anti-influenza_Chain
gacaucacccucacccagucccccgccacccucuccgucucccccggcgagcgcgccacccucuccugccgcgccucccaguccgucuccuccaaccucgccugguaccagcagaagcccggccaggccccccgccuccucaucuacggcgccuccaaccgcgccaccgacauccccgcccgcuucuccggcuccggcuccggcaccgaguucacccucaccaucuccucccuccaguccgaggacuucgccgucuacuacugccagcaguucaacgacuggcccuuccucaccuucggcggcggcaccaaggucgagaucaagcgcacc

SEQ ID NO: 20097 - RNA, 330 nt, Artificial Sequence
  derived and/or modified sequence opt2 from anti-influenza_Chain
gacaucgucaugacccagucccccuccuuccucuccgccuccgucggcgaccgcgucaccaucaccugccgcaccucccaggucaucuccuccuaccucgccugguaccagcagcgccccggcaaggcccccaagcuccucaucuacgccgccuccacccuccaguccggcguccccucccgcuucuccggcuccggcuccggcacccgcuucucccucaccaucuccaaccuccagcccgaggacuucgccaccuacuucugccagcagcucaccaccuacccccccaucaccuucggccagggcacccgccucgagaucaagcgcacc

SEQ ID NO: 20098 - RNA, 330 nt, Artificial Sequence
  derived and/or modified sequence opt2 from anti-influenza_Chain
gacaucguccucacccagucccccuccgucuccgucgcccccggccagaccgcccgcaucaccugcggcggcaacgacaucggcuccaaguccguccacugguaccagcagaagcccggccaggcccccguccucgucgucuucgacgaccgcgaccgccccuccggcauccccgagcgcuucuccggcuccaacuccggcaacaccgccacccucaccaucucccgcgucgaggccggcgacgaggccgacuacuacugccaggucugggacaucaccuccgaccucgucgucuucggcggcggcaccaagcucaccgucgucggccag

SEQ ID NO: 20099 - RNA, 330 nt, Artificial Sequence
  derived and/or modified sequence opt2 from anti-influenza_Chain
gacaucgucaugacccagccccccggcacccucuccgucucccccggcgagcgcgccacccucuccugccgcgccucccaguccgucuccaccaaccucgccugguaccagcagaagcccggccaggccccccgccuccucauccacggcgccuccacccgcgccaccggcauccccgcccgcuucuccggcuccggcuccggcgccgaguucacccucaccaucuccucccuccaguccgaggacgucgccgucuacuacugccagcaguacgacaacuggcuccccaucaccuucggccccggcaccaaggucgacauccagcgcacc

SEQ ID NO: 20100 - RNA, 330 nt, Artificial Sequence
  derived and/or modified sequence opt2 from anti-influenza_Chain
gaccccaugcucacccagaccgccucccccgucuccgccgccgucggcggcaccgucaccaucaacugccaggccucccaguccgucuacaacaagaacaaccucgccugguaccagcagaagcucggccagccccccaagcuccucaucuacgccgccuccacccucaccuccggcguccccucccgcuucaagggcuccggcuccggcacccaguucacccucaccaucuccgaccucgagugcgacgacgccgccaccuacuacugcgccggcgacuacuccggcggcaucuacgccuucggcggcggcaccaaggucgagaucaag

SEQ ID NO: 20101 - RNA, 330 nt, Artificial Sequence
  derived and/or modified sequence opt2 from anti-influenza_Chain
gagcucgucaugacccagacccccgccuccgucuccgccgccgucggcggcaccgucaccaucuccugccaguccuccgaguccgucuacaagaacaacaaccucgccugguuccagcagaagcucggccagccccccaagcuccucaucuacgacgccuccaagcucgccuccggcguccccucccgcuucuccggcuccggcuccggcacccaguucacccucaccaucuccgaccucgagugcgacgacgccgccaccuacuacugcgccggcgacuacuccggcuccaacuacgccuucggcggcggcaccaagcucgagaucaag

SEQ ID NO: 20102 - RNA, 330 nt, Artificial Sequence
  derived and/or modified sequence opt2 from anti-influenza_Chain
gagcccaugcucacccagaccgccuccuccgucuccgccgccgucggcggcuccgucaccaucuccugccaguccucccaguccgucgacuccaacaaccagcucuccugguaccagcagaagcccggccagccccccaagcuccucaucuacgccgccuccacccucaccuccggcguccccucccgcuucaagggcuccggcuccggcacccaguucacccucaccaucuccgaccucgagugcgacgacgccgccaccuacuacugcgccggcgacuacuccggcggcaucuacgccuucggcggcggcaccgaggucgucgucaag

SEQ ID NO: 20103 - RNA, 330 nt, Artificial Sequence
  derived and/or modified sequence opt2 from anti-influenza_Chain
gaccccaugcucacccagaccgccgccuccgucuccgccgccgucggcggcaccgucaccaucuccugccaguccuccgaguccgucuacaagaacaacaaccucgccugguuccagcagaagcucggccagccccccacccuccucaucugggacgccuccaagcucgccuccggcguccccucccgcuucuccggcuccggcuccggcacccaguucacccucaccaucuccgaccucgagugcgacgacgccgccaccuacuacugcgccggcgacuacuccggcgucaacuacgccuucggcggcggcaccgaggucgucgucaag

SEQ ID NO: 20104 - RNA, 330 nt, Artificial Sequence
  derived and/or modified sequence opt2 from anti-influenza_Chain
gagcucgucaugacccagacccccgccuccgucuccgccgccgucggcggcaccgucaccaucuccugccaguccuccgaguccgucuacaagaacaacaaccucgccugguuccagcagaagcucggccagccccccaagcuccucaucuacgacgccuccaagcucgccuccggcguccccucccgcuucuccggcuccggcuccggcacccaguucacccucaccaucuccgaccucgagugcgacgacgccgccaccuacuacugcgccggcgacuacuccggcuccaacuacgccuucggcggcggcaccgaggucgucgucaag

SEQ ID NO: 20105 - RNA, 330 nt, Artificial Sequence
  derived and/or modified sequence opt2 from anti-influenza_Chain
gaccccaugcucacccagaccgccuccuccgucuccgccaccgucggcggcaccgucaccaucuccugccaguccucccaguccgucgacaacaacaaggaccucgccugguuccagcagaagcccggccacucccccaagcuccucaucuacuucgccucccgccucgccuccggcguccccucccgcuucaagggcuccggcuccggcacccacuucacccucaccaucuccgaccucgagugcgacgacgccgccaccuacuacugcgccggcgacuacuccggcgccaacuacgccuucggcggcggcaccaagcucgagaucaag

SEQ ID NO: 20106 - RNA, 330 nt, Artificial Sequence
  derived and/or modified sequence opt2 from anti-influenza_Chain
gaccccaugcucacccagaccgccucccccgucuccgccgccgucggcggcaccgucaccaucaacugccaguccucccaguccgucuacaacaacaaccgccucuccugguuccagcagaagcccggccagccccccaagcuccucaucuacuccgccuccacccucgccuccggcgucuccucccgcuucaagggcuccggcuccggcacccaguucacccucaccaucuccgaccucgagugcgacgacgccgccaccuacuacugcgccggcgacuacuccggcggcaucuacgccuucggcggcggcaccgagcucgagauccuc

SEQ ID NO: 20107 - RNA, 330 nt, Artificial Sequence
  derived and/or modified sequence opt2 from anti-influenza_Chain
gagcucguccucacccagacccccgccuccgucuccgccgccgucggcggcaccgucuccaucuccugccaguccucccaguccgucuacaagaacaacaaccucgccugguuccagcagaagcucggccagccccccacccuccucaucugggacgccuccaagcucgccuccggcguccccucccgcuucuccggcuccggcuccggcacccaguucacccucaccaucuccgaccucgagugcgacgacgccgccaccuacuacugcgccggcgacuacuccggcgucaacuacgccuucggcggcggcaccaagcucgagaucaag

SEQ ID NO: 20108 - RNA, 330 nt, Artificial Sequence
  derived and/or modified sequence opt2 from anti-influenza_Chain
gagcucgaccucacccagacccccgccuccgucuccgccgccgucggcggcaccgucaccaucuccugccaguccuccgaguccgucuacaagaacaacaaccucgccugguuccagcagaagcucggccagccccccacccuccucaucugggacgccuccaagcucgccuccggcguccccucccgcuucuccggcuccggcuccggcacccaguucacccucaccaucuccgaccucgagugcgacgacgccgccaccuacuacugcgccggcgacuacuccggcgucaacuacgccuucggcggcggcaccgaggucgucgucaag

SEQ ID NO: 20109 - RNA, 330 nt, Artificial Sequence
  derived and/or modified sequence opt2 from anti-influenza_Chain
gacauccagaugacccagucccccuccucccucuccgccuccgucggcgaccgcgucaccaucaccugccaguccuccgaguccgucuacaagaacaacaaccucgccugguaccagcagaagcccggcaagccccccaagcuccucaucugggacgccuccaagcucgccuccggcguccccucccgcuucuccggcuccggcuccggcaccgacuucacccucaccaucuccucccuccagcccgaggacgucgccaccuacuacugcgccggcgacuacuccggcgucaacuacgccuucggcggcggcaccgaggucgucgucaag

SEQ ID NO: 20110 - RNA, 333 nt, Artificial Sequence
  derived and/or modified sequence opt2 from anti-influenza_Chain
gacaucgucaugacccagucccccgacucccucgccgucucccucggcgagcgcgccaccaucaacugcaaguccucccaguccgucaccuucaacaacaagaacuaccucgccugguaccagcagaagcccggccagccccccaagcuccucaucuacugggccuccacccgcgaguccggcguccccgaccgcuucuccggcuccggcuccggcaccgacuucacccucaccaucuccucccuccaggccgaggacgucgccgucuacuacugccagcagcacuaccgcaccccccccaccuucggccagggcaccaaggucgagaucaag

SEQ ID NO: 20111 - RNA, 333 nt, Artificial Sequence
  derived and/or modified sequence opt2 from anti-influenza_Chain
caguccgcccucacccagcccgccuccgucuccggcucccccggccaguccaucaccaucuccugcaccggcaccggcuccgacgucggcuccuccaaccucgucuccugguaccagcagcaccccgccaaggcccccaagcucaucaucuacgaggucaccaagcgccccuccggcgucuccaaccgcuucuccggcuccaaguccggcaacaccgccucccucaccaucuccggccuccaggccgaggacgaggccgacuacuacugcugcuccuacgccggcuccuccuccucccgcgucuucggcaccggcaccaaggucaccguccuc

SEQ ID NO: 20112 - RNA, 333 nt, Artificial Sequence
  derived and/or modified sequence opt2 from anti-influenza_Chain
caguccguccucacccagccccccuccgccuccggcacccccggccagcgcgucaccaucuccugcuccggcuccaccuccaacaucggcuccaacgccgucaacugguaccagcagcuccccggcaccgcccccaagcuccucaucuacuccaacaaccagcgccccuccggcguccccgaccgcuucuccggcuccaaguccggcaccuccgccucccucgccaucuccggccuccaguccgaggacgaggccgacuacuacugcgccgccugggacgacucccucuccggcuccugggucuucggcggcggcaccaagcucaccguccuc

SEQ ID NO: 20113 - RNA, 333 nt, Artificial Sequence
  derived and/or modified sequence opt2 from anti-influenza_Chain
gagaccacccucacccagucccccggcacccucucccucucccccggcgagcgcgccacccucuccugccgcgucucccaguccgucuccuccaacuaccucgccugguaccagcagaagcccggccaggccccccgccuccucaucuacggcgccuccucccgcgccaccggcauccccgaccgcuucuccggcuccggcuccggcaccgacuucacccucaccaucucccgccucgagcccgaggacuucgccgucuacuacugccagcaguacggcaccuccccccgcgccuucggccacggcaccaaggucgagaucaagcgcaccguc

SEQ ID NO: 20114 - RNA, 333 nt, Artificial Sequence
  derived and/or modified sequence opt2 from anti-influenza_Chain
caguccguccucacccagccccccuccgucuccggcgcccccggccagcgcgucaccaucuccugcggcggcucccgcuccaacaucggcgccggcuacgacguccacugguaccagcaguuccccggcaccgcccccaaggucgucaucuacggcaacaacaaccgccccuccggcguccccgaccgcuucuccggcuccaaguccggcaccuccgccucccucgccaucaccggccuccaggccgaggacgaggccaacuacuacugccaguccuacgacaccaaccucggcggcuccaucuucggcggcggcacccaggucaccguccuc

SEQ ID NO: 20115 - RNA, 333 nt, Artificial Sequence
  derived and/or modified sequence opt2 from anti-influenza_Chain
aacuucaugcucacccagccccacuccgucuccgagucccccggcaagaccgucaccaucuccugcaccggcuccuccggcuccaucgccuccaacuacguccagugguaccagcagcgccccggcuccgcccccaccaccgucaucuacgaggacuaccagcgccccuccggcguccccgaccgcuucuccggcuccaucgacuccuccuccaacuccgccucccucaccaucuccggccucaagaccgaggacgaggccgacuacuacugccaguccuacgacgacuccgaccaccucaucuucggcggcggcaccaagcucaccguccuc

SEQ ID NO: 20116 - RNA, 333 nt, Artificial Sequence
  derived and/or modified sequence opt2 from anti-influenza_Chain
caguccaugcucacccagccccccuccgccuccggcacccccggccagcgcgucaccaucuccugcuccggcuccuccuccaacaucggcuccaacaccgucaacugguucaagcaccuccccggcaccgcccccaagcuccucaucuaccgcaacgaccuccgccccuccggcguccccgaccgcuucuccggcuccaaguccggcaccuccgccucccucgccaucuccggccuccaguccgaggacgaggccgacuacuacugcgccaccugggacgacucccucaacggcuucuacgucuucggcaccggcaccaaggucaccguccuc

SEQ ID NO: 20117 - RNA, 333 nt, Artificial Sequence
  derived and/or modified sequence opt2 from anti-influenza_Chain
gacauccagcucacccagucccccuccucccucuccgccuccgccggcgaccgcgucuccaugaccugccgcgccucccagaucaucuccuccucccucaacugguaccagcagaagcccggcaaggcccccaagcuccucaucuacgccgccuccaaccuccaguccggcguccccucccgcuucuccggcuccggcuccggcaccgacuucacccucaccaucuccucccuccagcccgaggacuucgccaccuacuacugccagcaguccuacuccaccccccccgagcucaccuucggcggcggcaccaaggucgacaucaagcgcacc

SEQ ID NO: 20118 - RNA, 333 nt, Artificial Sequence
  derived and/or modified sequence opt2 from anti-influenza_Chain
uccuacguccucacccagccccccuccgccuccggcacccccggccagcgcgucaccaucuccugcuccggcuccaccuucaacaucggcuccaacgccgucgacugguaccgccagcuccccggcaccgcccccaagcuccucaucuacuccaacaaccagcgccccuccggcguccccgaccgcuucuccggcucccgcuccggcaccuccgccucccucgccaucuccggccuccaguccgaggacgaggccgacuacuacugcgccgccugggacgacauccucaacguccccgucuucggcggcggcaccaagcucaccguccucggc

SEQ ID NO: 20119 - RNA, 333 nt, Artificial Sequence
  derived and/or modified sequence opt2 from anti-influenza_Chain
caguccgcccucacccagcccgccgccgucuccggcucccccggccaguccaucaccaucuccugcaccggcaccuccuccgacgucggcggcuacaacuacgucuccugguaccagcagcaccccggcaaggcccccaagcucaugaucuacgaggucuccaaccgccccuccggcgucuccaaccgcuucuccggcuccaaguccggcaacaccgccucccucaccaucuccggccuccaggccgaggacgaggccgacuacuacugcuccuccuacaccuccuccuccaccuacgucuucggcaccggcaccaaggucaccguccucggc

SEQ ID NO: 20120 - RNA, 333 nt, Artificial Sequence
  derived and/or modified sequence opt2 from anti-influenza_Chain
uccuacguccucacccagccccccuccgucuccggcacccccggccagcgcgucaccaucuccugcuccggcucccgcuccaacgucggcgacaacuccgucuacugguaccagcacguccccgagauggcccccaagcuccucgucuacaagaacacccagcgccccuccggcguccccgcccgcuucuccggcuccaaguccggcaccuccgccucccucgccaucaucggccuccaguccggcgacgaggccgacuacuacugcgucgccugggacgacuccgucgacggcuacgucuucggcuccggcaccaaggucaccguccucggc

SEQ ID NO: 20121 - RNA, 333 nt, Artificial Sequence
  derived and/or modified sequence opt2 from anti-influenza_Chain
uccguccucacccagccccccuccgucuccgccgcccccggccagaaggucaccaucuccugcuccggcuccuccuccaacaucggcaacgacuacgucuccugguaccagcagcuccccggcaccgcccccaagcuccucaucuacgacaacaacaagcgccccuccggcauccccgaccgcuucuccggcuccaaguccggcaccuccgccacccucggcaucaccggccuccagaccggcgacgaggccaacuacuacugcgccaccugggaccgccgccccaccgccuacgucgucuucggcggcggcaccaagcucaccguccucggc

SEQ ID NO: 20122 - RNA, 333 nt, Artificial Sequence
  derived and/or modified sequence opt2 from anti-influenza_Chain
caguccgcccucacccagccccgcuccgucuccggcucccccggccaguccgucaccaucuccugcaccggcaccuccuccgacgucggcggcuacaacuacgucuccugguaccagcagcaccccggcaaggcccccaagcucaugaucuacgacgucuccaagcgccccuccggcguccccgaccgcuucuccggcuccaaguccggcaacaccgccucccucaccaucuccggccuccaggccgaggacgaggccgacuacuacugcuccuccuacaccuccuccuccacccacgucuucggcaccggcaccaaggucaccguccucggc

SEQ ID NO: 20123 - RNA, 333 nt, Artificial Sequence
  derived and/or modified sequence opt2 from anti-influenza_Chain
uccuacguccucacccagccccccuccgccuccggcacccccggccagcgcgucaccaucuccugcuccggcuccuccuccaacaucggcuccaacuacgucuacugguaccagcagcuccccggcaccgcccccaagcuccucaucuaccgcgacggccagcgccccuccggcguccccgaccgcuucuccggcuccaaguccggcaccuccgccucccucgccaucuccggccuccgcuccgacgacgaggccgacuacuacugcgccaccugggacgacaaccucuccggccccgucuucggcggcggcaccaagcucaccguccucggc

SEQ ID NO: 20124 - RNA, 333 nt, Artificial Sequence
  derived and/or modified sequence opt2 from anti-influenza_Chain
caguccgcccucacccagcccgccuccgucuccggcucccccggccaguccaucaccaucuccugcaccggcaccuccuccgacgucggcggcuacaacuacgucuccugguaccagcagcaccccggcaaggcccccaagcucaugaucuacgaggucuccaaccgccccuccggcgucuccaaccgcuucuccggcuccaaguccggcaacaccgccucccucaccaucuccggccuccaggccgaggacgaggccgacuacuacugcuccuccuacaccuccuccuccacccucgucuucggcaccggcaccaaggucaccguccucggc

SEQ ID NO: 20125 - RNA, 333 nt, Artificial Sequence
  derived and/or modified sequence opt2 from anti-influenza_Chain
accguccucacccagccccccuccgucuccggcgcccccggccagcgcgucaccaucuccugcaccggcuccuccuccaacaucggcgccggcuacgacguccacugguaccagcagcuccccggcaccgcccccaagcuccucaucuacggcaacuccaaccgccccuccggcguccccgaccgcuucuccggcuccaaguccggcaccuccgccacccucggcaucaccggccuccagaccggcgacgaggccgacuacuacugcggcaccugggacuccucccucuccgccuacgucuucggcaccggcaccaaggucaccguccucggc

SEQ ID NO: 20126 - RNA, 333 nt, Artificial Sequence
  derived and/or modified sequence opt2 from anti-influenza_Chain
ggcuccgcccucacccagccccgcuccgucuccggcucccccggccaguccgucaccaucuccugcaccggcaccuccuccgacgucggcggcuacaacuacgucuccugguaccagcagcaccccggcaaggcccccaagcucaugaucuacgacgucuccaagcgccccuccggcguccccgaccgcuucuccggcuccaaguccggcaacaccgccucccucaccaucuccggccuccaggccgaggacgaggccgacuacuacugcuccuccuacaccuccuccuccacccacgucuucggcaccggcaccaaggucaccguccucggc

SEQ ID NO: 20127 - RNA, 333 nt, Artificial Sequence
  derived and/or modified sequence opt2 from anti-influenza_Chain
gagaucguccucacccagucccccggcacccucucccucucccccggcgagcgcgccacccucuccugccgcgccucccaguccgucuccuccuccuaccucgccugguaccagcagaagcccggccaggccccccgccuccucaucuucggcgccuccacccgcgccaccggcauccccgaccgcuucuccggcuccggcuccggcaccgacuucacccucaccaucucccgccucgagcccgaggacuucgccgucuucuacugccagcaguacggcucccucccccucaccuucggcggcggcaccaaggucgagaucaagggcaccguc

SEQ ID NO: 20128 - RNA, 333 nt, Artificial Sequence
  derived and/or modified sequence opt2 from anti-influenza_Chain
gagaucguccucacccagucccccggcacccucucccucucccccggcgagcgcgccacccucuccugccgcgccucccaguccguccgcuccaacaaccucgccugguaccagcacaagcccggccaggccccccgccuccucaucuucggcgccuccucccgcgccaccggcauccccgaccgcuucuccggcuccggcuccggcaccgacuucacccucaccaucucccgccucgagcccgaggacuucgccgucuacuacugccagcaguacggcuccucccccgcccucaccuucggcggcggcaccaaggucgagaucaagcgcacc

SEQ ID NO: 20129 - RNA, 333 nt, Artificial Sequence
  derived and/or modified sequence opt2 from anti-influenza_Chain
cagucccucgaggaguccggcggcggccucgucaagcccggcggcucccucacccucaccugcaccgucuccggccucucccucuacuccaacgagaucaacuggguccgccaggcccccggcaacggccucgaguggaucggcgccaucgccggcuccggcuccgccgacuacgccuccugggccaagggccgcuccaccaucacccgcaacaccgaccucaacaccgucacccucaagaugaccucccucaccgccgccgacaccgccaccuacuucugcgccuccuucugggaccucuggggccccggcacccucgucaccgucuccucc

SEQ ID NO: 20130 - RNA, 333 nt, Artificial Sequence
  derived and/or modified sequence opt2 from anti-influenza_Chain
caguccgucgaggaguccggcggcggccucgucaagcccggcggcucccucacccucaccugcaccgucuccggccucucccucuacuccaacgagaucaacuggguccgccaggcccccggcaacggccucgaguggaucggcgccaucgccggcuccggcuccgccgacuacgccuccugggccaagucccgcuccaccaucacccgcaacaccaaccucaacaccgucacccucaagaugaccucccucaccgccgccgacaccgccaccuacuucugcgccuccuucugggaccucuggggccccggcacccucgucaccgucuccucc

SEQ ID NO: 20131 - RNA, 333 nt, Artificial Sequence
  derived and/or modified sequence opt2 from anti-influenza_Chain
cagucccucgaggaguccggcggcggccucgucaagcccggcggcucccucacccucaccugcaccgucuccggccucucccucuacuccaacgagaucaacuggguccgccaggcccccggcaacggccucgaguggaucggcgccaucgccggcuccggcuccgccgacuacgccuccugggccaagucccgcuccaccaucacccgcaacaccaaccucaacaccgucacccucaagaugaccucccucaccgccgccgacaccgccaccuacuucugcgccuccuucugggaccucuggggccccggcacccucgucaccgucuccucc

SEQ ID NO: 20132 - RNA, 333 nt, Artificial Sequence
  derived and/or modified sequence opt2 from anti-influenza_Chain
aacaucguccucacccagucccccgccucccucgccgucucccucggccagcgcgccaccaucuccugccgcgccuccgaguccgucgacaucuacggcaacuccuucaugcacugguaccagcagaagcccggccagccccccaagcuccucaucuaccucgccuccaagcucgagugcggcgucugcgcccgcuucaacggcuccggcugccgcaccgacuucacccucgccaucgaccccgucgagggcgacgacggcgccaccuacuacugccagcagaacuacgaggaccccuggaccuucggcggcggcaccaagcucgagaucaag

SEQ ID NO: 20133 - RNA, 333 nt, Artificial Sequence
  derived and/or modified sequence opt2 from anti-influenza_Chain
aacaucguccucacccagucccccgccucccucgccgucucccccggccagcgcgccaccaucuccugccgcgccuccgaguccaucgacaucuacggcaacuccuucaugcacugguaccagaagaagcccggccagccccccaagcuccucaucuaccgcgccuccaaccucgaguccggcguccccgcccgcuucaacggcuccggcucccgcaccgacuucacccucaccaucgaccccgucgagggcgacgacggcgccaccuacuacugccagcagaacuacgaggaccccuggaccuucggcggcggcaccaagcucgagaucaag

SEQ ID NO: 20134 - RNA, 333 nt, Artificial Sequence
  derived and/or modified sequence opt2 from anti-influenza_Chain
gagaucguccucacccagucccccgccacccucucccucuaccccggcgagcgcgccacccucuccugccgcgccucccaguccgucucccgcuaccucgccugguaccagcagaagcccggccaggccccccgccuccucaucuacgacgccuccaaccgcgccaccggcauccccgcccgcuucuccggcuccggcuccggcaccgacuucacccucaccaucuccucccucgagcccgaggacuucgccgucuacuacugccagcagcgcuccaacuggcucaagaucaccuucggccagggcacccgccucgagaucaagggcaccguc

SEQ ID NO: 20135 - RNA, 336 nt, Artificial Sequence
  derived and/or modified sequence opt2 from anti-influenza_Chain
gacaucgucaugacccagucccccgacucccucgccgucucccucggcgagcgcgccaccaucaacugcaaguccucccaguccguccucuacuccuccaacaacaagaacuaccucgccugguaccagcagaagcccggccagccccccaagcuccucaucgacugggccuccacccgcgaguccggcguccccgaccgcuucuccggcuccggcuccggcaccgacuucacccucaccaucuccaaccuccaggucgaggacgucgccgucuacuacugccagcaguacuaccgcucccccuccuucggccagggcaccaagcucgagaucaag

SEQ ID NO: 20136 - RNA, 336 nt, Artificial Sequence
  derived and/or modified sequence opt2 from anti-influenza_Chain
gacaucgucaugacccagaccccccucucccucuccgucacccccggccagcccgccuccaucuccugcaaguccucccagucccuccuccacuccgacggcaagaccuaccucuacugguaccuccagaagcccggccaguccccccagcuccucaucuacgaggucuccaaccgcuucuccggcguccccgaccgcuucuccggcuccggcuccggcaccgacuucacccucaagaucucccgcgucgaggccgaggacgucggcgucuacuacugcaugcagaacauccuccucccccucaccuucggcggcggcaccaaggucgagaucaag

SEQ ID NO: 20137 - RNA, 336 nt, Artificial Sequence
  derived and/or modified sequence opt2 from anti-influenza_Chain
gagaucgucaugacccagaccccccucucccucuccgucacccccggccagcccgccuccaucuccugccgcuccucccagucccuccuccacuccgacggcaagaccuaccucuacugguaccuccagaagcccggccagcccccccagcuccucaucuccgaggucuucaaccgcuucuccggcguccccgaccgcuucuccggcuccggcuccggcaccgacuucacccucaagaucucccgcgucgaggccgaggacgucggcgucuacuacugcaugcagucccuccagcucccccucaccuucggcggcggcaccaaggucgagaucaag

SEQ ID NO: 20138 - RNA, 336 nt, Artificial Sequence
  derived and/or modified sequence opt2 from anti-influenza_Chain
gacaucgucaugacccaguccccccucucccuccccgucacccccggcgagcccgccuccaucuccugccgcgccucccagucccuccuccacuccaacggcuacaacuaccucgacugguaccuccagaagcccggccaguccccccagcuccucauccagcucggcuccacccgcgccuccggcguccccgaccgcuucuccggcuccggcuccggcaccgacuucacccucgagaucucccgcgucgaggccgaggacgucggcgucuacuacugcaugcaggcccuccagcucccccucgccuucggccagggcacccgccucgagaucaag

SEQ ID NO: 20139 - RNA, 336 nt, Artificial Sequence
  derived and/or modified sequence opt2 from anti-influenza_Chain
gacaucgucaugacccaguccccccucucccuccccgucucccccggcgagcccgccuccaucuccugccgcuccucccagucccuccuccacggcaacggcuacaacuaccucgacugguaccuccagaagcccggccaguccccccgccuccucaucuaccucggcuccaaccgcgccuccggcguccccgaccgcuucuccggcuccggcuccggcaccgacuucacccucaagaucucccgcgucgaggccgaggacgucggcgucuacuacugcaugcaggcccuccagaccccccucaccuucggcggcggcaccaaggucgagaucaag

SEQ ID NO: 20140 - RNA, 336 nt, Artificial Sequence
  derived and/or modified sequence opt2 from anti-influenza_Chain
caguccguccucacccagccccccuccgucuccggcgcccccggccagcgcgucaccaucuccugcaccggcuccuccuccaacaucggcgccggcuacgacguccacugguaccagcagcuccccggcaccgcccccaagcuccucaucuacgacaacaacaaccgccccuccggcguccccgaccgcuucuccggcuccaaguccggcgccuccgccucccucgccaucaccggccuccaggccgaggacgaggcccacuacuacugccaguccuacgacaacucccucuccggcuccgucuucggcggcggcacccagcucaccguccucucc

SEQ ID NO: 20141 - RNA, 336 nt, Artificial Sequence
  derived and/or modified sequence opt2 from anti-influenza_Chain
caguccguccucacccagccccccuccgucuccggcgcccccggccagcgcgucaccaucuccugcaccggcuccuccuccaacaucggcuccgacuacgacguccacugguacaagcagcuccccggcaccgcccccaagcuccucaucuucggcaacuccaaccgccccuccggcguccccgaccgcuucuccggcuccaaguccggcaccuccgccucccucgccaucaccggccuccaggccgaggacgaggccgacuacuacugccaguccuacgacuccucccucuccggcuuccacgucuucggcuccggcaccaaggucaccguccuc

SEQ ID NO: 20142 - RNA, 336 nt, Artificial Sequence
  derived and/or modified sequence opt2 from anti-influenza_Chain
caguccguccucacccagccccccuccgucuccgccgcccccggccagaaggucaccaucuccugcuccggcuccuccuccaacaucggcaacgacuacgucuccugguaccagcagcuccccggcaccgcccccaagcuccucaucuacgacaacaacaagcgccccuccggcauccccgaccgcuucuccggcuccaaguccggcaccuccgccacccucggcaucaccggccuccagaccggcgacgaggccaacuacuacugcgccaccugggaccgccgccccaccgccuacgucgucuucggcggcggcaccaagcucaccguccucggc

SEQ ID NO: 20143 - RNA, 336 nt, Artificial Sequence
  derived and/or modified sequence opt2 from anti-influenza_Chain
gagaucguccucacccagucccccggcacccucucccucucccccggcgagcgcgccacccucuccugccgcgccucccaguccgucuccuccuccuaccucgccugguaccagcagaagcccggccaggccccccgccuccucaucuacggcgccuccacccgcgccaccggcauccccgaccgcuucuccggccgcggcuccggcaccgacuucacccucaccaucuccucccucgagcccgaggacuucgccgucuacuacugccagaacuacggcucccccuuccucuucaccuucggccccggcaccaaggucgacaucaagcgcaccguc

SEQ ID NO: 20144 - RNA, 336 nt, Artificial Sequence
  derived and/or modified sequence opt2 from anti-influenza_Chain
gacauccagcucacccaguccccccucuccccccccgucacccucggccagcccgccuccaucuccugccgcuccucccagucccuccucuacaccgacggcuucaccuaccucuccugguaccaccagcgccccggccaguccccccgccgccucaucuacaagaucuccaaccgcgacuccggcguccccgaccgcuucuccggcuccggcuccggcaccgacuucacccucaagaucucccgcgucgaggccgaggacgucggcgucuacuacugcaugcaggccacccacuggccccucaccuucggcgagggcaccaaggucgagaucaag

SEQ ID NO: 20145 - RNA, 336 nt, Artificial Sequence
  derived and/or modified sequence opt2 from anti-influenza_Chain
gacaucgagcucacccaggagcccuccgccuccggcacccccggccagcgcgucaccaucuccugcuccggcgacaccuccaacaucggcuccaacaccgucuccugguuccagcuccuccccggcaccgcccccaagcuccucaucuucaccgacaaccagcgccccuccggcguccccggccgcuucuccggcuccaaguccggcaccuccgccucccucgccaucuccggccuccaguccgaggacgagaccgacuacuacugcgccgccugggacgacucccucaacggcugggucuucggcggcggcaccaagcucaccguccucggccag

SEQ ID NO: 20146 - RNA, 336 nt, Artificial Sequence
  derived and/or modified sequence opt2 from anti-influenza_Chain
gacaucguccucacccagucccccuccgccuccggcucccccggccaguccgucaccaucuccugcaccggcaccuccuccgacgucggcggcuacgacuacgucuccugguaccagcagcaccccggcaaggcccccaagcucaugaucuacgagguccgcaagcgccccuccggcguccccgaccgcuucuccggcuccaaguccggcaacaccgccucccucaccgucuccggccuccaggccgaggacgaggccuacuacuacugcgccuccuacgccggcaccuacauccaccucuucggcggcggcaccaagcucaccguccucggccag

SEQ ID NO: 20147 - RNA, 336 nt, Artificial Sequence
  derived and/or modified sequence opt2 from anti-influenza_Chain
caggagcagcucauggaguccggcggcggccucgucaagcccggcggcucccucacccucaccugcaccgucuccggccucucccucuacuccaacgagaucaacuggguccgccaggcccccggcaacggccucgaguggaucggcgccaucgccggcuccggcuccgccgacuacgccuccugggccaagucccgcuccaccaucacccgcaacaccaaccucaacaccgucacccucaagaugaccucccucaccgccgccgacaccgccaccuacuucugcgccuccuucugggaccucuggggccccggcacccucgucaccgucuccucc

SEQ ID NO: 20148 - RNA, 336 nt, Artificial Sequence
  derived and/or modified sequence opt2 from anti-influenza_Chain
cagcagcagcucauggaguccggcggcggccucgucaagcccggcggcucccucacccucaccugcaccgucuccggccucucccucuacuccaacgagaucaacuggguccgccaggcccccggcaacggccucgaguggaucggcgccaucgccggcuccggcuccgccgacuacgccuccugggccaagucccgcuccaccaucacccgcaacaccgaccucaacaccgucacccucaagaugaccucccucaccgccgccgacaccgccaccuacuucugcgccuccuucugggaccucuggggccccggcacccucgucaccgucuccucc

SEQ ID NO: 20149 - RNA, 336 nt, Artificial Sequence
  derived and/or modified sequence opt2 from anti-influenza_Chain
cagcagcagcucgucgaguccggcggcggccucgucaagcccggcggcucccucacccucaccugccgcgucuccggccucucccucuucuccaacgagaucaacuggguccgccaggcccccggcaacggccucgaguggaucggcgccaucggcggcggcggcuccgccgacuacgccuccugggccaagucccgcuccaccaucacccgcaacaccaaccucaacaccgucacccuccgcaugaccucccucaccgccgccgacaccgccgccuacuucugcgccuccuucugggaccucuggggccccggcacccucgucaccgucuccucc

SEQ ID NO: 20150 - RNA, 336 nt, Artificial Sequence
  derived and/or modified sequence opt2 from anti-influenza_Chain
gagguccagcucgucgaguccggcggcggccucgucaagcccggcggcucccuccgccucuccugcgccgccuccggccucucccucuucuccaacgagaucaacuggguccgccaggcccccggcaagggccucgaguggaucggcgccaucggcggcggcggcuccgccgacuacgccuccugggccaagucccgcuucaccaucucccgcgacaacgccaagaacucccucuaccuccagaugaacucccuccgcgccgaggacaccgccgucuacuucugcgccuccuucugggaccucuggggccccggcacccucgucaccgucuccucc

SEQ ID NO: 20151 - RNA, 336 nt, Artificial Sequence
  derived and/or modified sequence opt2 from anti-influenza_Chain
gacaucgucaugacccaguccccccucucccuccccgucacccccggcgagcccgccuccaucuccugccgcuccucccagucccuccuccgcuccaacggcuacaacuaccucgacugguaccuccagaagcccggccaguccccccagcuccucaucuaccucggcuccaaccgcgccuccggcguccccgaccgcuucuccggcuccggcuccggcaccgacuucacccucaagaucucccgcgucgaggccgaggacgucggcgucuacuacugcaugcaggcccuccagacccccuacaccuucggccagggcaccaagcucgagaucaag

SEQ ID NO: 20152 - RNA, 339 nt, Artificial Sequence
  derived and/or modified sequence opt2 from anti-influenza_Chain
gacaucgucaugacccagucccccgacuuccuccccgucucccucggcgagcgcgccaccaucaacugcaaguccucccagcgcguccucuacuccuccaacaacaagaacuaccucgccugguaccagcucaagcccggccagccccccaagcucaucaucuacugggccuccacccgcgaguccggcguccccgaccgcuucuccggcuccggcuccggcaccgaguucacccucaccaucuccucccuccaggccgaggacgucgccgucuacuacugccagcaguacuacucccgccccuacaccuucggccagggcaccaagcucgagaucaag

SEQ ID NO: 20153 - RNA, 339 nt, Artificial Sequence
  derived and/or modified sequence opt2 from anti-influenza_Chain
gacaucgucaugacccagucccccgacucccucgccgucucccucggcgagcgcgccaccaucaacugcaaguccucccaguccguccucuacuccuccaacaacaagaacuaccucgccugguaccagcagaagcccggccagccccccaagcuccucaucuacugggccuccacccgcgaguccggcguccccgaccgcaucuccggcuccggcuccggcgccgacuucacccucaccaucuccucccuccaggccgaggacgucgccgucuacuacugccagcaguacuucgccaccccccgcaccuucggccagggcaccaaggucgagaucaag

SEQ ID NO: 20154 - RNA, 339 nt, Artificial Sequence
  derived and/or modified sequence opt2 from anti-influenza_Chain
gacaucgucaugacccagucccccgacucccucgccgucucccucggcgagcgcgccaccaucaacugcaaguccucccaguccguccucuacuccuccaacaacaagucccaccucgccugguaccagcagaagcccggccagccccccaagcuccucaucuacugggccuccacccgcgaguccggcguccccgaccgcuucuccggcuccggcuccggcaccgacuucacccucaucaucuccucccuccaggccgaggacgucgccgucuacuacugccagcaguacuacuucuccccccucaccuucggcggcggcaccaaggucgagaucaag

SEQ ID NO: 20155 - RNA, 339 nt, Artificial Sequence
  derived and/or modified sequence opt2 from anti-influenza_Chain
gacaucgucaugacccagucccccgacucccucgccgucucccucggcgagcgcgccaccaucaacugccgcuccucccaguccaucuuccacaacuccaacaacgagaacuaccucgccugguaccagcagaagcccggccagccccccaagcuccucaucuacugggccuccacccgcgaguccggcguccccgaccgcuucuccggcuccggcuccggcaccgacuucacccucaccaucuccucccuccaggccgaggacgucgccgucuacuucugccagcaguacuacaacgccccccucaccuucggcggcggcaccaaggucgagaucaag

SEQ ID NO: 20156 - RNA, 339 nt, Artificial Sequence
  derived and/or modified sequence opt2 from anti-influenza_Chain
gagaucguccucacccaguccccccucucccuccccgucacccccggcgagcccgccuccaucuccugccgcuccucccagucccuccuccacuccaacggcuacaacuaccucgacugguaccuccagaagcccggccaguccccccagcuccucaucuaccucggcuccaaccgcgccuccggcguccccgaccgcuucuccggcuccggcuccggcaccgacuucacccucaagaucucccgcgucgaggccgaggacgucggcgucuacuacugcaugcaggcccuccagaccccccucaccuucggcggcggcaccaaggucgagaucaagcgc

SEQ ID NO: 20157 - RNA, 339 nt, Artificial Sequence
  derived and/or modified sequence opt2 from anti-influenza_Chain
gacaucguccucacccagccccccuccgucuccgucgcccccggccagaccgccaccaucaccugcggcggcaacuacaucggcuccaaguccgucaacugguaccagcagcgccccggccacgcccccguccucgucgucuacgacgacuccgaccgccccuccggcauccccgaccgcuucuccggcuccaacucccgcuccaccgccaccaccgccacccucaccaucucccgcgucgaggccggcgacgaggccgacuacuacugccaggucugggagaccuccgaggaccucugggucuucggcggcggcaccaagcucaccguccucggccag

SEQ ID NO: 20158 - RNA, 342 nt, Artificial Sequence
  derived and/or modified sequence opt2 from anti-influenza_Chain
gacgucgucaugacccagucccccgacucccucgccgucucccucggcgagcgcgccaccaucaacugcaaguccucccaguccguccucuacuccuccaacaacaagaacuaccucgccugguaccagcagaagcccggccagccccccaagcuccucaucuacugggccuccacccgcgaguccggcguccccgaccgcuucuccggcuccggcuccggcaccgacuucacccucaccaucuccucccuccaggccgaggacgucgccgucuacuacugccagcaguacuacuccaccccccucaccuucggcggcggcaccaaggucgacaucaagcgc

SEQ ID NO: 20159 - RNA, 342 nt, Artificial Sequence
  derived and/or modified sequence opt2 from anti-influenza_Chain
gacauccagaugacccagucccccgacucccucgccgucucccucggcgagaaggccaccaucaacugcaaguccucccaguccauccucaacuccuccaacaacaagaacuaccucgccugguaccagcagaagcccggccagccccccaagcuccucaucuacugggccuccacccgcgaguccggcguccccgaccgcuucuccggcuccggcuccggcaccgacuucacccucaccaucuccucccuccaggccgaggacgucgccgucuacuacugccagcaguacuacuccuccccccccaccuucggccagggcaccaaggucgagaucaagcgc

SEQ ID NO: 20160 - RNA, 342 nt, Artificial Sequence
  derived and/or modified sequence opt2 from anti-influenza_Chain
gagaucguccucacccagucccccgccacccucucccucuaccccggcgagcgcgccacccucuccugccgcgccucccaguccgucucccgcuaccucgccugguaccagcagaagcccggccaggccccccgccuccucaucuacgacgccuccaaccgcgccaccggcauccccgcccgcuucuccggcuccggcuccggcaccgacuucacccucaccaucuccucccucgagcccgaggacuucgccgucuacuacugcugcgaccgccagcagcgcuccaacuggcucaagaucaccuucggccagggcacccgccucgagaucaagggcaccguc

SEQ ID NO: 20161 - RNA, 342 nt, Artificial Sequence
  derived and/or modified sequence opt2 from anti-influenza_Chain
gacaucgucaugacccagucccagaaguucgucuccaccuccgucggcgaccgcgucuccgucaccugcaaggccucccagaacgucggcuccaacgucgccugguaccagcacaagcccggccacucccccaccgcccucaucuacuccgccucccaccgcuacuccggcguccccgaccgcuucaccggcuccgaguccggcaccgacuucacccucaccaucuccaacguccaguccgaggaccucgccgaguacuucugccagcaguacuacuccuaccccuacaccuucggcggcggcaccaagcucgagaucaagcgcgccgacgccgcccccacc

SEQ ID NO: 20162 - RNA, 342 nt, Artificial Sequence
  derived and/or modified sequence opt2 from anti-influenza_Chain
gacaucgagaugacccaguccccccucucccuccccgucacccccggcgaguccgccuccaucuccugccgcuccucccagucccuccuccacuccaacggcuacaacuaccucgacugguaccuccagaagcccggccaguccccccagcuccucaucuaccucggcuccucccgcgccuccggcguccccgaccgcuucuccggcuccggcuccggcaccgacuucacccucaagaucucccgcgucgaggccgaggacgucggcgucuacuacugcaugcagggccuccagacccccuacaccuucggccagggcaccaagcucgagaucaagcgcacc

SEQ ID NO: 20163 - RNA, 342 nt, Artificial Sequence
  derived and/or modified sequence opt2 from anti-influenza_Chain
gacaucgagaugacccaguccccccucucccuccccgucacccccggcgagcccgccuccaucuccugccgcuccucccagucccuccuccacuccaacggcuacaaccaccucgccugguaccuccagaagcccggccgcuccccccaccuccucaucuaccucgccuccacccgcgccuccggcguccccgaccgcuucuccggcuccggcuccggcaccgacuucacccucaagaucucccgcgucgaggccgaggacgucggcaucuacuacugcaugcagucccuccagaccuccaucaccuucggccagggcacccgccucgagaucaagcgcacc

SEQ ID NO: 20164 - RNA, 345 nt, Artificial Sequence
  derived and/or modified sequence opt2 from anti-influenza_Chain
cagguccagcucguccaguccggcgccgaggucaagaagcccggcuccuccguccgcgucuccugcaagaccuccggcggcaccuucuccuccuacgccgucaccuggguccgccaggcccccggccagggccucgaguggaugggcggcaucaucggcauguucggcaccaccaacuacgcccagaaguuccagggccgccucaccaucaccgccgacgagaugaccuccaccgccuacauggagcucuccucccuccgcuccgaggacaccgccgucuacuacugcgcccgcggcuccuacuacuacgagaccacccucgacuacuggggccgcggcacccuc

SEQ ID NO: 20165 - RNA, 345 nt, Artificial Sequence
  derived and/or modified sequence opt2 from anti-influenza_Chain
gagguccagcucguccaguccggcgccgaggucaagaagcccggcuccuccgucaaggucuccugcaagaccuccggcggcaccuucuccuccuacgccgucaccuggguccgccaggcccccggccagggccucgaguggaugggcgccaucaucggcauguucggcaccaccaacuacgcccagaaguuccagggccgcgucaccaucaccgccgacgagcucaccuccaccgccuacauggagcucuccucccuccgcuccgacgacaccgccgucuacuacugcgcccgcggcuccuacuacuacgaguccucccucgacuacuggggcaagggcacccuc

SEQ ID NO: 20166 - RNA, 345 nt, Artificial Sequence
  derived and/or modified sequence opt2 from anti-influenza_Chain
cagguccagcucguccaguccggcgccgaggucaagaagcccggcuccuccgucaaggucuccugcaagaccuccggcggcaccuucuccuccuacgccgucaccuggguccgccaggcccccggccagggccucgaguggaugggcggcaucaucggcauguucggcaccaccaacuacgcccagaaguuccagggccgcgucaccaucaccgccgacgagcucaccuccaccgccuacauggagcucuccucccuccgcuccgaggacaccgccgucuacuacugcgcccgcggcuccuacuacuacgaguccucccucgacuacuggggccgcggcacccuc

SEQ ID NO: 20167 - RNA, 345 nt, Artificial Sequence
  derived and/or modified sequence opt2 from anti-influenza_Chain
gagguccagcucguccaguccggcgccgaggucaagaagcccggcgccuccgucaaggucuccugcaaggccuccggcuacaccuucaccggcuacuacgucuacuggguccgccaggcccccggccagggccucgaguggaugggcuggaucuccgccuacaacggcaacaccaacuacgcccagaaguuccagggccgcgucaccaucaccgccgacaaguccaccuccaccgccuacauggagcucuccucccuccgcuccgaggacaccgccgucuacuacugcgcccgcucccgcucccucgacgucuggggccagggcaccaccgucaccgucuccucc

SEQ ID NO: 20168 - RNA, 345 nt, Artificial Sequence
  derived and/or modified sequence opt2 from anti-influenza_Chain
gacaucgucaugacccaguccccccucucccuccccgucacccccggcgagcccgccuccaucuccugccgcuccucccagucccuccuccacuccaacggccacaucuacuucgacugguaccuccagaagcccggccaguccccccagcuccucaucuaccucgucuccaagcgcgccuccggcguccccgaccgcuucuccggcuccggcuccggcaccgacuucacccucaagaucucccgcgucgaggccgaggacgucggcgucuacuacugcaugcaggcccucgagacccccuucaccuucggccccggcaccaagguccacaucaagcgcaccguc

SEQ ID NO: 20169 - RNA, 345 nt, Artificial Sequence
  derived and/or modified sequence opt2 from anti-influenza_Chain
caguccgcccucacccagcccgccuccgucuccggcucccccggccaguccaucaccaucuccugcaccggcaccuccuccgacgucggcgccuacaacuacgucuccugguaccagcaccaccccggcaaggcccccaagcucaugaucuacgacgucaccuaccgccccuccggcgucuccacccgcuucuccggcuccaaguccggcaacaccgccucccucaccaucuccggccuccaggccgaggacgaggccgacuacuacugcuccucccagucccgcuccuccacccucgucaucuucggcggcggcaccaagcucaccguccucggccagcccaag

SEQ ID NO: 20170 - RNA, 345 nt, Artificial Sequence
  derived and/or modified sequence opt2 from anti-influenza_Chain
gacaucguccucacccagucccccgucucccucgccgucucccucggcgaguccgccaccgucaacugcaaguccucccaguccguccucuccaacuccaagaaccucaacuaccucgccugguaccagcacaagcccggccagccccccaagcuccucaucuacugggccuccacccgcgaguccggcguccccgaccgcuucuccggcuccggcuccggcaccgacuucacccucaccaucuccucccuccaggccgaggacgucgccgucuacuacugccagcagcacuacuccaucccccucaccuucggccccggcaccaaggucgacaucaagcgcacc

SEQ ID NO: 20171 - RNA, 348 nt, Artificial Sequence
  derived and/or modified sequence opt2 from anti-influenza_Chain
gacaucguccucacccaguccccccucucccuccccgucacccccggcgagcccgccuccaucuccugccgcuccucccagucccuccucgacuccaacggcuacaacuaccucgacugguaccuccagaagcccggccaguccccccagcuccucaucuaccucgccuccuaccgcgcccccggcguccccgaccgcuucuccggcuccggcuccggcaccgacuucacccucaagaucucccgcgucgaggccgaggacgucggccucuacuacugcaugcaggcccuccagaccccccccauguacaccuucggccagggcaccaagcucgagaucaagcgcacc

SEQ ID NO: 20172 - RNA, 351 nt, Artificial Sequence
  derived and/or modified sequence opt2 from anti-influenza_Chain
cucgaguccggcggcggccucguccagcccggcggcucccuccgccucuccugcgccgccuccggcaucaccuucuccuccuacgccauguccuggguccgccaggcccccggcaagggccucgagugggucuccaccgucaacuccggcggcggcuccaccuacuacggcgacuccguccgcggccgcuucaccaucucccgcgacaacuccaaguccacccucuaccuccagcucaacucccuccgcgccgaggacaccgccaucuacuacugcgccaaggacaagggccgccccaucuucggccucgucacccccuccuacuacauggacgucuggggcaacggcacc

SEQ ID NO: 20173 - RNA, 351 nt, Artificial Sequence
  derived and/or modified sequence opt2 from anti-influenza_Chain
caggagcagcucguccaguccggcgccgaggucaagaagcccggcgccuccgucaaggucuccugcaaggccucccgcaaguccuucaucggcuacuacguccacuggguccgccaggcccccggccagggccucgaguggaugggcuggaucucccccgacuccgacgccaccaaguacgcccagaaguuccagggcuccgucaucaugacccgcgacaccuccgucuccaccgucuacauggagcucucccgccucaccuccgacgacaccgcccucuacuacugccuccucuuccgcggcggcaacucccucuccuggggccagggcacccucgucaccgucuccucc

SEQ ID NO: 20174 - RNA, 351 nt, Artificial Sequence
  derived and/or modified sequence opt2 from anti-influenza_Chain
cagguccagcuccaggaguccggccccggccucgucaagcccuccgagacccucucccucaccugcaccgucuccggcuccuccaucuccaacuacuacugguccuggauccgccagucccccggcaagggccucgaguggaucggcuucaucuacuacggcggcaacaccaaguacaaccccucccucaagucccgcgucaccaucucccaggacaccuccaagucccaggucucccucaccauguccuccgucaccgccgccgaguccgccgucuacuucugcgcccgcgccuccugcuccggcggcuacugcauccucgacuacuggggccagggcacccucgucacc

SEQ ID NO: 20175 - RNA, 351 nt, Artificial Sequence
  derived and/or modified sequence opt2 from anti-influenza_Chain
gagguccagcucgucgaguccggcggcggccucguccagcccggcggcucccuccgccucuccugcgccgccuccggcuucaccuucuccaucuacgccauguccuggguccgccaggcccccggcaagggccucgagugggucuccgccaucuccuccuccggcgacuccaccuacuacgccgacuccgucaagggccgcuucaccaucucccgcgacaacgcccgcaacacccucuaccuccagaugaacucccuccgcgccgaggacaccgccgucuacuacugcgcccgcgccuacggcuacaccuucgaccccuggggccagggcacccucgucaccgucuccucc

SEQ ID NO: 20176 - RNA, 354 nt, Artificial Sequence
  derived and/or modified sequence opt2 from anti-influenza_Chain
cagguccagcuccaggaguccggccccggccucgucaagcccuccgagacccucucccucaccugcaccgucuccggcuacuccuucgacuccggcuacuacuggggcuggcuccgccagccccccggcaagggccucgaguggaucggcuccaucuaccacucccgcaacaccuacuacaaccccucccucaagucccgcgucaccaucuccgucgacaccuccaagaaccaguucucccuccagcucuccuccgucaccgccgccgacaccgccgucuacuacugcgcccgcggcaccugguacuccuccaaccuccgcuacugguucgaccccuggggcaagggcacccuc

SEQ ID NO: 20177 - RNA, 354 nt, Artificial Sequence
  derived and/or modified sequence opt2 from anti-influenza_Chain
cagcccguccucacccagccccccuccgccuccgccucccucggcgccuccgucacccucaccugcacccucuccuccgccuacuccaacuacaaggucgacugguaccagcagcgccccggcaagggcccccgcuucgucaugcgcgucggcaccggcggcaucgucggcuccaagggcgacggcauccccgaccgcuucuccguccucggcuccggccucaaccgcuaccucaccaucaagaacauccaggaggaggacgaguccgacuaccacugcggcgccgaccacggcuccggcuccaacuucgucucccccuacgucuucggcggcggcaccaagcucaccguccuc

SEQ ID NO: 20178 - RNA, 354 nt, Artificial Sequence
  derived and/or modified sequence opt2 from anti-influenza_Chain
cagguccagcucguccaguccggcgccgacgucaagaagcccggcuccuccgucaccgucuccugcaaggccuccggcggcuccuucuccaacuacggcaucaacuggguccgccaggcccccggccagggccucgaguggaugggcggcaucaucccccucaucaacgcccccaacuacgcccccaaguuccagggccgcgucaccaucaccgccgacauguucuccaacaucgucucccuccagcucaccucccuccgcaccgacgacaccgccgucuacuacugcgcccgccgcaagaugaccaccgccaucgacuacuggggccagggcacccucgucaccgucuccucc

SEQ ID NO: 20179 - RNA, 354 nt, Artificial Sequence
  derived and/or modified sequence opt2 from anti-influenza_Chain
cagguccagcucguccaguccggcgccgaggucaagaagcccggcuccuccgucaaggucuccugccgcgaguccggcggcaccuucaacggcuacaccaucaccuggguccgccaggcccccggccagggccucgaguggaugggcggcaucauccccaugaugggcaccgucaacuacgcccagaagcuccagggccgcgucaccaucaccaccgacuacuucaccaagaccgccuacauggaccucaacaaccuccgcuccgaggacaccgccauguacuacugcgucaagauccgcuacaccggccagcagcuccucuggggccagggcacccucgucaccgucuccucc

SEQ ID NO: 20180 - RNA, 354 nt, Artificial Sequence
  derived and/or modified sequence opt2 from anti-influenza_Chain
cagguccagcucguccaguccggcgccgaggucaagaagcccggcgccuccgucaaggucuccugcaaggccuccggccacaccuucaccggcuacuacauccacuggguccgccaggcccccggccagggccucgaguggaugggcuggaucaaccccgacuccggcgccaccuccuccgcccagaacuuccagggccgcgucaccaugaccggcgacaccuccuccuccaccgccuacauggagcucucccgccucuccuucgacgacaccgccgucuacuacugcgcccgcguccucuucaccucccccuucgacuucuggggcgagggcacccucgucaccgucuccucc

SEQ ID NO: 20181 - RNA, 354 nt, Artificial Sequence
  derived and/or modified sequence opt2 from anti-influenza_Chain
cagcccguccucucccagccccccuccgccuccgccucccucggcgccuccgucacccucaccugcacccucuccuccggcuucgacaacuaccaggucgccugguaccagcagcgccccggcaagggcccccgcuucgucaugcgcgucggcaacggcggcaacgucgccuccaagggcgacggcauccccgaccgcuucuccgucuccggcuccggccucaaccgcuaccucaccaucaagaacauccaggaggacgacgaguccgacuacuacugcggcgccgaccacggcuccggcaacaacuucgucucccccuacgucuucggcggcggcaccaagcucaccguccuc

SEQ ID NO: 20182 - RNA, 354 nt, Artificial Sequence
  derived and/or modified sequence opt2 from anti-influenza_Chain
gagguccagcucgucgaguccggcgccgaggucaagaagcccggcgccuccgucaaggucuccugcaaggccuccggcuacaccuucucccgcuacuacauccacuggguccgccaggcccccggccaggagcucgaguggaugggcuggaucaaccccgacuccggcgacaccaacuacgcccagaaguuccgcggccgcgucaccauggcccgcgacaccuccaucuccaccgucuacauggagcucaacucccuccgcuacgacgacaccgccgucuacuucugcgcccgcaucaucugguccuccuccggcauggacgucuggggccagggcaccaccgucaccgucucc

SEQ ID NO: 20183 - RNA, 354 nt, Artificial Sequence
  derived and/or modified sequence opt2 from anti-influenza_Chain
gagguccagcuccucgaguccggcggcggcgucguccagcccggccgcucccuccgccucuccugcgccgccuccggcuucaccuuccgcaccuacggcaugcacuggguccgccaggcccccggcaagggccucgagugggucgccgucaucucccacgacggcaaccucaaguacuacggcggcuccgucaagggccgcuucaccaucucccgcgacaacuccaagaacgcccucuaccuccagaugaacucccuccgcgucgacgacaccgcccucuacuacugcgcccgcggcaucggcaucaccgacgccuucgacauccgcggccagggcaccauggucgucgucucc

SEQ ID NO: 20184 - RNA, 354 nt, Artificial Sequence
  derived and/or modified sequence opt2 from anti-influenza_Chain
gagguccagcucgucgaguccggcggcggccucguccagcccggcggcucccuccgccucuccugcaccgccuccggccucuccgucuccuccaccuacaugaacuggguccgccaggcccccggcaagggccucgagugggucuccgucuucuacuccgagacccgcaccuacuacgccgacuccgucaagggccgcuucaccgucucccgccacaacuccaacaacacccucuaccuccagaugaacucccuccgcgucgaggacaccgccgucuacuacugcgcccgcguccagcgccucuccuacggcauggacgucuggggccagggcaccaccgucaccgucuccucc

SEQ ID NO: 20185 - RNA, 354 nt, Artificial Sequence
  derived and/or modified sequence opt2 from anti-influenza_Chain
gagguccagcucgucgaguccggcggcggccucguccagcccggcggcucccuccgccucuccugcaccgccuccggccucuccgucuccuccaccuacaugaacuggguccgccaggcccccggcaagggccucgagugggucuccgucuucuacuccgagacccgcaccuacuacgccgacuccgucaagggccgcuucaccgucucccgccacaacuccaacaacacccucuaccuccagaugaacucccuccgcgccgaggacaccgccgucuacuacugcgcccgcguccagcgccucuccuacggcauggacgucuggggccagggcaccaccgucaccgucuccucc

SEQ ID NO: 20186 - RNA, 354 nt, Artificial Sequence
  derived and/or modified sequence opt2 from anti-influenza_Chain
gacaugcagcucgucgaguccggcggcggccucgucccccccggcggcucccuccgccucuccugcgccgccuccggcuucuccgucuccgacaacuacaucaacuggguccgccaggcccccggcaagggccucgacugggucuccgucuucuacuccgccgaccgcaccuccuacgccgacuccgucaagggccgcuucaccgucuccucccacgacuccaagaacaccgucuaccuccagaugaacucccuccgcgccgaggacaccgccgucuacuacugcgcccgcguccagaaguccuacuacggcauggacgucuggggccagggcaccaccgucaccgucuccucc

SEQ ID NO: 20187 - RNA, 357 nt, Artificial Sequence
  derived and/or modified sequence opt2 from anti-influenza_Chain
gagguccagcucgucgaguccggccccguccucgucaagcccaccgagacccucaccgucaccugcaccgucuccggcuucuccgucgacaacgaccgcaugggcgucuccuggauccgccagccccccggcaaggcccucgaguggcucgcccacaucuucuccaacgacgagaaguccuacuccaccucccuccgcucccgccucaccaucuccaaggacaccuccaagcgccaggucguccucuccaugaccgacauggaccccgucgacaccgccaccuacuacugcgcccgcgcccccuccgaguacgccgccauggacgucuggggccagggcaccauggucaccgucucc

SEQ ID NO: 20188 - RNA, 357 nt, Artificial Sequence
  derived and/or modified sequence opt2 from anti-influenza_Chain
cagguccaggucguccaguccggcaccgaggucaagaagcccggcuccuccgucaaggucuccugccagaccuccggcggccgcuucauguccuacgccaucaccuggguccgccaggcccccggccagggccucgaguggaugggcggcaucguccccgucuucggcaccgccaacuacgcccagaaguuccagggccgcgucaccaucaccaccgacgacuccacccgcaccgccuacauggagcucuccucccuccgcuccgaggacaccgccgucuacuacugcggcuuccgcuacggcuccggcuacggcuucgacuccuggggccagggcacccucgucaccgucuccucc

SEQ ID NO: 20189 - RNA, 357 nt, Artificial Sequence
  derived and/or modified sequence opt2 from anti-influenza_Chain
gagguccagcucgucgaguccggcgccggcgucaagaagcccggcuccuccgucaaggucuccugcaaggccuccggcaacaccuucuccuccaacgccaucuccuggguccgccaggcccccggccagggccucgaguggaugggcggcauccucggcaugcuccgcaccaccaacuacgcccagaaguuccagggccgcgucaccaucaccgccgacgaguucaugaacaccgccuacauggagcucuccucccucaccuccgaggacaccgccgucuacuacugcgcccgcuccuccggcuacuaccccgacuacuuccaccucuggggccagggcacccucgucaccgucucc

SEQ ID NO: 20190 - RNA, 357 nt, Artificial Sequence
  derived and/or modified sequence opt2 from anti-influenza_Chain
cagguccagcuccaggaguccggccccggccucgucaagcccuccgagacccucucccucaccugcaccgucuccggcuccuccaucuccaacuacuacugguccuggauccgccagucccccggcaagggccucgaguggaucggcuucaucuacuacggcggcaacaccaaguacaaccccucccucaagucccgcgucaccaucucccaggacaccuccaagucccaggucucccucaccauguccuccgucaccgccgccgaguccgccgucuacuucugcgcccgcgccuccugcuccggcggcuacugcauccucgacuacuggggccagggcacccucgucaccgucucc

SEQ ID NO: 20191 - RNA, 357 nt, Artificial Sequence
  derived and/or modified sequence opt2 from anti-influenza_Chain
gagguccagcucgucgaguccggcggcggccucguccagcccggcggcucccuccgcaucuccugcgccgccuccggcuucaccgucuccuccaacuacauguccuggguccgccaggcccccggcaagggccucgagugggucuccgucaucuacuccggcggcuccaccuacuacgccgacuccgucaagggccgcuucuccuucucccgcgacaacuccaagaacaccgucuuccuccagaugaacucccuccgcgccgaggacaccgccgucuacuacugcgcccgcugccucucccgcaugcgcggcuacggccucgacgucuggggccagggcaccaccgucaccgucucc

SEQ ID NO: 20192 - RNA, 357 nt, Artificial Sequence
  derived and/or modified sequence opt2 from anti-influenza_Chain
cagguccagcuccaggaguccggccccggccucgucaagcccuccgagacccucucccucaccugcaccgucuccggcgccuccaucuccuccgacuacugguccuggauccgccucccccccggcaagggccucgaguggaucggcuacaucuacaaccgcggcuccaccaaguacacccccucccucaagucccgcgucaccaucucccucgacaccgccgagaaccaguucucccuccgccuccgcuccgucaccgccgccgacaccgccaucuacuacugcgcccgccacgucggcggccacaccuacggcaucgacuacuggggccagggcacccucgucaccgucuccucc

SEQ ID NO: 20193 - RNA, 357 nt, Artificial Sequence
  derived and/or modified sequence opt2 from anti-influenza_Chain
cagguccagcuccaggaguccggccccggccucgucaagcccuccgagacccucucccucaccugcaccgucuccggcgccuccaucuccuccgacuacugguccuggauccgccucccccccggcaagggccucgaguggaucggcuacaucuacaaccgcggcuccaccaaguacacccccucccucaagucccgcgucaccaucucccucgacaccgccgagaaccaguucucccuccgccuccgcuccgucaccgccgccgacaccgccgucuacuacugcgcccgccacgucggcggccacaccuacggcaucgacuacuggggccagggcacccucgucaccgucuccucc

SEQ ID NO: 20194 - RNA, 357 nt, Artificial Sequence
  derived and/or modified sequence opt2 from anti-influenza_Chain
cagguccagcuccaggaguccggcccccgccucgucaagcccuccgagucccucucccucaccugcaccgucuccggcggcuccaucuccaacuccuucuggggcuggauccgccagccccccggcgagggccucgaguggaucggcuacgucuacaacuccggcaacaccaaguacaaccccucccucaagucccgcgucaccaucucccgcgacaccuccaagucccagcucuacaugaagcuccgcuccgucaccgccgccgacaccgccgucuacuacugcgcccgccacgacgacgccucccacggcuacuccaucuccuggggccacggcacccucgucaccgucuccucc

SEQ ID NO: 20195 - RNA, 357 nt, Artificial Sequence
  derived and/or modified sequence opt2 from anti-influenza_Chain
gagguccaccuccagcaguccggccccgagcucgucaagcccggcgccuccgucaagauguccugcgaggccuccggcuacaccuucaccgacuacuacgucgccugggucaagcagucccccggcgaguccuucgaguggaucggccgcgucaaccccuacuccggcggcaccuccuacaaccagaaguucaagggcaaggccacccucaucgucgacaaguccuccuccaccgccuacauggagcucuccucccucaccuccgaggacuccgccgucuacuacugcgcccgcugggacuacggcgucuacgagggcuacaucgacuacuggggccagggcuccgcccucaccguc

SEQ ID NO: 20196 - RNA, 360 nt, Artificial Sequence
  derived and/or modified sequence opt2 from anti-influenza_Chain
cagguccagcucguccagcccggcgccgaggucaagaagcccggcuccuccgucaaggucuccugcaaggccuccggcggcaucuucucccccuacgccaucuccuggguccgccaggcccccggccagggccucgaguggaugggcggcaucaucgccaucuucggcaccaccaacuacgcccagaaguuccagggccgcgucaccaucaccgccgacaaguccaccaccaccgccuaccucgagcucaacucccuccgcuucgaggacaccgccgucuacuacugcgcccgcggcggccgcuacuacgucgacuacuucgacuacuggggccagggcacccucgucuccgucuccucc

SEQ ID NO: 20197 - RNA, 360 nt, Artificial Sequence
  derived and/or modified sequence opt2 from anti-influenza_Chain
cagguccagcuccaggaguccggccccgaccucgucaagcccggcgccuccgucaagauguccugcaaggccuccggcuacuccuucaccuacuaccacaugcacugggucaagcagacccacggcaagucccucgaguggaucggccgcauccccuacaacggcggcaccaacuacucccagcgcuucaagggcaaggccgucuucaccgucgacauguccuccuccaccgccuacauggagcuccgcucccucaccuccgaggacuccgccgucuacuacugcgcccgcgacgccaacuacgagggcgacugguacuucgacgucuggggccagggcaccaccgucaccgucuccucc

SEQ ID NO: 20198 - RNA, 360 nt, Artificial Sequence
  derived and/or modified sequence opt2 from anti-influenza_Chain
cagguccagcucguccaguccggcgccgaggucaaggagcccggcuccgccaugaaggucuccugcaaggccuccggcggcaccuucuccuccgacgccuucugcuggguccgccaggcccccggccgcggccucgaguggaugggcggcaucauccccgucuuccagaccgccaacuacggccccaacuuccagggccgcgucaccaucuccgccgacgucuacaccaccacccucuaccucgagcucuccggccucaccuccgaggacaccgccgucuacuucugcgcccgcuccggcgacggcuacaacuacuacuucccccucuggggccagggcacccucgucaccgucuccucc

SEQ ID NO: 20199 - RNA, 360 nt, Artificial Sequence
  derived and/or modified sequence opt2 from anti-influenza_Chain
cagaucacccuccgcgaguccggccccacccucgucaagcccacccagacccucacccucaccugcaccuucuccggcuucucccucuccaccaacggcgucaacgucggcuggauccgccagccccccggcaaggcccucgaguggcucgcccucaucuacugggacgacgacaagcgcuacucccccucccucaagcgccgccucaccaucaccaaggacaccuccaagaaccaggucguccucacccucaccaacauggaccccgucgacaccgccaccuacuacugcgcccaccgccccgacuucuacggcgacuucgaguacuggggccccggcacccucgucaccgucuccucc

SEQ ID NO: 20200 - RNA, 360 nt, Artificial Sequence
  derived and/or modified sequence opt2 from anti-influenza_Chain
cagguccagcucguccaguccggcuccgaggucaagaagcccggcaccuccgucaaggucuccugcaccgccuccggcuccgucuucaccaacuacggcaucuccuggguccgccaggcccccggccagggccucgaguggaugggcggcaucaucccccucuucggcgccgccaaguacgcccagaaguuccagggccgcgucaccaucaccgccgacgaguccaccaagaccgucuacauggagcucucccgccucaccuccaaggacaccgccaucuacuucugcgccaaggccccccgcgucuacgaguacuacuucgaccaguggggccagggcacccccgucaccgucuccucc

SEQ ID NO: 20201 - RNA, 360 nt, Artificial Sequence
  derived and/or modified sequence opt2 from anti-influenza_Chain
cagguccagcucguccaguccggcgccgaccucaagaagcccggcgccuccgucaaggucuccugcaaggccuccggcuacaccuucaccgacuacuacauccacuggguccgccaggcccccggccagggccucgaguggaugggcuggaucaaccccgaguccggcgacaccaaguacgcccagaaguuccagggccgcgucaccaugacccgcgacaccuccaucaccaccgccuacauggagcucggccgccuccgcuccgacgacaccgccgucuacuacugcgcccgcgacgucuccaccaccugguccugguucgcccccuggggccagggcacccucgucaccgucuccucc

SEQ ID NO: 20202 - RNA, 360 nt, Artificial Sequence
  derived and/or modified sequence opt2 from anti-influenza_Chain
cagguccagcuccaggaguccggccccggccucgucaagcccuccgagacccucucccucaccugcuccgucuccggcggcuccaucaacuacuacuacugguccuggauccgccagccccccggcaagggccucgagugcaucggcuacaucuccgacaccggccgcaccuacuacaaccccucccuccgcucccgcgucaccaucuccgucgacaccuccaagaaccaguucucccucaaccucaccuccaugaccgccgccgacaccgccgucuacuacugcgcccgcgaccccaccggcucccgccagaagaacgccuucgacauguggggccagggcaccauggucaccgucucc

SEQ ID NO: 20203 - RNA, 360 nt, Artificial Sequence
  derived and/or modified sequence opt2 from anti-influenza_Chain
cagguccagcuccaggaguccggcccccgcgucguccgccccuccgagacccucucccucaccugcaccgucuccggcggcuccaucuccuccuacaacuggaucuggauccgccagccccccggcaagggccucgaguggaucggccacaucuacgacuacggccgcaccuucuacaacuccucccuccagucccgccccaccaucuccgucgacgccuccaagaaccagcucucccuccgccucaccuccgucaccgccuccgacaccgccgucuacuacugcgcccgcccccucggcauccuccacuacuacgccauggaccucuggggccagggcaccaccgucaccgucuccucc

SEQ ID NO: 20204 - RNA, 360 nt, Artificial Sequence
  derived and/or modified sequence opt2 from anti-influenza_Chain
cagguccagcuccaggaguccggccccggccucgucaagcccuccgagacccucucccucaccugcuccgucuccggcggcuccaucuccuccgacuucugguccuggauccgccagccccccggcaagggccucgaguggaucggcuacgucuacaaccgcggcuccaccaaguacucccccucccucaagucccgcgucaccaucuccgccgacauguccaagaaccaguucucccucaacauguccuccgucaccgccgccgacaccgccgucuacuacugcgccaagaacggccgcuccuccaccuccuggggcaucgacgucuggggcaagggcaccaccgucaccgucuccucc

SEQ ID NO: 20205 - RNA, 360 nt, Artificial Sequence
  derived and/or modified sequence opt2 from anti-influenza_Chain
cagguccagcuccaggaguccggccccggccucgucaagcccuccgagacccucucccucaccugcaccgucuccggcggcuccaucuccgccuaccacugguccuggauccgccagccccccggcaagggccucgaguggaucggccacaucuucgacuccggcuccaccuacuacaaccccucccucaagucccgcgucaccaucucccucgacgccuccaagaaccagcucucccuccgccucaccuccgucaccgccuccgacaccgccaucuacuacugcgcccgcccccucggcucccgcuacuacuacggcauggacgucuggggccagggcaccaccgucaccgucuccucc

SEQ ID NO: 20206 - RNA, 360 nt, Artificial Sequence
  derived and/or modified sequence opt2 from anti-influenza_Chain
gagguccagcucgucgaguccggcggcggccucguccagcccggcggcucccuccgcaucuccugcgccgccuccggcuucaccgucuccuccaacuacauguccuggguccgccaggcccccggcaagggccucgagugggucuccgucaucuacuccggcggcuccaccuacuacgccgacuccgucaagggccgcuucuccuucucccgcgacaacuccaagaacaccgucuuccuccagaugaacucccuccgcgccgaggacaccgccgucuacuacugcgcccgcugccucucccgcaugcgcggcuacggccucgacgucuggggccagggcaccaccgucaccgucuccucc

SEQ ID NO: 20207 - RNA, 360 nt, Artificial Sequence
  derived and/or modified sequence opt2 from anti-influenza_Chain
cagguccagcuccaggaguccggccccggccucgucaagcccuccgagacccucucccucaccugcaccgucuccggcuccuccaucuccaacuacuacugguccuggauccgccagucccccggcaagggccucgaguggaucggcuucaucuacuacggcggcaacaccaaguacaaccccucccucaagucccgcgucaccaucucccaggacaccuccaagucccaggucucccucaccauguccuccgucaccgccgccgaguccgccgucuacuucugcgcccgcgccuccugcuccggcggcuacugcauccucgacuacuggggccagggcacccucgucaccgucuccucc

SEQ ID NO: 20208 - RNA, 360 nt, Artificial Sequence
  derived and/or modified sequence opt2 from anti-influenza_Chain
cagguccagcuccagcaguccggcgccgaggucaagaagcccggcuccuccgucaaggucuccugcaaggucuccggcgucaucuucuccggcuccgccaucuccuggguccgccaggcccccggccagggccucgaguggaugggcggcaucuccccccucuucggcaccaccaacuacgcccagaaguuccagggccgcgucaccaucaccgccgaccaguccaccaacaccaccuacauggaggucaacucccuccgcuacgaggacaccgccgucuacuucugcgcccgcggccccaaguacuacuccgaguacauggacgucuggggcaagggcaccaccgucaccgucuccucc

SEQ ID NO: 20209 - RNA, 360 nt, Artificial Sequence
  derived and/or modified sequence opt2 from anti-influenza_Chain
cagguccagcucguccaguccggcgccgaggucaagaagcccggcuccuccgucaaggucuccugcaaggccuccggcggcaccuucuccuccuacgccaucuccuggguccgccaggcccccggccagggccucgaguggaugggcggcaucaugggcauguucggcaccaccaacuacgcccagaaguuccagggccgcgucaccaucaccgccgacgaguucaccuccgccgccuacauggagcuccgcucccuccgcuccgaggacaccgccgucuacuacugcgcccgcuccuccggcuacuaccccgaguacuuccaggacuggggccagggcacccucgucaccgucuccucc

SEQ ID NO: 20210 - RNA, 360 nt, Artificial Sequence
  derived and/or modified sequence opt2 from anti-influenza_Chain
cagaugcagcucguccaguccggcgccgaggucaagaagcccggcuccuccgucaaggucuccugcaaggccuccggcggcaccuucuccuccuacgccaucaccuggguccgccaggcccccggccagggccucgaguggaugggcggcaucaucggcauguucggcuccaccaacuacgcccagaacuuccagggccgcgucaccaucaccgccgacgaguccaccuccaccgccuacauggagcucuccucccuccgcuccgaggacaccgccgucuacuacugcgcccgcuccaccggcuacuaccccgccuaccuccaccacuggggccagggcacccucgucaccgucuccucc

SEQ ID NO: 20211 - RNA, 360 nt, Artificial Sequence
  derived and/or modified sequence opt2 from anti-influenza_Chain
gagguccagcucgucgaguccggcgccgaggucaagaagcccggcuccuccgucaaggucuccugcaaggccuccggcggcaccuucuccuccuacggcaucuccuggguccgccaggcccccggccagggccucgaguggaugggcgacaucaucggcauguucggcuccaccaacuacgcccagaacuuccagggccgccucaccaucaccgccgacgaguccaccuccaccgccuacauggagcucuccucccuccgcuccgaggacaccgccgucuacuacugcgcccgcuccuccggcuacuaccccgccuaccucccccacuggggccagggcacccucgucaccgucuccucc

SEQ ID NO: 20212 - RNA, 360 nt, Artificial Sequence
  derived and/or modified sequence opt2 from anti-influenza_Chain
gagguccagcucgucgaguccggcgccgaggucaagaagcccggcuccuccgucaaggucuccugcaaggccuccggcggcaccuucuccuccuacgccaucuccuggguccgccaggcccccggccagggccucgaguggaugggcggcaucaucggcauguucggcaccgccaacuacgcccagaaguuccagggccgcgucaccaucaccgccgacgaguucaccuccaccgccuacauggagcucuccucccuccgcuccgaggacaccgccgucuacuacugcgcccgcggcaacuacuacuacgaguccucccucgacuacuggggccagggcacccucgucaccgucuccucc

SEQ ID NO: 20213 - RNA, 360 nt, Artificial Sequence
  derived and/or modified sequence opt2 from anti-influenza_Chain
cagguccagcucguccaguccggcgccgaggucaagaagcccggcuccuccgucaaggucuccugcaaggccuccggcggccccuuccgcaacuucgccaucaacuggguccgccaggcccccggccagggccucgaguggaugggcggcaucaucgccgucuucggcaccaccaaguacgcccacaaguuccagggccgcgucaccaucaccgccgacgacuccaccaacaccgccuacauggagcucggcucccucaaguccgaggacaccgccgucuacuacugcgcccgcggcccccacuacuacuccuccuacauggacgucuggggcgagggcaccaccgucaccgucuccucc

SEQ ID NO: 20214 - RNA, 360 nt, Artificial Sequence
  derived and/or modified sequence opt2 from anti-influenza_Chain
gaggucgcccucgucgagaccggcgccgaggucaagaagcccggcuccuccgucaagguccccugcaaguccuccggcucccccuuccgcuccaacgccgucuccuggguccgccaggcccccggccagggccucgagugggucggcggcauccucggcgucuucggcucccccuccuacgcccagaaguuccagggccgcgucaccaucaccgccgacgaguccaccaacaccguccacauggagcuccgcggccuccgcuccgaggacaccgccgucuacuacugcgcccgcggccccaccuacuacuacuccuacauggacgucuggggcaagggcaccaccgucaccgucuccucc

SEQ ID NO: 20215 - RNA, 360 nt, Artificial Sequence
  derived and/or modified sequence opt2 from anti-influenza_Chain
cagaugcagcucguccaguccggcgccgaggucaagaagcccggcuccuccgucaaggucuccugcaaggccuccggcggcaccuucuccuccuacgccaucuccuggguccgccaggcccccggccagggccucgaguggaugggcggcaucuucggcauguucggcaccgccaacuacgcccagaaguuccagggccgcgucaccaucaccgccgacgaguucaccuccgccgccuacauggagcucuccucccucggcuccgaggacaccgccauguacuacugcgcccgcuccuccggcuacuacccccaguacuuccaggacuggggccagggcacccucgucaccgucuccucc

SEQ ID NO: 20216 - RNA, 360 nt, Artificial Sequence
  derived and/or modified sequence opt2 from anti-influenza_Chain
cagguccagcucguccaguccggcgccgaggucaagaagcccggcuccuccgucaaggucuccugcaaggccuccggcgucaccuucuccuacuacgccauguccuggguccgccaggcccccggccagggccucgaguggaugggcggcaucucccccauguucggcaccaccaccuacgcccagaaguuccagggccgcgucaccaucaccgccgacgacuccaccuccaccgccuacauggagguccgcucccuccgcuccgaggacaccgccgucuacuacugcgcccgcuccuccaacuacuacgacuccgucuacgacuacuggggccagggcacccucgucaccgucuccucc

SEQ ID NO: 20217 - RNA, 360 nt, Artificial Sequence
  derived and/or modified sequence opt2 from anti-influenza_Chain
gagguccagcucgucgagaccggcgccgaggucaagaagcccggcuccuccgucaagguccccugcaaguccuccggcucccccuuccgcuccaacgccgucuccuggguccgccaggcccccggccagggccucgagugggucggcggcauccucggcgucuucggcucccccuccuacgcccagaaguuccagggccgcgucaccaucaccgccgacgaguccaccaacaccguccacauggagcuccgcggccuccgcuccgaggacaccgccgucuacuacugcgcccgcggccccaccuacuacuacuccuacauggacgucuggggcaagggcaccaccgucaccgucuccucc

SEQ ID NO: 20218 - RNA, 360 nt, Artificial Sequence
  derived and/or modified sequence opt2 from anti-influenza_Chain
cagguccaccucguccaguccggcgccgagguccgcaagcccggcgccuccgucaaggucuccugcaaggucuccggcuacacccucaacgagcucuccauccacuggcuccgccaggcccccggccgcggccucgaguggaugggcuccuucgaccccgaggacggcgagaccaucuacgcccagaaguuccagggccgcgucaccaugaccggcgacaccuccaccgacaccgccuaccucgagcucaccucccuccgcuccgaggacaccgcccucuacuacugcgcccgcggcuggggcgccgucaccucccccuucgacuucuggggccagggcacccucgucaccgucuccucc

SEQ ID NO: 20219 - RNA, 360 nt, Artificial Sequence
  derived and/or modified sequence opt2 from anti-influenza_Chain
gagguccagcucguccaguccggcgccgaggucaagaagcccggcuccuccaugaaggucuccugcaaggccuccggcuccaucuucuccaacuacggcaucuccuggguccgccaggcccccggccagggccucgaguggaugggcggcaucauccccaucuucggcgccgccaacuacgcccagaaguuccagggccgcgucaccaucaccgccgacgaguccaccuccaccgucuacauggagguccgcucccuccgcuccgaggacaccgccgucuacuacugcgcccgccgccagcagcucuacaagggcuacuaccaccacuggggccagggcacccucgucaccgucuccucc

SEQ ID NO: 20220 - RNA, 360 nt, Artificial Sequence
  derived and/or modified sequence opt2 from anti-influenza_Chain
cagguccagcucguccaguccggcgccggcgucaagaagcccggcuccuccaugaaggucuccugcaaggccuccggcuccaucuucuccaacuacggcaucuccuggguccgccaggcccccggccagggccucgaguggaugggcggcaucauccccaucuucggcgccgccaacuacgcccagaaguuccagggccgcgucaccaucaccgccgacgaguccaccuccaccgucuacauggagguccgcucccuccgcuccgaggacaccgccgucuacuacugcgcccgccgccagcagcucuacaagggcuacuaccaccacuggggccagggcacccucgucaccgucuccucc

SEQ ID NO: 20221 - RNA, 360 nt, Artificial Sequence
  derived and/or modified sequence opt2 from anti-influenza_Chain
cagguccagcuccaggaguccggccccggccucgucaagcccuccgagacccucucccucaccugcaccgucuccggcggccucaucggcaccggcuccuacuacuggggcuggauccgccagacccccggcaagggcauggaguggaucggcuccaucuccuacuccggcuccaccuacuaccaccccucccucaagucccgcgucaccaucuccgacgacaccuccaagaaccagcucuuccucaagcuccgcuccgucaccgccgccgacaccgcccaguacuacugcgcccgcuacaacuggggcauccgcuacuucgacuucuggggccgcggcacccucgucaccgucuccucc

SEQ ID NO: 20222 - RNA, 360 nt, Artificial Sequence
  derived and/or modified sequence opt2 from anti-influenza_Chain
cagguccagcucguccaguccggcgccgagguccgcaagcccggcuccuccgucaaggucuccugcaaggucuccggcggcaucauccgcaaguacgccaucaacuggguccgccaggcccccggccagggccucgaguggaugggcggcaucaucgccaucuucaacaccgccaacuacgcccagaaguuccagggccgcgucaccaucaccgccgacgaguccaccuccaccgucuacauggagcucuccucccuccgcuccgaggacaccgcccucuacuacugcgcccgcggcaugaacuacuacuccgacuacuucgacuacuggggccagggcucccucgucaccgucuccccc

SEQ ID NO: 20223 - RNA, 360 nt, Artificial Sequence
  derived and/or modified sequence opt2 from anti-influenza_Chain
cagguccagcucguccaguccggcggcggcgucguccagcccggccgcucccuccgccucuccugcgccgccuccggcuucaccuuccgcucccacgccaugcacuggguccgccaggcccccggcaagggccccgagugggucgcccucaucuccuacgacgaggucaacaaguucuacgccgacuccgucaagggccgcuucaccaucucccgcgacgucuccaagaacaccgucuuccuccagaugaacucccucuccgccgacgacaccgccgucuacuacugcgcccgcggccacuccggcuccuaccgccucuucgacuucuggggccagggcacccucgucaccgucuccucc

SEQ ID NO: 20224 - RNA, 360 nt, Artificial Sequence
  derived and/or modified sequence opt2 from anti-influenza_Chain
cagguccagcucgucgaguccggcggcggccucguccagcccggcggcucccuccgccucuccugcgccgccuccggcuucaucuucggcgacuucgccauccacuggguccgccaggccuccggcaagggccucgagugggucgcccgcauccgcuccggccucaaccgcuucgagaccgccuacgccgccuccgucgagggccgccucaccaucucccgcgacgacuccaaguccauggccuaccuccagaugaacaacgucaaggccgaggacaccgccgucuaccucugcaccuaccucgucggcgccgucggcuuccagcacuggggccagggcacccucgucaccgucuccucc

SEQ ID NO: 20225 - RNA, 360 nt, Artificial Sequence
  derived and/or modified sequence opt2 from anti-influenza_Chain
cagguccagcucgucgaguccggcggcggcgucguccagcccggccgcucccuccgccucuccugcgccgccuccggcuucaccuucuccuccuacggcaucuacuggguccgccaggcccccggcaagggccucgagugggucgccuucaucuccuacgacgagaucaacaaguucuacgccgacuccgucaagggccgcuucaccaucucccgcgacaacuccaagaacaccgucuuccuccagaugaacucccuccgcgacgaggacaccgccgucuacuacugcgccaagccccuccgcggcuccuaccgcuacuucgaccucuggggccgcggcaccgucgucaccgucuccucc

SEQ ID NO: 20226 - RNA, 363 nt, Artificial Sequence
  derived and/or modified sequence opt2 from anti-influenza_Chain
cagguccagcuccaggaguccggccccgaccucgucaagcccggcgccuccgucaugaucuccugcaaggccuccggcuacuccuucaccuacuacuacaugcacugggucaagcagucccacggcaagacccucgaguggaucggccgcaucuaccccuacaacggcgacaccaacuacaaccgccgcuucaaggacaaggccauccucaccgucgacgaguccuccuccaccgccuacauggagcuccgcucccucaccuccgaggacuccgccgucuacuucugcgcccgcgacgccaacuacgagggcgacugguacuucgacgucuggggccagggcaccaccgucaccgucuccucc

SEQ ID NO: 20227 - RNA, 363 nt, Artificial Sequence
  derived and/or modified sequence opt2 from anti-influenza_Chain
cagguccagcucguccaguccggcggcggcgucguccagcccggccgcucccuccgccucuccugcgccgccuccggcuucaccuucuccuccuacgccaugcacuggguccgccaggcccccggcaagggccucgagugggucgccaucaucuccuacgacggcaacgaccaguacuacaccgacuccgucaagggccgcuucaccaucucccgcgacuccuccaaggucuaccuccagaugcaccgccuccgccccgaggacaccgccgucuacuacugcgccaaggaguucgagaccuccggcuacuuccacggcuccuucgacuacuggggccagggcauccucgucaccgucuccucc

SEQ ID NO: 20228 - RNA, 363 nt, Artificial Sequence
  derived and/or modified sequence opt2 from anti-influenza_Chain
cagguccaggucguccaguccggcgccgaggucaagaagcccggcuccuccguccgcgucuccugccaggccuccggcggcaccuucaugaacuacgccaucaucuggguccgccgcgcccccggccagggccucgaguggaugggcggcaucauccccgucuuccccacccccaacuacgcccagauguuccagggccgcgucaccaucuccaccgacgagucccgcuccaccuccuuccucgagcucaccaaccuccgcuacgaggacaccgccgucuacuacugcgcccgccgcaucuaccacggcggcaacuccggcuucgacuucuggggccagggcacccucgucaccgucuccucc

SEQ ID NO: 20229 - RNA, 363 nt, Artificial Sequence
  derived and/or modified sequence opt2 from anti-influenza_Chain
cagguccagcuccaggaguccggccccggccuccucaagcccuccgacacccucgcccucaccugcaccgucuccggcggcuccaucaccuccgacuacugguccuggauccgccagccccccggccgcggccucgacuggaucggcuucuucuacaacggcggcuccaccaaguacaaccccucccucaagucccgcgucaccaucuccgccgacaccuccaagaaccagcucucccucaagcucaccuccgucaccgccgccgacaccggcgucuacuacugcgcccgccacgacgccaaguucuccggcuccuacuacgucgccuccuggggccagggcacccgcgucaccgucuccucc

SEQ ID NO: 20230 - RNA, 363 nt, Artificial Sequence
  derived and/or modified sequence opt2 from anti-influenza_Chain
cagguccagcuccaggaguccggccccggccuccucaagcccuccgacacccucgcccucaccugcaccgucuccggcggcuccaucaccuccgacuacugguccuggauccgccagccccccggccgcggccucgacuggaucggcuucuucuacaacggcggcuccaccaaguacaaccccucccucaagucccgcgucaccaucuccgccgacaccuccaagaaccagcucucccucaagcucaccuccgucaccgccgccgacaccggcgucuacuacugcgcccgccacgacgucaaguucuccggcuccuacuacgucgccuccuggggccagggcacccgcgucaccgucuccucc

SEQ ID NO: 20231 - RNA, 363 nt, Artificial Sequence
  derived and/or modified sequence opt2 from anti-influenza_Chain
cagguccagcuccaggaguccggccccggccucgucaagcccuccgagacccucuccgucaccugcaaggucuccggcgacuccaucuccuccuacuccugguccuggauccgccagccccccggcaagggccucgagugggucggcuaccucuacuacuccggcuccaccaaguacaaccccucccucaagucccgcaccaccaucuccgucgacaccuccaccaaccagcucucccucaagcucuccuucgucaccgccgccgacaccgccgucuacuucugcgcccgcaccggcuccgaguccaccaccggcuacggcauggacgucuggggccagggcaccaccgucaccgucuccucc

SEQ ID NO: 20232 - RNA, 363 nt, Artificial Sequence
  derived and/or modified sequence opt2 from anti-influenza_Chain
gagguccagcucgucgaguccggcgccgaggucaagaagcccggcuccuccgucaaggucuccugcaaggccuccggcggccccuuccgcuccuacgccaucuccuggguccgccaggcccccggccagggccccgaguggaugggcggcaucauccccaucuucggcaccaccaaguacgcccccaaguuccagggccgcgucaccaucaccgccgacgacuucgccggcaccgucuacauggagcucuccucccuccgcuccgaggacaccgccauguacuacugcgccaagcacaugggcuaccagguccgcgagaccauggacgucuggggcaagggcaccaccgucaccgucuccucc

SEQ ID NO: 20233 - RNA, 363 nt, Artificial Sequence
  derived and/or modified sequence opt2 from anti-influenza_Chain
cagguccagcucguccaguccggcgccgaggucaagaagcccggcuccuccgucaaggucuccugcaaggccuccggcggccccuuccgcuccuacgccaucuccuggguccgccaggcccccggccagggccccgaguggaugggcggcaucauccccaucuucggcaccaccaaguacgcccccaaguuccagggccgcgucaccaucaccgccgacgacuucgccggcaccgucuacauggagcucuccucccuccgcuccgaggacaccgccauguacuacugcgccaagcacaugggcuaccagguccgcgagaccauggacgucuggggcaagggcaccaccgucaccgucuccucc

SEQ ID NO: 20234 - RNA, 363 nt, Artificial Sequence
  derived and/or modified sequence opt2 from anti-influenza_Chain
gagguccagcucgucgagaccggcgccgaggucaagaagcccggcgccuccgucaaggucuccugcaaggccuccggcuacaccuucaccuccuacuacaugcacuggguccgccaggcccccggccagggccucgaguggaugggcuggaucaaccccaacuccggcggcaccaacuacgcccagaaguuccagggccgcgucaccaugacccgcgacaccuccaucuccaccgccuacauggagcucucccgccuccgcuccgacgacaccgccgucuacuacugcgcccgcgagggcaaguggggcccccaggccgccuucgacaucuggggccagggcaccauggucaccgucuccucc

SEQ ID NO: 20235 - RNA, 363 nt, Artificial Sequence
  derived and/or modified sequence opt2 from anti-influenza_Chain
gagguccagcucgucgaguccggcgccgaggucaagaagcccggcuccuccgucaaggucuccugcaaggccuccggcggcaccuucuccuucuacuccauguccuggguccgccaggcccccggccagggccucgaguggaugggcggcaucauccccauguucggcaccaccaacuacgcccagaaguuccagggccgcgucaccaucaccgccgucgaguccaccuccaccgccuacauggaggucuccucccuccgcuccgaggacaccgccgucuacuacugcgcccgcggcgacaagggcaucuacuacuacuacauggacgucuggggcaagggcaccaccgucaccgucuccucc

SEQ ID NO: 20236 - RNA, 363 nt, Artificial Sequence
  derived and/or modified sequence opt2 from anti-influenza_Chain
gagguccagcucgucgagaccggcgccgaggucaagaagcccggcuccuccgucaaggucuccugcaaggccuccggcggcaccuuccgcacccacgccaucuccuggguccgccaggcccccggccagggccucgaguggaugggcggcaucaucgccaucuucggcaccgccaacuacgcccagaaguuccagggccgcaucaccaucaccgccgacgaguccaccuccaccgccuacauggagcucuccucccuccgcuccgaggacaccgccgucuacuucugcgcccgcggcuccggcuaccacaucuccacccccuucgacaacuggggccagggcacccucgucaccgucuccucc

SEQ ID NO: 20237 - RNA, 363 nt, Artificial Sequence
  derived and/or modified sequence opt2 from anti-influenza_Chain
gagguccagcucguccaguccggcgccgaggucaagaagcccggcuccuccgucaaggucuccugcaaggccuccggcggcaucuuccgcuccaacuccaucuccuggguccgccaggcccccggccagggccucgaguggaugggcggcaucuucgcccucuucggcaccaccgacuacgcccagaaguuccagggccgcgucaccaucaccgccgacgaguccuccaccaccgucuaccucgagcucuccucccucaccuccgaggacaccgccgucuacuacugcgcccgcggcuccggcuacaccacccgcaacuacuucgacuacuggggccagggcacccucgucaccgucuccucc

SEQ ID NO: 20238 - RNA, 363 nt, Artificial Sequence
  derived and/or modified sequence opt2 from anti-influenza_Chain
gagguccagcucgucgaguccggcgccgaggucaagaagcccggcuccuccgucaaggucuccugcaaggccuccggcggcaucuucaacuccuacgccaucuccuggguccgccaggcccccggccagggccucgaguggaugggcggcaucaucgccaucuuccacacccccaaguacgcccagaaguuccagggccgcgucaccaucaccgccgacgaguccaccaacaccgccuacauggagcuccgcucccucaaguccgaggacaccgcccucuacuacugcgcccgcggcuccaccuacgacuucuccuccggccucgacuacuggggccagggcacccucgucaccgucuccucc

SEQ ID NO: 20239 - RNA, 363 nt, Artificial Sequence
  derived and/or modified sequence opt2 from anti-influenza_Chain
cagguccagcucguccaguccggcgccgaggucaagaagcccggcuccuccgucaaggucuccugcaaguccuccggcggcaacuucaacaacuacgccgucuccuggguccgccaggcccccggccagggccucgaguggaugggcggcaucucccccaucuucggcuccaccaaccacgcccagaaguuccagggccgcgucaccaucuccgccgacaucuucaccaacaccgccuacauggagcucuccucccuccgcuccgacgacaccgccaucuacuacugcgcccgcggccgcggcuacuacuucuaccacgccauggacgucuggggccagggcuccaccgucaccgucuccucc

SEQ ID NO: 20240 - RNA, 363 nt, Artificial Sequence
  derived and/or modified sequence opt2 from anti-influenza_Chain
cagguccagcucguccaguccggcgccgaggucaagaagcccggcuccuccgucaaggucuccugcaaggccuccggcggcaccuucaacaacuacgccaucaacuggguccgccaggcccccggccagggccucgaguggaugggcggcaucucccccaucuucggcuccgucaacuacgcccagaagcuccagggccgcgucaccaucaccgccgacgucuucaccuccaccgccuacauggagcucuccucccuccgcuccgaggacaccgccgucuacuacugcgccaagggcuccggcuacuacuacuacuacggccucgacgucuggggccucggcaccaccgucaccgucuccucc

SEQ ID NO: 20241 - RNA, 363 nt, Artificial Sequence
  derived and/or modified sequence opt2 from anti-influenza_Chain
cagguccagcucgucgaguccggcggcggcgucguccagcccggccgcucccuccgccucuccugcgccgccuccggcuucaccuucaccaacuacgccaugcacuggguccgccaggcccccggcaagggccucgagugggucgccgucaucuccuucgacgaggacaacaaguccuacgccgacuacgucaagggccgcuucaccaucucccgcgacaacuccaacaaccgccucuaccuccagaugaacucccuccgcgccgaggacaccgccgucuacuacugcgcccgcggccccgagggcgucuggggccgcuccaucgacuccuggggccagggcacccucgucaccgucuccucc

SEQ ID NO: 20242 - RNA, 363 nt, Artificial Sequence
  derived and/or modified sequence opt2 from anti-influenza_Chain
cagguccagcucguccaguccggcggcgaccucguccagcccggcggcucccuccgccucuccugcgccgccuccggcuucaccuucucccgcuacuccaugaacuggguccgccaggcccccggcaugggccucgagugggucgccuacaucuccgacaccucccgcaccaucuacuacgccgacuccgucaagggccgcuucaccaucucccgcgacaacgccaagaacucccucuaccuccagaugaagucccuccgcgacgaggacaccgccgucuacuacugcgcccgcgaccccgacacccccuucguccgcgccuucgacuccuggggccagggcacccucgucaccgucuccucc

SEQ ID NO: 20243 - RNA, 363 nt, Artificial Sequence
  derived and/or modified sequence opt2 from anti-influenza_Chain
cagguccagcucgucgaguccggcggcggccucguccagcccggcggcucccuccgccucuccugcgucgccuccggcuucaccuucucccgcuucuccaugaacuggguccgccaggcccccggcaugggccucgagugggucuccuacaucuccgacaccggccgcaccaucuacuacgccgacuccgucaagggccgcuucaccaucucccgcgacaacgacaagaacacccucuaccuccagaugaagucccuccgcgacgaggacuccgccuucuacuacugcgcccgcgaccccgacacccccuucguccgcgccuucgacuccuggggccagggcguccucgucaccgucuccucc

SEQ ID NO: 20244 - RNA, 363 nt, Artificial Sequence
  derived and/or modified sequence opt2 from anti-influenza_Chain
cagguccagcuccaggaguccggccccgaccucgucaagcccggcgccuccgucaagauguccugcaaggccuccggcuacuccuucaccuacuaccacaugcacugggucaagcagacccacggcaagucccucgaguggaucggccgcaucuaccccuacaacggcggcaccaacuacucccagcgcuucaagggcaaggccgucuucaccgucgacauguccuccuccaccgccuacauggagcuccgcucccucaccuccgaggacuccgccgucuacuacugcgcccgcgacgccaacuacgagggcgacugguacuucgacgucuggggccagggcaccaccgucaccgucuccucc

SEQ ID NO: 20245 - RNA, 366 nt, Artificial Sequence
  derived and/or modified sequence opt2 from anti-influenza_Chain
cagggccagcucguccaguccggcgccgaggucaagaaguccggcuccuccgucaaggucuccugcaagaccuccggcggcaccuucaacucccacgccaucuccuggguccgccaggcccccggccagggccucgaguggaucggcggcaucauccccauguucggcaccaccaacuacgcccagaagcucaagggccgcaucgccaucaccgccgaccagcuccccaccaccgccuaccucgagcucuccucccuccgcuccgaggacaccgccgucuacuacugcgcccgcggccagcgcuacuacuacgaccgcgacggcauggacgucuggggccagggcaccauggucaccgucuccucc

SEQ ID NO: 20246 - RNA, 366 nt, Artificial Sequence
  derived and/or modified sequence opt2 from anti-influenza_Chain
cagguccaccucguccaguccggcgccgaggucaagaagcccggcuccuccguccgccucuccugcuccgccuccggcggccccuucuccggcuucgccaucuccuggcuccgccaggcccccggccagggccucgaguggcucggcggcaucuccgccgucuucggcaccgccaccuacgcccagaaguuccagggccgcgucaccaucaccgccgaccaguucaccuccaccucccacauggaccucucccgccucaccuacgacgacaccgccgucuacuacugcgcccgcuccggcggcuaccucccccagaacaacuggaucgaccccuggggccagggcacccucgucaucgucuccucc

SEQ ID NO: 20247 - RNA, 366 nt, Artificial Sequence
  derived and/or modified sequence opt2 from anti-influenza_Chain
cagguccagcucguccaguccggcgccgaggucaagaaggccggcuccuccgucaaggucuccugccaguccuccggcgucaccuucuccauguacgccgucuccuggguccgccaggcccccggccagggccucgaguggaugggcggcaucaucccccucuucggcaccaccaccuacgcccagaaguucgagggccgccucaccaucaccgccgacaccuccaccaacauggccuaccucgagcuccgcucccuccgcuccgaggacaccgccgucuacuucugcgcccgcgccggcaccaccgucacccgcuucaacugguucgaccccuggggccagggcacccucgucaccgucuccucc

SEQ ID NO: 20248 - RNA, 366 nt, Artificial Sequence
  derived and/or modified sequence opt2 from anti-influenza_Chain
cagguccagcucguccaguccggcgccgaggucaagaagcccggcuccucccucaaggucuccugcaaggccuccggcgucaccuucuccauguacaccaucuccuggguccgccaggcccccggccagggccucgaguggaugggcggcaucaucccccucuucggcaccgccaacuacgagcagaaguuccagggccgcgucaccaucaccgccgacaccuccaccaacaccgccuacauggagcucuccucccuccgcuccgaggacaccgccgucuacuacugcgcccgcgccggcaccacccucacccgcuucaacugguucgaccccuggggccagggcacccucgucaccgucuccucc

SEQ ID NO: 20249 - RNA, 366 nt, Artificial Sequence
  derived and/or modified sequence opt2 from anti-influenza_Chain
auggccgacaacaugaccaccacccagaucgaguggcgcaugaagaagauggccaucggcuccuccacccacuccuccuccguccucaugaaggacauccagucccaguucgagcagcucaagcuccgcugggaguccuaccccaaccucgucaaguccaccgacuaccaccagaagcgcgagaccauccgccucgccaccgaggagcucuaccuccucuccaagcgcaucgacgacuccauccucuuccacaagaccgucaucgccaacuccuccaucaucgccgacaugaucgucucccucucccuccucgagacccucuacgagaugaaggacgucgucgaggucuacucccgccagugccuc

SEQ ID NO: 20250 - RNA, 366 nt, Artificial Sequence
  derived and/or modified sequence opt2 from anti-influenza_Chain
gagguccagcucguccaguccggcggcggccucguccagcccggcggcucccuccgccucgccugcgucgucuccggcuucaccgucaccuccaacuacaucaccuggguccgccaggcccccggcaagggccucgagugggucuccgucaucuacucccacggccgcgccuacuacuccgccuccgucaacggccgcuucaccaucucccgccacaccuccaagaacaccgucuaccucgagaugaacucccuccgccccgaggacaccgccgucuacuacugcgccggcggcggccucgucggcggcuacgacgaguacuucuucgacuacuggggccagggcacccucgccaccgucuccucc

SEQ ID NO: 20251 - RNA, 366 nt, Artificial Sequence
  derived and/or modified sequence opt2 from anti-influenza_Chain
cagguccagcucguccaguccggcgccgaggucaagaagcccggcgccuccgucaaggucuccugcaaggccuccggcuacaccuucaccggcuacuacaugcacuggguccgccaggcccccggccagggccucgaguggaugggcuggaucaaccccaacuccggcgacaccaacuacgcccagaaguuccagggccgcgucaccaugacccgcgacaccuccaucaccaccgccuacauggagcucuccucccuccgcuccgacgacaccgccgucuacuacugcgcccgcgacucccccuacuccuccuccugguccuucuucgacuacuggggccagggcccccucgucaccgucuccucc

SEQ ID NO: 20252 - RNA, 366 nt, Artificial Sequence
  derived and/or modified sequence opt2 from anti-influenza_Chain
gagguccagcucgucgaguccggcggcggccucguccagcccggcggcucccuccgccucuccugcgccgccuccggcuucaucuuccgcaacuacuggauguccuggguccgccaggcccccggcaagggccucgagugggucgccaacaucaagcaggacggccgcgagaaguacuacgucgacucccuccgcggccgcgucaacaucucccgcgacaacgccgagaacucccucuaccuccacaugaacucccuccgcgucgaggacaccgccgucuacuucugcgcccgcgcccgcauggucgucgucaccggcgacggcuucgacgucuggggccacggcaccauggucaccgucuccucc

SEQ ID NO: 20253 - RNA, 366 nt, Artificial Sequence
  derived and/or modified sequence opt2 from anti-influenza_Chain
gagguccagcuccucgaguccggcggcggccucguccagcccggcggcucccuccgccucuccugcgccgccuccggcuucgccuucuccuccuacggcauguccuggguccgccaggcccccggcaagggccucgagugggucuccgccuucuccggcuccggcaccuccaccuacuacgccgacuccgucaagggccgcuucaccaucucccgcgacaaguccaagaacacccucuaccuccagaugaacucccuccgcgccgaggacaccgccaucuacuacugcgccaagccccccggccccuacaucgucgucgccggccucuucgagaacuggggccgcggcacccucgucaccgucucc

SEQ ID NO: 20254 - RNA, 366 nt, Artificial Sequence
  derived and/or modified sequence opt2 from anti-influenza_Chain
gagguccagcucgucgaguccggcggcggcgucguccagcccggccgcucccuccgccucuccugcgccgccuccggcuucuccuucuccaacuacgccaugcacuggguccgccaggcccccggcaagggccucgagugggucgcccucaucuccuucgacggcuccgacaaguacuacgccgacuccgucaagggccgcuucaccaugucccgcgacaacuccaagaacacccucuaccuccagaugaacucccuccgcgccgaggacaccgccgucuacuacugcgcccgcgacgagcccuacugcggcggcgacugcuucgccuucgacgucuggggccagggcaccauggucaccgucucc

SEQ ID NO: 20255 - RNA, 366 nt, Artificial Sequence
  derived and/or modified sequence opt2 from anti-influenza_Chain
cagguccagcuccagcaguccggccccggccucgucaagcccucccagacccucucccucaccugcaccgucuccggcggccccgucuccggcggcggcuacuccuggaacuggauccgccagcgccccggccagggccucgagugggucggcuucauguuccacuccggcuccccccgcuacaaccccacccucaagucccgcaucaccaucuccgucgacaccuccaagaaccucgucucccucaagcucuccuccgucaccgccgccgacaccgccgucuacuucugcgcccgcgucggccagauggacaaguacuacgccauggacgucuggggccagggcaccaccgucaccgucuccucc

SEQ ID NO: 20256 - RNA, 366 nt, Artificial Sequence
  derived and/or modified sequence opt2 from anti-influenza_Chain
cagguccagcucguccaguccggcggcggccucgucaagcccggcggcucccuccgccucuccugcgccgccuccggcuucaccuucuccuccuacuccaugaacuggguccgccaggcccccggcaagggccucgagugggucuccuccaucuccuccuccuccuccuacaucuacuacgucgacuccgucaagggccgcuucaccaucucccgcgacaacgccaagaacucccucuaccuccagaugaacucccuccgcgccgaggacaccgccgucuacuacugcgcccgcggcggcggcuccuacggcgccuacgagggcuucgacuacuggggccagggcacccucgucaccgucuccucc

SEQ ID NO: 20257 - RNA, 366 nt, Artificial Sequence
  derived and/or modified sequence opt2 from anti-influenza_Chain
cagguccagcucguccaguccggcggcggcgucguccagcccggccgcucccuccgccucuccugcgccgccuccggcuucaacuucuccuccuacggcaugcacuggguccgccaggcccccggcaagggccucgaguggcucuccgucaucugguccggcggcuccaacaaguacuacgccgacuccgucaagggccgcuucaccaucucccgcgacgacuccaagaacaccgucuaccuccagaugaacucccuccgcgacgaggacaccgccgucuacuacugcgcccgcgcccacaccgcccucacccgcuuccgcuggcucgaccccuggggccagggcauccucgucaccgucuccucc

SEQ ID NO: 20258 - RNA, 366 nt, Artificial Sequence
  derived and/or modified sequence opt2 from anti-influenza_Chain
cagguccagcucguccaguccggcggcggcgucguccagcgcggccgcucccuccgccucuccugcgccgccuccggcuucaccuuccgcaccuacggcaugcacuggguccgccaggcccccggcaagggccucgagugcgucgcccucaucuccuacgacggcaccaacaaguacuacgccgacuccgucaagggccgcuucaccaucucccgcgacaacuccaaggacacccucuaccuccagaugaacucccuccgcgccgaggacaccggcgucuacuacugcgccucccucgacuacgacuucuccuacuacuaccaccgcgacgucuggggccccggcaccaccgucaccgucuccucc

SEQ ID NO: 20259 - RNA, 366 nt, Artificial Sequence
  derived and/or modified sequence opt2 from anti-influenza_Chain
cagguccagcucgucgaguccggcggcggccucguccagcccggcggcucccuccgccucuccugcgccgccuccggcuucaccuucuccgacuacuggauggucuggguccgccaggcccccggcaagggccucgucugggucucccgcaucuccuccgacggcuccaccaccuccuacgccgacuccgucaagggccccuucaccaucucccgcgacaacgccaagaacacccucuaccuccagaugaacucccuccgcgccgaggacaccgccgucuacuacugcgcccgcgucgccacccccuacuacuacgaguccggcuucgacuacuggggccagggcgcccucgucaccgucuccucc

SEQ ID NO: 20260 - RNA, 369 nt, Artificial Sequence
  derived and/or modified sequence opt2 from anti-influenza_Chain
caguuccagcucguccaguccggccccgaggucaagaagcccggcaccuccgucaaggucuccugcaaggccuccggcuacaccuccaccaccuacggcaucuccuggguccgccagguccccggccagggccucgaguggaugggcuggaucaaccccuacaacggcaacccccacuacggccagaaguuccagggccgcgucacccucacccgcgacaccuccaccaacaccgccuaccucgagauccucucccuccgcuccgacgacaccgccgucuacuacugcgcccgcgacggcuggggccagcagcucguccccuacuacuucgacuacuggggccagggcacccucgucaccgucuccucc

SEQ ID NO: 20261 - RNA, 369 nt, Artificial Sequence
  derived and/or modified sequence opt2 from anti-influenza_Chain
cagguccagcucgcccaguccggcgccgaggucaagcgccccggcuccuccgucaaggucuccugcaccgccuccggcggcaucuuccgcaagaacgccaucuccuggguccgccaggcccccggccagggccucgaguggaugggcggcaucaucgccgucuucaacaccgccaacuacgcccagaaguuccagggccgcgucaagaucaccgccgacgaguccggcaacaccgccuacauggagcucuccucccuccgcuccgacgacaccgccgucuacuacugcgccucccaccccaaguacuucuacggcuccggcuccuaccccgacuucuggggccagggcacccucgucaccgucuccucc

SEQ ID NO: 20262 - RNA, 369 nt, Artificial Sequence
  derived and/or modified sequence opt2 from anti-influenza_Chain
cagguccagcuccaggaguccggccccggccucgucaagcccuccgagacccucucccucaccugcaccgucucccgcggcuccaucggccacuacuucugguccuggauccgccagccccccggcaagggccucgaguggaucggcuacaucuccuacuccggcuccaccaaguacaaccccucccuccgcucccgcgucaccaucuccgucgacaccuccaagaaccaguucucccucaaccucaacuccgucaccgccaccgacaccgcccucuacuacugcgcccgcgaggacuacgacauccucaccggcgccggccccggcauggaggucuggggccagggcaccaccgucaccgucuccucc

SEQ ID NO: 20263 - RNA, 369 nt, Artificial Sequence
  derived and/or modified sequence opt2 from anti-influenza_Chain
cagguccagcuccaggaguccggccccggccucgucaagcccuccgagacccucucccucaccugcaccgucuccggcgccuccaucaacucccacuacugguccuggauccgccagccccccggcaagggccucgaguggaucggcuacgucuacuacuccggcuccaccaccuacaaccccucccucaagucccgcgucacccucuccgucgacaccuccaagaaccaguucucccucaaccucuccuccgucaccgccgccgacaccgccuucuacuacugcgcccgccaccccuacgacguccucaccggcuccggcgacugguucgaccccuggggccagggcacccucgucaccgucuccucc

SEQ ID NO: 20264 - RNA, 369 nt, Artificial Sequence
  derived and/or modified sequence opt2 from anti-influenza_Chain
cagguccagcucguccaguccggcgccgaggucaagcgccccggcuccuccgucaaggucuccugcaccgccuccggcggcaucuuccgcaagaacgccaucuccuggguccgccaggcccccggccagggccucgaguggaugggcggcaucaucgccgucuucaacaccgccaacuacgcccagaaguuccagaaccgcgucaagaucaccgccgacgaguccggcaacaccgccuacauggagcucuccucccucaccuccgacgacaccgccgucuacuacugcgccucccaccccaaguacuucuacggcuccggcuccuaccccgacuucuggggccagggcacccucgucaccgucuccucc

SEQ ID NO: 20265 - RNA, 369 nt, Artificial Sequence
  derived and/or modified sequence opt2 from anti-influenza_Chain
gagguccagcucgucgaguccggcgccgaggucaagaagcccggcuccuccgucaaggucuccugcaaggccuccggcggcaccuuccgcuccuacgccgucuccuggguccgccaggcccccggccagggccucgaguggaugggcggcaucaucgccaucuucggcaccaccaacuacgcccagaaguuccaggaccgcgucaccaucaccgccgacgaccuccccuccaccgccuacauggagcucaccucccuccgcuccgaggacaccgccgucuacuucugcguccgcggccgcggcuacuaccucggcggcgacuacggcucccucgacuccuggggccagggcacccucgucaccgucucc

SEQ ID NO: 20266 - RNA, 369 nt, Artificial Sequence
  derived and/or modified sequence opt2 from anti-influenza_Chain
gagguccagcucgucgaguccggcggcggccucguccagcccggccgcucccuccgccucuccugcgucggcuccggcuucaacuucgacggcuacgccaugcaguggguccgccagguccccggcaagggccucgagugggucuccggcaucuccuggcacuccgacuccaccggcuacgccgacuccguccgcggccgcuucaccaucucccgcgacaacgccaagaacucccucuaccuccagauggacucccuccgccccgaggacaccgccuucuacuacugcggcaaguccaucggccacgucggcggcuccuaccgccaccccaucgacuacuggggccagggcacccucgucaccgucucc

SEQ ID NO: 20267 - RNA, 369 nt, Artificial Sequence
  derived and/or modified sequence opt2 from anti-influenza_Chain
cagguccagcuccaggccuccggccccggccucgucaagcccuccgagacccucucccucaccugcaccgucuccggcgacuccaucaccuccggcgccuacuacuggaccuggauccgccagcaccccggcaagggccucgaguggaucggcuacaucuacuacuccggcaacaccuacuacaaccccucccucaagucccgcgucaccaucucccucgacaccuccaagaaccaguucucccucaaggucaacuccgucaccgccgccgacaccgccgucuacuacugcgcccgcgccgccuccaccuccguccucggcuacggcauggacgucuggggccagggcaccaccgucaccgucuccucc

SEQ ID NO: 20268 - RNA, 369 nt, Artificial Sequence
  derived and/or modified sequence opt2 from anti-influenza_Chain
cagguccagcucguccaguccggcgccgaggucaagaagcccggcuccuccguccgcgucuccugcaaggccuccggcuccaucuuccgcaacuacgccauguccuggguccgccaggcccccggccagggccucgaguggaugggcggcaucaucgccaucuucggcacccccaaguacgcccagaaguuccagggccgcgucaccaucaccgccgacgaguccaccuccaccgucuacauggagcucuccggccuccgcuccgaggacaccgccauguacuacugcgcccgcaucccccacuacaacuucggcuccggcuccuacuucgacuacuggggccagggcacccucgucaccgucuccucc

SEQ ID NO: 20269 - RNA, 369 nt, Artificial Sequence
  derived and/or modified sequence opt2 from anti-influenza_Chain
cagcuccagcuccaggaguccggcccccgccucgucaagcccuccgagacccucucccucaccugcuccgucuccggcgucuccaucuccuccuccaacuacuacuggggcuggauccgccagccccccggcaagggccucgaguggaucggcaccaucuaccacuccggcuccaccuacuacaaccccucccucaagucccgccucaucaucuccgucgacaccuccaagaaccaguucuaccuccagcucaccucccucaccgccgccgacuccgccgucuacuacugcgccaccggcggcggcuucggcuggucccagaccuacuucggcuacuggggccagggcacccucgucaccgccuccucc

SEQ ID NO: 20270 - RNA, 369 nt, Artificial Sequence
  derived and/or modified sequence opt2 from anti-influenza_Chain
gagguccagcuccagcaguccggccccgagcucgucaagcccggcgccuccgucaagauguccugcaaggccuccggcuacaccuucaccuccuucaucauguacugggucaagcagaagcccggccagggccucgaguggcucggcuacaucgaccccuacaacgacggcaccaaguacaacgagaaguucgagggcaaggccacccucaccuccgacaaguccuccuccaccgccuacauggagcucuccucccucaccuccgaggacuccgccgucuacuacugcgccaagcgcggcaacuacggcaacggcuucgccuacuggggccagggcacccucgucaccgucuccgccgccaagaccucc

SEQ ID NO: 20271 - RNA, 369 nt, Artificial Sequence
  derived and/or modified sequence opt2 from anti-influenza_Chain
cagguccagcuccucgaguccggcggcgacgucguccagcccggcaccucccuccgccucuccugcgccgccuccggcuucucccucuggaccuccggcaugcacuggguccgccaggcccccggcaagggccucgagugggucgccgucauguccuacgacgagaccaagaaguacuacgccgacuccguccgcggccgcuucuccaucucccgcgacaacucccgcaacacccucuaccuccagaugaacucccuccgcgucgaggacaccgccgucuacuucugcgccaagccccgccucgacuaccucgacuacuuccacgccgccgacuccuggggccagggcacccucgucuccgucuccucc

SEQ ID NO: 20272 - RNA, 369 nt, Artificial Sequence
  derived and/or modified sequence opt2 from anti-influenza_Chain
cagguccagcucgucgaguccggcgccgagguccgcaagcccggcgagucccuccgcaucuccugcaaggcccacggcgacuccuucaccuccuacuggaucggcuggguccgccagcuccccggcaagggccucgaguggauggccgucaucuacccccgcgacuccgagaccaaguucucccccgccuuccacggccaggucuccaucuccgucgacaaguccaccuccaccguccaccuccaguggaacucccucaaggccuccgacaccgccgucuacuacugcgcccgcucccccggcuacuccggcuaccucuacggcugguucgaccccuggggccagggcacccccgucaccgucuccucc

SEQ ID NO: 20273 - RNA, 369 nt, Artificial Sequence
  derived and/or modified sequence opt2 from anti-influenza_Chain
cagguccagcucgucgaguccggccccggccucgucaagcccuccgagacccucucccucaccugcaccgucuccggcgacuccgucaucaacuccgccuacuacugggacuggauccgccagccccccggcaagggccucgagugggucggcuccgucuacuacuccggcaucaccuacuacaaccccucccucaagucccgcgucaccaucuccgucgacaccuccaagaaccaguucucccuccgccucuccuacgucaccgccgccgacaccgcccucuacuacugcgcccgccgcggcggcggcuggcaguacuacuacggcauggacgucuggggccagggcaccaccgucaccgucuccucc

SEQ ID NO: 20274 - RNA, 369 nt, Artificial Sequence
  derived and/or modified sequence opt2 from anti-influenza_Chain
cagguccagcucguccaguccggcgccgaggucaagaagcccggcgccuccgucaaggucuccugcaaggccuccggcuacaucuucaccggcuacuacauccacuggguccgccaggcccccggccagggccucgaguggaugggccgcaucgaccccaacggcuccggcaccaccuacgcccagaaguuccagggccgcgucacccucaccauggacaccuccaucaccaccgccuacauggagcucucccgccuccgcuucgacgacaccgccaucuacuacugcgcccgcugggacuggaacuucgaccucuaccucggcugguucgaccccuggggccagggcacccccgucaccgucgccucc

SEQ ID NO: 20275 - RNA, 369 nt, Artificial Sequence
  derived and/or modified sequence opt2 from anti-influenza_Chain
gagguccagcucguccaguccggcgccgaggucaagaagcccggcgccuccgucaaggucuccugcaaggccuccggcuacaucuucaccggcuacuacauccacuggguccgccaggcccccggccagggccucgaguggaugggccgcaucgaccccaacggcgccggcaccaccuacgcccagaaguuccagggccgcgucacccucaccauggacaccuccaucaccaccgccuacauggagcucucccgccuccgcuucgacgacaccgccaucuacuacugcgcccgcugggacuggaacuucgaccucuaccucggcugguucgaccccuggggccagggcacccccgucaccgucgccucc

SEQ ID NO: 20276 - RNA, 369 nt, Artificial Sequence
  derived and/or modified sequence opt2 from anti-influenza_Chain
cagguccagcucguccaguccggcgccgaggucaagaagcccggcgccuccgucaaggucuccugcaaggccuccggcuacaccuucaacgcccaccacaugcacuggguccgccaggcccccggccagggccucggcuggaugggcuggaucgaccccaacaacgacggcaccaucuacgcccagaaguuccagggccgcgucacccucaccauggacaccuccauccacaccgccuacauggagcucuccggccuccgcuacgacgacaccgccaucuacuacugcguccgcugggccuggaacuucgacuucuuccucggcugguucgaccccuggggccagggcacccucgucaccgucgccucc

SEQ ID NO: 20277 - RNA, 369 nt, Artificial Sequence
  derived and/or modified sequence opt2 from anti-influenza_Chain
gagguccagcucguccaguccggcgccgaggucaagaagcccggcgagucccucaagaucuccugcaaggucuccggcuacuccuucaccucccaguggaucggcuggguccgccagaugcccggcaagggccucgaguggaucggcaugauguaccccggcgacuccgacaccaucuacucccccuccuuccagggccaggucaccaucuccgccgacaacuccaucuccaccgccuaccuccagugguccucccucaaggccuccgacaccgccaucuacuacugcgccuccggccccggcuacuccggcuaccacuacggcugguucgacaccuggggccagggcacccucgucaccgucuccucc

SEQ ID NO: 20278 - RNA, 369 nt, Artificial Sequence
  derived and/or modified sequence opt2 from anti-influenza_Chain
gagguccagcucguccaguccggcgccgaggucaagaagcccggcgagucccucaagaucuccugcaaggucuccggcuacuccuucaccucccaguggaucggcuggguccgccagaugcccggcaagggccucgaguggaucggcaugauguaccccggcgacgccgacgccaucuacucccccuccuuccagggccaggucaccaucuccgccgacaacuccaucuccaccgccuaccuccagugguccucccucaaggccuccgacaccgccaucuacuacugcgccuccggccccggcuacuccggcuaccacuacggcugguucgacaccuggggccagggcacccucgucaccgucuccucc

SEQ ID NO: 20279 - RNA, 369 nt, Artificial Sequence
  derived and/or modified sequence opt2 from anti-influenza_Chain
gagguccagcucguccaguccggcgccgaggucaagaagcccggcgagucccucaagaucuccugcaaggucuccggcuacuccuucaccucccaguggaucggcuggguccgccagaugcccggcaagggccucgaguggaucggcaugauguaccccggcgaguccgagaccaucuacucccccuccuuccagggccaggucaccaucuccgccgacaacuccaucuccaccgccuaccuccagugguccucccucaaggccuccgacaccgccaucuacuacugcgccuccggccccggcuacuccggcuaccacuacggcugguucgacaccuggggccagggcacccucgucaccgucuccucc

SEQ ID NO: 20280 - RNA, 369 nt, Artificial Sequence
  derived and/or modified sequence opt2 from anti-influenza_Chain
gagguccagcucguccaguccggcgccgaggucaagaagcccggcgagucccucaagaucuccugcaaggucuccggcuacuccuucaccucccaguggaucggcuggguccgccagaugcccggcaagggccucgaguggaucggcaugauguaccccggcgacgccgacaccaucuacucccccuccuuccagggccaggucaccaucuccgccgacaacuccaucuccaccgccuaccuccagugguccucccucaaggccuccgacaccgccaucuacuacugcgccuccggccccggcuacuccggcuaccacuacggcugguucgacaccuggggccagggcacccucgucaccgucuccucc

SEQ ID NO: 20281 - RNA, 369 nt, Artificial Sequence
  derived and/or modified sequence opt2 from anti-influenza_Chain
gagguccagcucguccaguccggcgccgaggucaagaagcccggcgagucccucaagaucuccugcaaggucuccggcuacuccuucaccucccaguggaucggcuggguccgccagaugcccggcaagggccucgaguggaucggcaugauguaccccggcuccuccgacaccaucuacucccccuccuuccagggccaggucaccaucuccgccgacaacuccaucuccaccgccuaccuccagugguccucccucaaggccuccgacaccgccaucuacuacugcgccuccggccccggcuacuccggcuaccacuacggcugguucgacaccuggggccagggcacccucgucaccgucuccucc

SEQ ID NO: 20282 - RNA, 369 nt, Artificial Sequence
  derived and/or modified sequence opt2 from anti-influenza_Chain
gagguccagcucguccaguccggcgccgaggucaagaagcccggcgagucccucaagaucuccugcaaggucuccggcuacuccuucaccucccaguggaucggcuggguccgccagaugcccggcaagggccucgaguggaucggcaugauguaccccggcgacuccgacgccaucuacucccccuccuuccagggccaggucaccaucuccgccgacaacuccaucuccaccgccuaccuccagugguccucccucaaggccuccgacaccgccaucuacuacugcgccuccggccccggcuacuccggcuaccacuacggcugguucgacaccuggggccagggcacccucgucaccgucuccucc

SEQ ID NO: 20283 - RNA, 369 nt, Artificial Sequence
  derived and/or modified sequence opt2 from anti-influenza_Chain
gagguccagcucguccaguccggcgccgaggucaagaagcccggcgagucccucaagaucuccugcaaggucuccggcuacuccuucaccucccaguggaucggcuggguccgccagaugcccggcaagggccucgaguggaucggcaugauguaccccggcgacaccgacaccaucuacucccccuccuuccagggccaggucaccaucuccgccgacaacuccaucuccaccgccuaccuccagugguccucccucaaggccuccgacaccgccaucuacuacugcgccuccggccccggcuacuccggcuaccacuacggcugguucgacaccuggggccagggcacccucgucaccgucuccucc

SEQ ID NO: 20284 - RNA, 369 nt, Artificial Sequence
  derived and/or modified sequence opt2 from anti-influenza_Chain
gagguccagcucguccaguccggcgccgaggucaagaagcccggcgagucccucaagaucuccugcaaggucuccggcuacuccuucaccucccaguggaucggcuggguccgccagaugcccggcaagggccucgaguggaucggcaugauguaccccggcgaguccgacaccaucuacucccccuccuuccagggccaggucaccaucuccgccgacaacuccaucuccaccgccuaccuccagugguccucccucaaggccuccgacaccgccaucuacuacugcgccuccggccccggcuacuccggcuaccacuacggcugguucgacaccuggggccagggcacccucgucaccgucuccucc

SEQ ID NO: 20285 - RNA, 372 nt, Artificial Sequence
  derived and/or modified sequence opt2 from anti-influenza_Chain
cagguccagcucguccaguccggcgccgaggucaagaagcccggcuccuccgucaaggucuccugcaaggccuccggcggcaucuucaucucccaggccaucuccuggguccgccaggcccccggccagggccucgaguggaugggcggcaucauccccauguucggcgccaccaacuacgcccagaaguuccagggccgcgucaccaucaccgccgacaaguccaccaacaccgucuacauggagcucuccucccucaccuccgaggacaccgccgucuacuacugcgcccgccucggcuccggcuccuaccacaacggccccaacugguucgaccccuggggccagggcacccucgucaccgucuccucc

SEQ ID NO: 20286 - RNA, 372 nt, Artificial Sequence
  derived and/or modified sequence opt2 from anti-influenza_Chain
cagguccagcuccaggaguccggccccggccucgucaagcccuccgagacccucucccucaacugcgccgucuccggcggcuccaucuccaacuacuacugguccuggauccgccagccccccggcaagggccucgaguggaucggcuacaucuccuacaacggccgccccaaguacaaccccucccucaccucccgcgucaccaucuccgucgacaccuccaaggaccaguucucccucgagcuccgcuccgucaccgccgccgacaccgcccucuacuacugcgcccgcgagacccgcuucggcgagcuccucucccccuacgacgccuucgagaucuggggccagggcaccauggucaccgucuccucc

SEQ ID NO: 20287 - RNA, 372 nt, Artificial Sequence
  derived and/or modified sequence opt2 from anti-influenza_Chain
cagguccagcuccaggaguccggccccggccucgucaagcccuccgagacccucucccucaccugcaccgucuccggcggcuccgucuccuccgagaccuacuacugguccuggauccgccagccccccggcaagggccucgaguggaucggcuacaucuacuacaucggcaacaccgacuaccgccccucccucaagucccgcgucaccaucucccucgacaccuccaagaaccaguucucccucaagcucuccuccgucaccgccgccgacaccgccgucuacuacugcgcccgcggcgccuacuacgacuccuccggcuaccccgccuucuacaucuggggccagggcaccauggucaccgucuccucc

SEQ ID NO: 20288 - RNA, 372 nt, Artificial Sequence
  derived and/or modified sequence opt2 from anti-influenza_Chain
cagguccagcuccaggaguccggccccggccucgucaagcccuccgagacccucucccucaccugcgccgucuccggcgucuccaucuccaacaucgacuucuacuggggcuggauccgccagccccccggcaagggccucgaguggaucggcaacaucuacuacaccggcaucaccuucuacaaccccucccucuccucccgcgucgccaucuccaucgacaccuccaagaaccaguucucccucacccucaccuccgucaccgccgccgacaccgccauguacuacugcgcccgccacuacggcgacuccgaggccaucaacgacgccuucgacaucuggggccagggcaccaugcucaccgucuccucc

SEQ ID NO: 20289 - RNA, 372 nt, Artificial Sequence
  derived and/or modified sequence opt2 from anti-influenza_Chain
cagguccagcucgucgaguccggcgccgaggucaagaaguucggcgccuccgucaaggucuccugcaaggccuccggcuacacccucaucgacuacuacaugcacuggguccgcgucgcccccggccagggccucgaguggaugggcuggaucaaccccaucaacggcggcaccaacuacgcccagaaguuccagggccgcgucaccaugacccgcgacaccuccaucaacaccgccuacauggaccucuccucccuccgcuccgacgacaccgccauguacuacugcacccgcggccgccccaucggccgcaacugggagccccgcgacaaggacuacuggggccagggcacccccgucaccgucuccucc

SEQ ID NO: 20290 - RNA, 372 nt, Artificial Sequence
  derived and/or modified sequence opt2 from anti-influenza_Chain
cagguccagcucguccaguccggcgccgaggucaagaagcccggcuccuccgucaccgucuccugcaagaccuccggccacaccuucaucuccuacgccaucuccuggcuccgccaggcccccggccagggccucgaguggaugggcggcaucguccccaucuucggcaccgucaacuacacccagaaguuccagggccgccucaccaucaccgccgacgaguccaccuccaccgccuacauggaccucucccgccucaccuucgaggacaccgccaucuacuucugcgcccgcgaggccggcuaccacuccuccuucuccggcgucuacuucgacuacuggggccagggcacccuccucaccgucuccucc

SEQ ID NO: 20291 - RNA, 372 nt, Artificial Sequence
  derived and/or modified sequence opt2 from anti-influenza_Chain
gagguccagcuccagcaguccggccccgagcucgucaagcccggcgccuccgucaagaucuccugcaaggccuccggcuacaccuucaccgacuacaacaugcacugggucaagcagucccucggcaagucccucgaguggaucggcuacaucuaccccaacaacggcggcaccggcuacaaccagaaguucgaguccaaggccacccucaccgucgacaacuccuccuccaccgccuacauggagcuccgcacccucaccuccgaggacuccgccgucuacuacugcguccgcuccggcgccuacuacuucaacuaccucguccccuacuucgacuacuggggccagggcaccacccucaccgucuccucc

SEQ ID NO: 20292 - RNA, 372 nt, Artificial Sequence
  derived and/or modified sequence opt2 from anti-influenza_Chain
gagguccagcuccagcaguccggccccgagcucgucaagcccggcgccuccgucaagaucuccugcaaggccuccggcuacaccuucaccggcuacaacaugcacugggucaagcagucccacggcaagucccucgaguggaucggcaagaucuaccccaacaacggcgucaccggcuacaaccaggaguuccgcuccaaggccacccucaccgucgacaacuccuccuccaccgccuacauggagcuccgcucccucaccuccgaggacuccgccaucuacuucugcguccgcuccggcgccuacuacgucaacuaccucguccccuacuucgacuacuggggccagggcaccacccucaccgucuccucc

SEQ ID NO: 20293 - RNA, 375 nt, Artificial Sequence
  derived and/or modified sequence opt2 from anti-influenza_Chain
cagguccagcucguccaguccggcgccgaggucaagaagcccggcuccuccgucaaggucuccugcaaggccuccggcgucaccuccuccaacuaccccaucaccuggguccgccaggcccccggccagggccucgaguggaugggcggcguccucccccucuucggcgucaccaacuacgcccagaaguuccagggccgcgucaccaucuccgccgacaaguccaccaacaccgccuacauggagcucuccucccuccgcuccgaggacaccgccgucuacuacugcgcccgcggcaagcgccccggcuacugcuccggcggcgucugcuccuccgacuacuggggccagggcacccucgucaccgucuccucc

SEQ ID NO: 20294 - RNA, 375 nt, Artificial Sequence
  derived and/or modified sequence opt2 from anti-influenza_Chain
cagguccagcuccaggaguccggccccggccucgucaagcccucccagacccucucccucaccugcaccgucuccggcggcuccaucuccuccggcaccuacuacugguccuggauccgccaccaccccggcaagggccucgaguggaucggcuacaucuaccacuccggcuccgccuacuacaaccccucccucgagucccgcgucaccauguccgucgacaccuccaagaaccaguucucccucaagcucuccuccgucaccgccgccgacaccgccaucuacuacugcgcccgcgccgagaaccuccucucccccuaccucgccgagggcuucgaccccuggggccagggcacccucgucaccgucuccucc

SEQ ID NO: 20295 - RNA, 375 nt, Artificial Sequence
  derived and/or modified sequence opt2 from anti-influenza_Chain
gagguccagcucguccaguccggcgccgaggucaagaagcccggcgagucccucaagaucuccugccaggccuccggcuacuccuucaccucccgcuggaucggcuggguccgccagaugcccggcaagggccucgagugggucggcuucaucuaccccuccgacuccgacguccgcuacucccccuccuuccgcggccaggucaccaucuccgccgacaaguccaucuccaccgccuaccuccagugguccucccucaaggccuccgacaccgccauguacuucugcgcccgccucggcggcaacaaggacuacggcgacuaccucugguacuucgaccucuggggccgcggcgcccucgucaccgucuccucc

SEQ ID NO: 20296 - RNA, 375 nt, Artificial Sequence
  derived and/or modified sequence opt2 from anti-influenza_Chain
cagguccagcucgucgaguccggcggcggcgucguccagcccggccgcucccuccgccucuccugcgccgccuccggcuucaccuucuccuccuacggcaugcacuggguccgccaggcccccggcaagggccucgagugggucgccgucaucugguacgacggcgacaacaaguacuacggcgacuccgucaagggccgcuucaccaucucccgcgacaacuccaagaacacccucuuccuccagaugaacucccuccgcgccgaggacaccgccgucuacuacugcgccaaggacaccgccgaccacggcgacuacgucgaccucggcuucuucgacgccuggggccagggcacccucgucaccgucuccucc

SEQ ID NO: 20297 - RNA, 375 nt, Artificial Sequence
  derived and/or modified sequence opt2 from anti-influenza_Chain
gagguccagcucguccaguccggcgccgagcucaagaugcccggcgagucccucaagaucuccugcaaggccuccggcuacaccuucaccaacuacuggaucggcuggguccgccagacccccggcaagggccucgaguggaugggcaucaucuucccccccgacucccagaccuccuacucccccuccuuccagggccaggucaccuucuccgucgacaacuccaucuccgucgccuacauccagugguccucccucaaggccuccgacaccgccaucuacuacugcgcccgcuccggcaucuucgacugguccgccccccucgucgaggccuucgacaucuggggccagggcaccgucgucaccgucuccucc

SEQ ID NO: 20298 - RNA, 375 nt, Artificial Sequence
  derived and/or modified sequence opt2 from anti-influenza_Chain
gagguccagcucguccaguccggcgccgaggucaagaagcccggcgagucccucaagaucuccugcaagggcuccggcuacuccuucuccgacuacuggaucggcuggguccgccagaugcccggcgagggccucgaguggaugggcaucaucuaccccgccuccuccgagauccgcuacucccccuccuuccagggccucgucaccaucuccgccgacaaguccaucaacaccgccucccuccagugguccucccucaaggccuccgacaccgccaucuacuacugcgcccgccacgccuccugcuccgcccgcuccugcuacuggggccccgucgacuacuggggccagggcacccucgucaccgucuccucc

SEQ ID NO: 20299 - RNA, 375 nt, Artificial Sequence
  derived and/or modified sequence opt2 from anti-influenza_Chain
cagguccagcucgucgaguccggcggcggcgucguccagcccggccgcucccuccgccucuccugcgccgccuccgagaucaccuucaucaccuacgccaugcacuggguccgccaggcccccggcaagggccucgagugggucgcccucaucuccgacgacggcuccaacaaguucuacgccgacuccgucaagggccgcuucaccaucucccgcgacaacuccaagaacacccucuaccuccagaugaacucccuccgcgccgaggacaccgccgccuacuacugcgcccgcgagggcgucuacuucgacuccggcaccuaccgcggcuacuucgacuacuggggccaggagacccucgucaccgucuccucc

SEQ ID NO: 20300 - RNA, 375 nt, Artificial Sequence
  derived and/or modified sequence opt2 from anti-influenza_Chain
cagguccagcuccaggaguccggccccggccucgucaagcccucccagacccucucccucaccugcaccgucuccggcggcuccaucuccuccggcaacuacuacuggaacuggguccgccagcaccccggcaagggccucgaguggaucggcuacaucuacuaccgcggcuccaccuucuacaaccccucccucaagucccgcgucaccaucuccaucgacaccuccaagaaccaguucucccuccgccucuccuccgucaccgccgccgacaccgccgucuacuacugcgccaaggacacccgcuccucccucgacaacuaccaguacggcauggacgucuggggccagggcaccaccgucaccgucuccucc

SEQ ID NO: 20301 - RNA, 375 nt, Artificial Sequence
  derived and/or modified sequence opt2 from anti-influenza_Chain
gagguccagcuccucgaguccggcggcggccucguccagcccggcggcucccuccgccucuccugcgccgccuccggcuucuccuucuccaccuacgccauguccuggguccgccaggcccccggcaagggccucgagugggucuccggcaucuccggcuccggcgaguccaccuacuacgccgacuccgucaagggccgcuucaccgucucccgcgacaacuccaagaacacccucuaccuccagaugaacucccuccgcgccgaggacaccgccgucuacuacugcgccaagcagggcgaccacaucgccuggcuccuccgcggcaucaacuucgacuacuggggccagggcguccucgucaccgucuccucc

SEQ ID NO: 20302 - RNA, 375 nt, Artificial Sequence
  derived and/or modified sequence opt2 from anti-influenza_Chain
cagguccagcucgucgaguccggcggcggcgucguccagcccggccgcucccuccgccucuccugcgccgccuccggcuucgccuuccacaaccgcgccaugcacuggguccgccaggcccccggcaagggccucgagugggucgcccucaucuacuucgacggcuccaagcaguacuacgccgacuccgucaagggccgcuucaccaucucccgcgacaacuccaagaacaccgucuuccuccagaugaacucccuccgccccgaggacaccgccgucuacuacugcgccguccccggccccaucuucggcaucuucccccccugguccuacuucgaccacuggggccagggcauccucgucaccgucuccucc

SEQ ID NO: 20303 - RNA, 375 nt, Artificial Sequence
  derived and/or modified sequence opt2 from anti-influenza_Chain
gagguccagcucgucgaguccggcggcggcgucguccagcccggccgcucccuccgccucuccugcgccgccuccggcuucgccuuccacaaccgcgccaugcacuggguccgccaggcccccggcaagggccucgagugggucgcccucaucuacuucgacggcuccaagcaguacuacgccgacuccgucaagggccgcuucaccaucucccgcgacaacuccaagaacaccgucuuccuccagaugaacucccuccgccccgaggacaccgccgucuacuacugcgccguccccggccccaucuucggcaucuucccccccugguccuacuucgaccacuggggccagggcauccucgucaccgucuccucc

SEQ ID NO: 20304 - RNA, 375 nt, Artificial Sequence
  derived and/or modified sequence opt2 from anti-influenza_Chain
gagguccagcucguccaguccggcggcggcgucguccagcccggcaagucccuccgccucuccugcgccgccuccggccucaccuucuccuccuacgccguccacuggguccgccaggcccccggcaagggccucgagugggucacccucaucuccuacgacggcgccaaccaguacuacgccgacuccgucaagggccgcuucaccaucucccgcgacaacuccaagaacaccgucuaccuccagaugaacucccuccgccccgaggacaccgccgucuacuacugcgccguccccggccccgucuucggcaucuucccccccugguccuacuucgacaacuggggccagggcauccucgucaccgucuccucc

SEQ ID NO: 20305 - RNA, 375 nt, Artificial Sequence
  derived and/or modified sequence opt2 from anti-influenza_Chain
cagguccagcucgucgaguccggcggcggcgucguccagcccggcaagucccuccgccucuccugcgccgccuccggccucaccuucuccuccuacgccguccacuggguccgccaggcccccggcaagggccucgagugggucacccucaucuccuacgacggcgccaaccaguacuacgccgacuccgucaagggccgcuucaccaucucccgcgacaacuccaagaacaccgucuaccuccagaugaacucccuccgccccgaggacaccgccgucuacuacugcgccguccccggccccgucuucggcaucuucccccccugguccuacuucgacaacuggggccagggcauccucgucaccgucuccucc

SEQ ID NO: 20306 - RNA, 375 nt, Artificial Sequence
  derived and/or modified sequence opt2 from anti-influenza_Chain
cagguccagcucgucgaguccggcggcggcgucguccagcccggcaaguccccccgccucuccugcgccgccuccggccccaccuucuccuccuacgccguccacuggguccgccaggcccccggcaagggccucgagugggucacccucaucuccuacgacggcgccaaccaguacuacgccgacuccgucaagggccgcuucaccaucucccgcgacaacuccaagaacaccgucuaccuccagaugaacucccuccgccccgaggacaccgccgucuacuacugcgccguccccggccccgucuucggcaucuucccccccugguccuacuucgacaacuggggccagggcauccucgucaccgucuccucc

SEQ ID NO: 20307 - RNA, 375 nt, Artificial Sequence
  derived and/or modified sequence opt2 from anti-influenza_Chain
gagguccagcucgucgaguccggcggcggcgucguccagcccggcaagucccuccgccucuccugcgccgccuccggccucaccuucuccuccuacgccguccacuggguccgccaggcccccggcaagggccucgagugggucacccucaucuccuacgacggcgccaaccaguacuacgccgacuccgucaagggccgcuucaccaucucccgcgacaacuccaagaacaccgucuaccuccagaugaacucccuccgccccgaggacaccgccgucuacuacugcgccguccccggccccgucuucggcaucuucccccccugguccuacuucgacaacuggggccagggcauccucgucaccgucuccucc

SEQ ID NO: 20308 - RNA, 375 nt, Artificial Sequence
  derived and/or modified sequence opt2 from anti-influenza_Chain
cagguccagcucguccaguccggcgccgagcucaagcgccccggcgccuccgucaaggucuccugcaagaccuccggcuacuccuucaacaacuacggcaucaacuggguccgccaggcccccggccagggccucgaguggaugggcuggaucuccgccuacaccggcaacacccacuacgccaagaacuucgagggccgcgucacccucaccaccgacaccuccaccuccaccgccuacauggagguccgcucccuccgcuccgacgacuccgccgucuacuucugcgcccgcgccaugauccagggcgucgucacccucuaccuccgccccggcgacuacuggggccagggcacccucgucaccgucuccucc

SEQ ID NO: 20309 - RNA, 375 nt, Artificial Sequence
  derived and/or modified sequence opt2 from anti-influenza_Chain
cagguccagcucguccaguccggcgccgaggucaagcagcccggcgccuccgucaaggucuccugcaaggccuccggcuacaccuucaacgccuacuacauccacuggguccgccaggcccccggccagggccucgaguggaugggcuggaucaaccccaacuucggcggcacccacuacgcccgcaaguuccagggccgcgucaccaugacccgcgacgccuccaucaacaccgccuacauggagcucgaccgccucaucuccgacgacaccgccgucuacuacugcguccgcuggcgcgccgccgccgucaucauggaccaguucuacaagauggacgucuggggccagggcacccucgucaccgucuccucc

SEQ ID NO: 20310 - RNA, 375 nt, Artificial Sequence
  derived and/or modified sequence opt2 from anti-influenza_Chain
cagguccagcucguccaguccggccccgagcucaagaagcccggcuccuccgucaagcucuccugcauggccaccggcggcaccuucaucaacuacgccuucuccuggguccgccaggcccccggccagggccucgaguggcucggcggcaucauccccgucuacggcaccuccaaccacgucgagaagcuccagggccgcgucaccaucaccgccgacgccuccaccaacaccgccuacauggagcucuccggccuccgcuucgacgacaccgccgucuacuucugcgccgccuccaccgccaccuccggcaccuacuacgccaugcgccccuucgacuucuggggccagggcacccucgucuccgucuccucc

SEQ ID NO: 20311 - RNA, 378 nt, Artificial Sequence
  derived and/or modified sequence opt2 from anti-influenza_Chain
gagguccagcucgucgaguccggcggcggcgucguccagcccggcggcucccuccgccucuccugcaucgccuccgccuucaaccucggcaucuucggcaugcacuggguccgccaggcccccggcaagggccucgagugggucgccuucauccgcuacgacggcggcaagaccuucuacgccgacuccgucaagggccgcuucaccaucucccgcgacaacuccaagaacacccucuaccuccagaugaacucccuccgcaccgaggacaccgcccucuacuacugcgcccgcgacgccaccgccgacuacuacggccccggcuccuaccccaacuggcucgaccccuggggccagggcacccucgucaccgucucc

SEQ ID NO: 20312 - RNA, 378 nt, Artificial Sequence
  derived and/or modified sequence opt2 from anti-influenza_Chain
gagguccagcucgucgaguccggccccgcccucgucaagcccacccagacccucacccucaccugcuccuucuccggcuucucccucuccaccuccggcauguccgucuccuggauccgccagccccccggcaaggcccucgaguggcucgcccucaucgacugggacgacgacaccuacuacaucaccuacuccuccucccucaagacccgccucaccaucuccaaggacaccuccaagucccaggucguccucaccaugaccaacauggaccccgucgacaccgccaccuacuacugcgcccgcacccuccgcgucuccggcgacuacguccgcgacuucgaccucuggggccgcggcacccucgucaccgucucc

SEQ ID NO: 20313 - RNA, 378 nt, Artificial Sequence
  derived and/or modified sequence opt2 from anti-influenza_Chain
cagguccagcuccaggaguccggccccggccucgucaagcccuccgagacccucucccucaccugcaccgucuccggcggcuccaucaacuccuacuacuggaacuggauccgccagccccccggcaagggccucgaguggaucggcuacaucuaccacuccggcuccaccaacuacaaccccucccucaagucccgcgucaccaucuccgucgacaccuccaagaaccaguucucccuccagcucuccuccgucaccgccgccgacaccgccgucuacuacugcgcccgccuccgcaccgacuacggcgaccccgacuccgucuacuacuacggcauggacgucuggggccagggcaccaccgucaccgucuccucc

SEQ ID NO: 20314 - RNA, 378 nt, Artificial Sequence
  derived and/or modified sequence opt2 from anti-influenza_Chain
cagguccaccucguccaguccggcgccgagguccgcaagcccggcgacuccgucaaggucuccugcaagaccuccggcuacaccuucuccaccuaccccgucgccuggguccgccagguccccggccagggccucgaguggaugggcuggaucuccaccuacaacggcaacaccaacuucgcccagaacuuccagggccgcgucacccucaccaccgacaccaccaccaacaccgccuacauggagguccgcucccucaaguucgacgacaccgccgucuacuacugcgcccgcgucgagggcuccuaccgcgacuucuggaacaaccagaaccgcuucgaccccuggggccagggcacccucgucaccgucuccucc

SEQ ID NO: 20315 - RNA, 378 nt, Artificial Sequence
  derived and/or modified sequence opt2 from anti-influenza_Chain
gagguccagcucgucgaguccggcgccgaggucaagaagcccggcgccuccgucaaggucuccugcaaggccuccggcuacaccuucaccuccuucgacaucaacuggguccgccaggcccccggccagggccucgaguggaugggcuggaugacccccaccuccggcaagaccggcuacgcccagaaguuccagggccgcaucaccaugacccgcaacaccuccaucaacaccgccuacauggagcucuccucccuccgcuccgaggacaccgccgucuacuucugcgcccgcggccccgagcgccgcaccaccaucuucgacgucauccucgacugguucgaccccuggggccagggcacccucgucaccgucucc

SEQ ID NO: 20316 - RNA, 378 nt, Artificial Sequence
  derived and/or modified sequence opt2 from anti-influenza_Chain
cagguccagcucguccaguccggcgccgaggucaagaagcccggcuccuccgucaaggucuccugcaaggccuccggcggcuucuucuccuccuacgccaucuccuggguccgccaggcccccggccagggccucgaguggaugggcggcgucauccccaucuuccgcaccgccaacuacgcccagaacuuccagggccgcgucaccaucaccgccgacgaguucaccuccuacauggagcucuccucccuccgcuccgacgacaccgccgucuacuacugcgcccgccucaacuaccacgacuccggcaccuacuacaacgccccccgcggcugguucgaccccuggggccagggcacccucgucaccgucuccucc

SEQ ID NO: 20317 - RNA, 378 nt, Artificial Sequence
  derived and/or modified sequence opt2 from anti-influenza_Chain
cagguccagcucguccaguccggcgccgaggucaagaagcccggcuccuccgucaaggucuccugcaaggccuccggcggcgccuucuccaacuacgccaucuccuggguccgccaggcccccggccagggccucgaguggaugggcggcaucauccccaucuucggcaccaccaacuacgcccagaaguuccagggccgcgucaccaucaccgccgacaaguucaccaccaucgccuacauggagcuccgcucccuccgcuccgaggacaccgccgucuacuacugcgcccgccacggcggcgucuacuacuacggcuccgccuccuccggcugguucgaccccuggggccagggcacccucgucaccgucuccucc

SEQ ID NO: 20318 - RNA, 378 nt, Artificial Sequence
  derived and/or modified sequence opt2 from anti-influenza_Chain
cagguccagcuccucgaguccggcggcggcgucguccgccccggccgcucccuccgccucgccugcgccggcuccggcuucaccuucuccgccuacgccaugcacuggguccgccaggcccccggcaagggccucgagugggucgcccacaccuccuacgacggccgcgacuccuacuacgucgacuccgucaagggccgcuucaccaucucccgcgacgacuccaagaacacccucuaccuccagaugaacucccuccgccccgaggacaccgccgucuacuacugcgccaaggucggccccuacaccggcuacgacgacuacaacuacuacggcauggacgucuggggccacggcaccaccgucaccgucuccucc

SEQ ID NO: 20319 - RNA, 378 nt, Artificial Sequence
  derived and/or modified sequence opt2 from anti-influenza_Chain
cagguccagcucgucgaguccggcggcggcgucguccagcccggcggcucccuccgccucuccugcgccgccuccggcuucaacuucgacgaguacgucauguacuggguccgccagucccccggcaagggccucgagugggucucccucaucggcgccgacggccgcggcaccuacaacuccgacuccgucaagggccgcuucaccaucucccgcgacaaccgcaagaacucccucuaccuccagaugaacucccuccgcuccgacgacaccgcccucuacuacugcgccaaggucgagcgcuccuucuacgacggcuccggcuacggcgacgcccucgagaucuggggccagggcaccauggucaccgucuccucc

SEQ ID NO: 20320 - RNA, 381 nt, Artificial Sequence
  derived and/or modified sequence opt2 from anti-influenza_Chain
gagguccagcuccucgaguccggcggcggccucguccaccccggcggcucccuccgccucuccugcgccgccuccggcuucaccuucuccaacuacgccauguccuggguccgccaggcccccggcaagggccucgagugggucuccuccaucaacuccggcggcggcgccaccuacuacgccgacuccgucaagggccgcuucaccaucucccgcgacaacuccaagaacacccucucccuccagaugaacucccuccgcgccgaggacaccgccgucuacuacugcgccaaggagggcggcaacaccaucuucggccucgucaccauggccuacuacuucgacuccuggggccagggcacccucgucaccgucuccucc

SEQ ID NO: 20321 - RNA, 381 nt, Artificial Sequence
  derived and/or modified sequence opt2 from anti-influenza_Chain
cagccccagcuccaggaguccggccccggccucguccgccccuccgagacccucucccucaccugcaccgucuccggcgacuccgucacccgcggcggcuucuacuggggcuggauccgccagccccccggcaagggccucgaguggaucggcuccaucuacuacaacuacaacaucuaccacucccccucccucaagucccgcgucucccucuccgucgacaccuccaagaaccaggucucccucaagcucgccuccgucaccgccgccgacaccgccgucuacuacugcgcccgccacuaccccuacuacgaccuccccaccggcuucuacucccaguucgacuucuggggccagggcacccccgucaccgucuccucc

SEQ ID NO: 20322 - RNA, 381 nt, Artificial Sequence
  derived and/or modified sequence opt2 from anti-influenza_Chain
ugguggcagcucguccaguccggcgccgaggucaagaagcccggcuccuccgucaaggucuccugcaaggccuccggcggcaccuucuccuccuacgacaucuccuggguccgccaggcccccggccagggccucgaguggaugggcggcaucauccccaucuacggcaccgccaacuacgcccagaaguuccagggccgcgucaccaucaccgccgacgaguccaccuccaccgccuacauggagcucuccucccuccgcuccgaggacaccgccgucuacuacugcgcccgcgccggcggcgacuccuccggcuacuacggcgcccucggccgcuucuuccagcacuggggccagggcacccucgucaccgucuccucc

SEQ ID NO: 20323 - RNA, 381 nt, Artificial Sequence
  derived and/or modified sequence opt2 from anti-influenza_Chain
gagguccagcucguccaguccggcggcgccgucguccagcccggccgcucccuccgccucuccugcgccgccuccggcuucaccuucuccaucuacgccaugcacuggguccgccagacccccggcaagggccucgagugggucgcccucaucuccuacgacggcaacaacaaguacuacgccgacuccgucaagggccgcuucaccaucucccgcgacaacuacaagaacacccucuaccuccagaugaagggccuccgcgccgaggacaccgcccucuacuacugcgcccgccgcaucaccgagaagggcuacuacaacgacuccggccgccccaacugguucgaccccuggggccagggcacccucgucaccgucucc

SEQ ID NO: 20324 - RNA, 381 nt, Artificial Sequence
  derived and/or modified sequence opt2 from anti-influenza_Chain
cagguccagcuccagcaguccggcccccgccucgucaagcccucccagacccucucccucaccugcgccaucuccggcgacuccgucuccggcgacuccggcaccuggaacuggauccgccagucccccucccgcggccucgaguggcucggccgcaccuacuaccgcuccaagugguacaacgacuacgccgaguccgucaagucccgcaucgucaucaaggccgacaccuccaagaacgaguucucccuccagcucaacuccgucacccccgaggacaccgccaucuacuacugcgcccgcgccggcgucaagaucuucggccucaucgucggcgcccucgacaacuggggccgcggcacccucgucaccgucuccucc

SEQ ID NO: 20325 - RNA, 381 nt, Artificial Sequence
  derived and/or modified sequence opt2 from anti-influenza_Chain
cagguccagcuccagcaguggggcgccggccuccucaagcccuccgagacccucucccucaccugcaccgucuccggcggcucccucaccgacuacuccuggaacuggauccgccagccccccggcaagggccucgaguggaucggcgacacccuccacaacggcuacaccaacuacaaccccucccuccgcggccgcgucuccaucuccaucgacaccuccaagaaccaggucucccuccgccucaccuccgucaccgccgccgacaccgcccucuacuacugcgcccgcggcuccggcggcuacggcggcuucgacuacuucggcaagcuccgcaccugggacuucuggggccagggcacccucgucaccgucuccucc

SEQ ID NO: 20326 - RNA, 381 nt, Artificial Sequence
  derived and/or modified sequence opt2 from anti-influenza_Chain
cagguccagcucguccaguccggcgccgagguccgcaagcccggcgagucccuccgcaucuccugccgcggcuccggcuacaacuuccccaaguacuggaucggcuggguccgccagaugcccggcaagggccucgaguggaugggcaugaucuaccccggcgacuccgacguccgcuacaaccccuccuuccagggccaggucaccaucuccgccgacgaguccaucaacaccgccuaccuccagugguccucccuccgcaccuccgacaccgcccgcuacuacugcgcccgccaccucggccagcagcucgucuccaacaccuacuacuacuacggcauggacgucuggggccagggcaccaccgucaccgucuccucc

SEQ ID NO: 20327 - RNA, 384 nt, Artificial Sequence
  derived and/or modified sequence opt2 from anti-influenza_Chain
cagauccagcuccaggaguccggccccggccucgucaagcccucccagacccucucccucaccugcgccaucuccggcgacuccgucuccuccaacaacgccgucuggaacuggauccgccagucccccucccgcggccucgaguggcucggccgcaccuacuaccgcuccaagugguacaacgacuacgccgaguccgucaagucccgcaucaccgucaaccccgacaccuccaagaaccaguucucccuccaccucaaguccgucacccccgaggacaccgccgucuucuacugcguccgcuccggccacaucaccgucuucggcgucaacgucgacgccuucgacauguggggccagggcaccauggucaccgucuccucc

SEQ ID NO: 20328 - RNA, 384 nt, Artificial Sequence
  derived and/or modified sequence opt2 from anti-influenza_Chain
cagguccagcuccaggaguccggccccggccucgucaagcccucccagacccucucccucaccugcgccaucuccggcgacuccgucuccuccaacaacgccgucuggaacuggauccgccagucccccucccgcggccucgaguggcucggccgcaccuacuaccgcuccaagugguacaacgacuacgccgaguccgucaagucccgcaucaccgucaaccccgacaccuccaagaaccaguucucccuccaccucaaguccgucacccccgaggacaccgccgucuucuacugcguccgcuccggccacaucaccgucuucggcgucaacgucgacgccuucgacauguggggccagggcaccauggucaccgucuccucc

SEQ ID NO: 20329 - RNA, 384 nt, Artificial Sequence
  derived and/or modified sequence opt2 from anti-influenza_Chain
cagguccagcuccagcaguccggccccggccucgucaagcccucccagacccucucccucaccugcgccaucuccggcgaccgcgucuccuccaacuccgccgucuggaacuggauccgccagucccccucccgcggccucgaguggcucggccgcaccuacuaccgcuccaagugguacuacgacuacgccgaguccgucaagucccgcaucgucaucgaccccgacaccuccaagaaccaggucucccuccagcucaacuccgucacccccgaggacuccgccaucuacuacugcgcccgcggcggccacaucaccgucuucggccucaacaucgacgccuacgacaucuggggccagggcgccaaggucaccgucuccucc

SEQ ID NO: 20330 - RNA, 384 nt, Artificial Sequence
  derived and/or modified sequence opt2 from anti-influenza_Chain
cagguccagcuccagcaguccggccccggccucgucaagcccucccagacccucucccucaccugcgccaucuccggcgaccgcgucuccuccaacuccgccgucuggaacuggauccgccagucccccucccgcggccucgaguggcucggccgcaccuacuaccgcuccaagugguacuacgacuacgccgaguccgucaagucccgcaucgucaucgaccccgacaccuccaagaaccaggucucccuccagcucaacuccgucacccccgaggacuccgccaucuacuacugcgcccgcggcggccacaucaccgucuucggccucaacaucgacgccuacgacaucuggggccagggcgccauggucaccgucuccucc

SEQ ID NO: 20331 - RNA, 384 nt, Artificial Sequence
  derived and/or modified sequence opt2 from anti-influenza_Chain
cagguccagcuccagcaguccggccccggccucgucaagcccucccagacccucucccucaccugcgccaucuccggcgaccgcgucuccuccaacuccgccgucuggaacuggauccgccagucccccucccgcggccucgaguggcucggccgcaccuacuaccgcuccaagugguacuacgacuacgccgaguccgucaagucccgcaucgucaucgaccccgacaccuccaagaaccaggucucccuccagcucaacuccgucacccccgaggacuccgccaucuacuacugcgcccgcggcggccacaucaccgaguucggccucaacaucgacgccuacgacaucuggggccagggcgccauggucaccgucuccucc

SEQ ID NO: 20332 - RNA, 384 nt, Artificial Sequence
  derived and/or modified sequence opt2 from anti-influenza_Chain
cagguccagcuccagcaguccggccccggccucgucaagcccucccagacccucucccucaccugcgucaucuccggcgacaccgucuccuccaaccgcgccaccuggaacuggaugcgccaguccccccuccgcggccucgaguggcucggccgcaccuacuaccgcuccaagugguacaacgacuacgccgucuccgucaagucccgcgucgucaucaaccccgacaccuccaagaaccaggucucccuccagcucaacaccgucacccccgacgacuccggcgucuacuucugcgcccgcggcggccacaucaccgucuucggcgucaacaucgacgccuucgacaucuggggccucggcaccaaggucaccgucuccucc

SEQ ID NO: 20333 - RNA, 384 nt, Artificial Sequence
  derived and/or modified sequence opt2 from anti-influenza_Chain
caggucgagcuccagcaguccggccccggccucgucaagcccucccagacccucucccucaccugcgccaucuccggcgacuccgucuccuccaacuccgccaccuggaacuggauccgccagucccccucccgcggccucgaguggcucggccgcaccuacuaccgcuccaagugguacaacgacuacgccgacuuccucaagcgccgcaucaccaucaaccccgacaccuccaacaacgaggucucccuccgccucaccuccgucacccccgacgacaccgcccucuacuacugcgcccgcggcggccacaucaccgucuucggcgucaacaucgacgccuucgacgucuggggccagggcaccauggccaccgucuccucc

SEQ ID NO: 20334 - RNA, 384 nt, Artificial Sequence
  derived and/or modified sequence opt2 from anti-influenza_Chain
cagguccagcuccagcaguccggccccggccucgucaagcccucccagacccucucccucaccugcgccaucuccggcgacuccgucuccuccaacuccgccaccuggaacuggauccgccagucccccucccgcggccucgaguggcucggccgcaccuacuaccgcuccaagugguacaacgacuacgccgacuuccucaagcgccgcaucaccaucaaccccgacaccuccaacaacgaggucucccuccgccucaccuccgucacccccgacgacaccgcccucuacuacugcgcccgcggcggccacaucaccgucuucggcgucaacaucgacgccuucgacgucuggggccagggcaccauggucaccgucuccucc

SEQ ID NO: 20335 - RNA, 384 nt, Artificial Sequence
  derived and/or modified sequence opt2 from anti-influenza_Chain
cagguccagcuccagcaguccggccccggccucgucaagcccucccagacccucucccucaccugcgccaucuccggcgacuccgucuccuccuacaacgccgucuggaacuggauccgccagucccccucccgcggccucgaguggcucggccgcaccuacuaccgcuccggcugguacaacgacuacgccgaguccgucaagucccgcaucaccaucaaccccgacaccuccaagaaccaguucucccuccagcucaacuccgucacccccgaggacaccgccgucuacuacugcgcccgcuccggccacaucaccgucuucggcgucaacgucgacgccuucgacauguggggccagggcaccauggucaccgucuccucc

SEQ ID NO: 20336 - RNA, 384 nt, Artificial Sequence
  derived and/or modified sequence opt2 from anti-influenza_Chain
cagguccagcuccagcaguccggccccggccucgucaagcccucccagacccucucccucaccugcgccaucuccggcgacuccgucuccuccaacaacgccgucuggaacuggauccgccagucccccucccgcggccucgaguggcucggccgcaccuacuaccgcuccaagugguacaacgacuacgccgaguccgucaagucccgcaucaccaucaaccccgacaccuccaagaaccaguucucccuccagcucaacuccgucacccccgaggacaccgccgucuacuacugcgcccgcuccggccacaucaccgucuucggcgucaacgucgacgccuucgacauguggggccagggcaccaccgucaccgucuccucc

SEQ ID NO: 20337 - RNA, 384 nt, Artificial Sequence
  derived and/or modified sequence opt2 from anti-influenza_Chain
cgcggccagcucguccaguccggcggcggcgucguccagcccggccgcucccuccgccucuccugcgccgccuccggcuucgucuucaacgucuucggcauccacuggguccgccaggcccccggcaagggccucgaguggcucgccaccaucuccuacgacggccucaacaaguacuacgccgacuccgucaagggccgcaucaccaucucccgcgacaacuccaagaacacccucuaccuccagaugaacucccuccgcgccgaggacaccgccgucuacuacugcguccgcgacuccgaggaguccaccuacuacggcgacuacaugugggucuacaacugguucgaccucuggggccagggcacccucgucaccgucucc

SEQ ID NO: 20338 - RNA, 384 nt, Artificial Sequence
  derived and/or modified sequence opt2 from anti-influenza_Chain
cagguccagcuccagcaguggggcuccggccuccucaagcccuccgagacccucucccucaccugcgccgucuacggcggcuccuuccgcgacgacuacuggaccuggauccgccagccccccggcaagggccucgaguggaucggcgagaucaaccacuccggccgcaccaacuacaaccccucccucaagucccgcgucaccaucuccgucgacaccucccucaagcaguucucccucaaggucaucuccgucaccgccgccgacaccgccgucuacuacugcgcccgcggcaccucccacgucucccgcuacuucgacuggcucccccccaccaacugguucgaccccuggggccagggcacccaggucaccgucuccucc

SEQ ID NO: 20339 - RNA, 384 nt, Artificial Sequence
  derived and/or modified sequence opt2 from anti-influenza_Chain
cagguccagcuccagcaguggggcgccggccuccucaagcccuccgagacccucucccucuccugcgccgucuucggcggcuccuucuccgacuacuacuggaccuggauccgccagccccccggcaagggccucgaguggaucggcgagaucaagcacuccggccgcaccaacuacaaccccucccucgagucccgcgucaccaucuccgucgacaccuccaagaaccaguucucccucaagcucuccuccgucaccgccgccgacaccgccaucuacuacugcgcccgcggcaccgaccccgacaccgagggcuacugccgcuccggcuccugcuccgccuucgacuucuggggccagggcacccucgucaccgucuccucc

SEQ ID NO: 20340 - RNA, 384 nt, Artificial Sequence
  derived and/or modified sequence opt2 from anti-influenza_Chain
cagguccagcuccagcaguggggcgccggccuccucaagcccuccgagacccucucccucaccugcggcgucuacggcggcucccucuccgacuacuacugguccuggauccgccagccccccggcaagggccucgaguggaucggcgagaucaaccacuccggcggcaccaacuacaaccccucccucaagcgccgcgucaccaucuccgucgacaccuccaagaagcaguucucccucaagaugaacuccgucaccgccgccgacaccgccgucuacuacugcgcccgcggcaccgaccccgacaccgaggucuacugccgcgccggcaacugcgccgccuucgacuucuggggccagggcacccucgucaccgucuccucc

SEQ ID NO: 20341 - RNA, 384 nt, Artificial Sequence
  derived and/or modified sequence opt2 from anti-influenza_Chain
cagguccagcuccaggaguccggccccggccucgucaagcccucccagacccucucccucaccugcaccgucuccggcgacuccaucuccuccgucgaccacuacugguccuggauccgccagcaccccgucaagggccucgaguggaucggcuucauguacuacuccgccuccaccuacuacaaccccucccucaagucccgcgucaccaucuccaccgacaccuccaagaaccaguucucccuccgccucuccuccgucaccgccgccgacaccgccgucuacuacugcgcccgcggcaccugcgccggcgacugcucccuccacuacuacuacuacggccucgacgucuggggccagggccgcaccgucaccgucuccucc

SEQ ID NO: 20342 - RNA, 384 nt, Artificial Sequence
  derived and/or modified sequence opt2 from anti-influenza_Chain
gaggucgcccucgucgaguccggcgccgaggucaagaagcccggcuccuccgucaaggucuccugcaaggccuccggccacaucuucuccggcuacgccaucuccuggguccgccaggcccccggccagggccucgaguggaugggcggcaucauccccaucuucggcaccaccaacuacgcccagaaguuccagggccgcgucaccaucaccgccgaccaguccaccuccaccgccuacauggaccucuccaaccuccgcuccgaggacaccgccgucuacuacugcgcccgcgucaaggacggcuacugcacccucaccuccugccccgucggcugguacuucgaccucuggggccgcggcacccucgucaccgucuccucc

SEQ ID NO: 20343 - RNA, 384 nt, Artificial Sequence
  derived and/or modified sequence opt2 from anti-influenza_Chain
gagguccagcucgucgaguccggcgccgaggucaagaagcccggcuccuccgucaaggucuccugcaaggccuccggccacaucuucuccggcuacgccaucuccuggguccgccaggcccccggccagggccucgaguggaugggcggcaucauccccaucuucggcaccaccaacuacgcccagaaguuccagggccgcgucaccaucaccgccgaccaguccaccuccaccgccuacauggaccucuccaaccuccgcuccgaggacaccgccgucuacuacugcgcccgcgucaaggacggcuacugcacccucaccuccugccccgucggcugguacuucgaccucuggggccgcggcacccucgucaccgucuccucc

SEQ ID NO: 20344 - RNA, 384 nt, Artificial Sequence
  derived and/or modified sequence opt2 from anti-influenza_Chain
cagguccagcucguccaguccggcgccgagguccgcaagcccggcgccuccgucaaggucuccugcaaggccuccggcuacaccuucacccgccacggcaucuccuggguccgccaggcccccggccagggccucgaguggaugggcuggaucuccgccuacaccggcgacaccgacuacgcccagaaguuccagggccgcgucaccaugaccaccgacaccuccaccaacaccgccuacauggagcuccgcucccuccgcuccgacgacgccgccgucuacuacugcgcccgccuccgccuccagggcgaggucgucgucccccccucccaguccaacugguucgaccccuggggccagggcacccucgucaccgucuccucc

SEQ ID NO: 20345 - RNA, 384 nt, Artificial Sequence
  derived and/or modified sequence opt2 from anti-influenza_Chain
cagguccagcucgucgaguccggccccggccucaugaagcccuccgagacccucucccucaccugcaccgucuccggcggcuccgucuccaacuacuacugguccuggauccgccagccccccggcaagggccucgaguggaucggcuacgucuucuacuccggcuccuccaacuacaaccccucccucaacaaccccucccucaagucccgcgucaccaucuccaucgacaccuccaacaaccaguucucccucaagcucuccuccgucaccgccgccgacaccgccgucuacuacugcgcccgcggccgcgucaacuccggcuacgacuggggccccaacuucgacuccuggggccagggcgcccucgucaccgucuccucc

SEQ ID NO: 20346 - RNA, 384 nt, Artificial Sequence
  derived and/or modified sequence opt2 from anti-influenza_Chain
cagguccagcucguccaguccggcgccgaggucaagaagcccggcuccuccgucaaggucuccugcaaggccuccggcggcaccuucuccuacuacgccaucuccuggguccgccaggcccccggccagggccucgaguggaugggcggcaucauccccaucgucggcaccgcccacuacacccagaaguuccagggccgcgucaccaucaccgccgacgaguccaccuccaccgccuacauggagcucuccucccuccgcuccgaggacaccgccgucuacuucugcgcccgcgccgccgacgaguccgucgagucccucaccaucaaggccuuccgcaccaacuaccacuggggccagggcacccucgucaccgucuccucc

SEQ ID NO: 20347 - RNA, 387 nt, Artificial Sequence
  derived and/or modified sequence opt2 from anti-influenza_Chain
gagguccagcucgucgaguccggcggcggcgccguccagcccggcgagucccucaagcuccccugcgccgccuccggcuucaccuucuccaacuacggcaugcacuggguccgccaggcccccggcaagggccucgagugggucgccgucaucuccuacgacggcuccaacaaguacuacgccgacuccgucaagggccgcuucaccaucucccgcgacaacuccaaggacacccucuaccuccagaugaacucccuccgcgccgaggacaccgcccucuucuacugcgccaaggagcgcccccuccgccuccuccgcuacuucgacuggcucuccggcggcgccaacgacuacuggggccagggcacccucgucaccgucuccucc

SEQ ID NO: 20348 - RNA, 387 nt, Artificial Sequence
  derived and/or modified sequence opt2 from anti-influenza_Chain
gagguccagcucgucgaguccggcggcggcgccguccagcccggcgagucccucaagcucuccugcgccgccuccggcuucaccuucuccaacuacggcaugcacuggguccgccaggcccccggcaagggccucgagugggucgccgucaucuccuacgacggcuccaacaaguacuacgccgacuccgucaagggccgcuucaccaucucccgcgacaacuccaaggacacccucuaccuccagaugaacucccuccgcgccgaggacaccgcccucuucuacugcgccaaggagcgcccccuccgccuccuccgcuacuucgacuggcucuccggcggcgccaacgacuacuggggccagggcacccucgucaccgucuccucc

SEQ ID NO: 20349 - RNA, 387 nt, Artificial Sequence
  derived and/or modified sequence opt2 from anti-influenza_Chain
cagguccagcucgucgaguccggcggcggcgucguccagcccggccgcucccuccgccucuccugcgccgucuccggcuucaccuucuccuccuacgccaugcacuggguccgccaggcccccggcaagggccucgagugggucgccgucaucuccuacgacggcuccaaccaguacuacgccgacuccgucaagggccgcuucaccaucucccgcgacaacuccaagaacacccucuaccuccagaugaacucccuccgcgccgaggacaccgcccucuacuacugcgccaaggacccccgccuccgccaccuccucuacuuccccuucaccuccaugaucuacuucgacuacuggggccagggcacccucgucaccgucuccucc

SEQ ID NO: 20350 - RNA, 387 nt, Artificial Sequence
  derived and/or modified sequence opt2 from anti-influenza_Chain
cagguccagcucguccaguccggcggcggcgucguccagcccggccgcucccuccgccucuccugcgucgccuccggcuucaccuucuccaccuacgccaugcacuggguccgccaggcccccggccgcggccucgagugggucgccgucaucuccuacgacgccaacuacaaguacuacgccgacuccgucaagggccgcuucuccaucucccgcgacaacucccagaacacccuccaccucgagaugaacacccuccgcaccgaggacaccgcccucuacuacugcgccaaggacucccagcuccgcucccuccucuacuucgaguggcucucccagggcuacuucgagcccuggggccagggcacccucgucaccgucaccucc

SEQ ID NO: 20351 - RNA, 387 nt, Artificial Sequence
  derived and/or modified sequence opt2 from anti-influenza_Chain
cagguccagcucguccaguccggcggcggcgucguccagcccggccgcucccuccgccucuccugcgucgccuccggcuucaccuucuccaccuacgccaugcacuggguccgccaggcccccggccgcggccucgagugggucgccgucaucuccuacgacggcaacuacaaguacuacgccgacuccgucaagggccgcuucuccaucucccgcgacaacuccaacuccacccuccaccucgagaugaacacccuccgcaccgaggacaccgcccucuacuacugcgccaaggacucccagcuccgcucccuccucuacuucgaguggcucucccagggcuacuucgaccccuggggccagggcacccucgucaccgucaccucc

SEQ ID NO: 20352 - RNA, 387 nt, Artificial Sequence
  derived and/or modified sequence opt2 from anti-influenza_Chain
cagguccagcucguccaguccggcgccgaggucaagaagcccggcuccuccgucaccgucuccugcaaggccuccggcggcaccuucuccaacuacggcaucuccuggguccgccaggcccccggccagggccucgacuggaugggcggcaucaucccccucuucggcaccgccaacuacgcccagaaguuccagggccgcgucaccaucaccgccgacgaguccaccuccuccuccaacauggagcucuccucccuccgcuccgaggacaccgccgucuacuacugcgcccgcgacguccacaacuacgacuuccucaccggcuacccccuccaccucuacggcauggacgucuggggccagggcaccaccgucaccgucuccucc

SEQ ID NO: 20353 - RNA, 387 nt, Artificial Sequence
  derived and/or modified sequence opt2 from anti-influenza_Chain
cagguccagcuccaggaguccggccccggccucgucaagcccuccgagacccucucccucaucugcgccgucuccggcgccuccaucuccuccuccuacugguccuggauccgccagccccccggcaagggccucgaguggaucggcuacaucuacuacuccggcgucaccaaguacaaccccucccucaagucccgcgucacccucuccgucgacaccuccaagaaccacuucucccucaagcucuccuacgucaccgccgccgacaccgccgucuacuacugcgcccgcaaccuccccgacaucgccgucgucaccgccguccaggacgccacccccgucugguucgaccccuggggccccggcacccucgucuccgucuccucc

SEQ ID NO: 20354 - RNA, 387 nt, Artificial Sequence
  derived and/or modified sequence opt2 from anti-influenza_Chain
gagguccagcucgucgaguccggcggcggccucguccagcccggccgcucccuccgccucuccugcgccgccuccggcuucaccuucuccgacuucuggauguccuggguccgccaggcccccggcaagggccucgagugggucgccaacaucgaccaggacggcaacgagcgcuucuacgccgacuccgucaagggccgcuucaccaucucccgcgacaacgccaagaacucccucuaccuccagaugaccucccuccgcgccgacgacaccgccgucuacuacugcgcccgcgacggccgcgagggcuacuucuacggcuccggcuccuucuacaaccucaagggccucaacuggggccagggcacccuccucaccgucuccucc

SEQ ID NO: 20355 - RNA, 387 nt, Artificial Sequence
  derived and/or modified sequence opt2 from anti-influenza_Chain
gagguccucauggucgaguccggcggcggccucguccagcccggcggcuccguccgccucuccugcgucgccuccggcuucuccuucuccucccacuggaugaccuggguccgccaggcccccggcaagggccucgagugggucgccaacaucgaggacgacggcggcgacaaguacuacgucgacuccgucaagggccgcuucaucaucucccgcgacaacgccaagaacuccgucuaccuccagaugaacucccuccgcgccgaggacaccgccgucuacuucugcgcccgcggcuccggcuccuccgaccgcuccgacuacgacccccacuacuacuacuaccucgacgucuggggcaagggcgccaccgucaccgucuccucc

SEQ ID NO: 20356 - RNA, 387 nt, Artificial Sequence
  derived and/or modified sequence opt2 from anti-influenza_Chain
gagguccagcucgucgaguccggcggcgaccucguccagcccggccgcucccucaagcucuccugcaccggcuccggcuucaccuucggcgacuacggcgucaccuggguccgccaggcccccggcaagggccucgagugggucggcuucauccgcacccgccccuggggcggcaccgccgacaccgccgccuccgucaagggccgcuucaccaucucccgcgacgacuccaagucccucgccuaccuccagaugaacucccucaagaccgaggacaccgccgucuacuacugcugccgcgacgccccccccaacgucgaggucgccuccaugaccaacugguacuucgaccucuggggccgcggcacccucgucaccgucuccucc

SEQ ID NO: 20357 - RNA, 387 nt, Artificial Sequence
  derived and/or modified sequence opt2 from anti-influenza_Chain
gagguccagcucguccaguccggcuccgaggucaagaagcccggcgagucccucaagaucuccugcaagggcuccggcuacuccuucuccaacuacuggaucggcuggguccgccacaugcccggcaagggccucgaguggaugggcaucaucuaccccggcgacuccgacacccgcuacucccccuccuuccagggccaggucaccauguccgccgacaaguccuccuccaccgucuaccuccagugguccucccucaaggccuccgacaccgccaucuacuacugcgcccgccgcggcggccacuccuucggcuacggcuccggcggcgacacccacuccgaguucgacuccuggggccagggcacccucgucaccgucuccucc

SEQ ID NO: 20358 - RNA, 387 nt, Artificial Sequence
  derived and/or modified sequence opt2 from anti-influenza_Chain
cagguccagcuccucgagaccggcggcggccucgucaagcccggccagucccucaagcucuccugcgccgccuccggcuucaccuucaccuccuacgccaugcacuggguccgccagccccccggcaagggccucgagugggucgccgucgucuccuacgacggcaacuacaaguacuacgccgacuccguccagggccgcuucaccaucucccgcgacaacuccaagaacacccucuaccuccagaugaacucccuccgcgccgaggacaccgccgucuacuacugcgccaaggacucccgccuccgcucccuccucuacuucgaguggcucucccagggcuacuucaaccccuggggccagggcaccacccucaccgucuccucc

SEQ ID NO: 20359 - RNA, 387 nt, Artificial Sequence
  derived and/or modified sequence opt2 from anti-influenza_Chain
cagguccagcucgucgaguccggcgccgaggucaagaagcccggcgccuccgucaagcucuccugcaccgccuccggcuacaacuucgccgccuacuacauccacuggguccgccaggcccccggccagggccucgaguggaugggcugguccaaccccaacaccggcggcgccaacuacgcccaggacuuccagggccgcgucaccaugaccgccgucaccuccaccuccaccgccuacauggagcucucccgccucaccuccgacgacaccgcccucuacuucugcgcccgcgucccccgcgaccgccuccucacccucuacuacgaguccuccaccuacggcuucgacuacuggggccagggcacccucgucaccgucuccucc

SEQ ID NO: 20360 - RNA, 387 nt, Artificial Sequence
  derived and/or modified sequence opt2 from anti-influenza_Chain
cagguccagcucgucgaguccggcggcggccucguccagcccggcggcucccuccgccucuccugcaccgucuccggcuucaccuucaacuccuacgccaugaacuggguccgccaggcccccggcaagggccucgagugggucuccggcauccgcggcuccggcgagaacaccuacuacgccgagaccgucaagggccgcuucaccaucucccgcgacaacuccaagaacacccucuaccucgagaugaacucccuccgcgccgaggacaccgccgucuacuacugcgcccgcaaguggggccgcaugaccgucuucggcgucgccaccgaccagcucuacuacuucgacuacuggggccagggcacccucgucaccgucuccucc

SEQ ID NO: 20361 - RNA, 387 nt, Artificial Sequence
  derived and/or modified sequence opt2 from anti-influenza_Chain
cagguccagcucgucgaguccggccccggccucgucaagcccucccagacccucucccucaccugcaccgucuccggcggcuccaucuccaacggcggcuaccacugguccuggauccgccagcaccccggcaagggccucgaguggaucggcaacaucuacuaccgcggcuccaccuucuacgaccccucccucaagucccgcgucaccaucuccgucgacaccuccaagucccaguucucccucaagcucaccuccgucaccgccgccgacaccgccgucuacuacugcgcccgcaugccccucgccaacuacgaccuccucaccggccucuacaucggcgccuucgaccucuggggccagggcaccauggucaccgucuccucc

SEQ ID NO: 20362 - RNA, 387 nt, Artificial Sequence
  derived and/or modified sequence opt2 from anti-influenza_Chain
cagguccagcucgucgaguccggcgccgaggucaagaagcccggcgccuccguccgcgucuccugcaagggcuccggcuacaccuucaccgccuaccacaugcacuggguccgccaggcccccggccagggcuucgagugggucggcuggaucaaccccaacuccggcgccaccuacuacaccuccaccuucgagggccgcgucaccaugacccgcgacaccuccaucaccaccgccuacauggagcucuccucccuccgcuccgacgacaccgccgucuacuacugcgccaccgacaucgucgucgagcgcgacgccucccucggcggcuucaacuccuacggcauggacgucuggggccagggcaccaccgucaccgucuccucc

SEQ ID NO: 20363 - RNA, 390 nt, Artificial Sequence
  derived and/or modified sequence opt2 from anti-influenza_Chain
cagguccagcuccagcaguggggcgccggccuccucaagcccuccgagacccucucccucaccugcgccgucuacggcggcuccuucuccgucuccggcuacuacugguccuggauccgccagccccccggccgcggccucgaguggaucggcgagaucucccacggcggcuccaccaacuacaaccccucccucaagucccgcgucaccaucuccgucgacaccaccaagaaccaguucucccuccgccucuccuccgucaccgccgccgacaccgccgucuacuacugcgcccgcggcaccgaccccgacaccgaggucuacugccgcgucggcaacugcgccgccuucgacuacuggggccagggcucccucgucaccgucuccucc

SEQ ID NO: 20364 - RNA, 390 nt, Artificial Sequence
  derived and/or modified sequence opt2 from anti-influenza_Chain
cagguccagcuccucgaguccggccccggccucgucaagcccucccagacccuccuccucaccugcaccgucuccggcgccuccaucuccaccggcggcaacuacugguccuggauccgccagcaccccggcaaggaccucgaguggaucggcuacaucuucuacuccggcaccaccaaguacaaccccuccgucgacaaccccucccucaagucccgcgucaccauguccgucgacaccuccgagaaccaguucucccucaagcucuccuccgucaccgccgccgacaccgccgucuacuucugcgcccgcggcucccccaacuccggcuacgacuggggcccccacuucgacuacuggggccagggcacccucgucaccgucuccucc

SEQ ID NO: 20365 - RNA, 390 nt, Artificial Sequence
  derived and/or modified sequence opt2 from anti-influenza_Chain
gagguccagcucgucgaguccggcggccaccucguccagcccggccgcucccuccgccucuccugcgccgccuccggcuucaccuucgaggacuacgccaugaacuggguccgccaggcccccggcaagggccucgagugggucuccgucaucuccugggacuccggccgcaucggcuacgccgacuccgucaagggccgcuucaccaucucccgcgacaacgccaagaacuccuccuaccuccagaugaacucccuccgccccgaggacaccgcccucuacuacugcguccgcgacaugcucgccuacuacuccgacaacuccggcaagaaguacaacgucuacggcauggacgucuggggccagggcaccaccgucaccgucuccucc

SEQ ID NO: 20366 - RNA, 390 nt, Artificial Sequence
  derived and/or modified sequence opt2 from anti-influenza_Chain
gagguccagcucgucgaguccggcggcggccucguccagcccggccgcucccuccgccucuccugcgccgucuccggcuucaucuucgaggacuacgccaucaacuggguccgccaggcccccggcaagggccucgagugggucuccaucaucuccugggacuccggccgcaucggcuacgccgacuccguccgcggccgcuucaccaucucccgcgacaacgccaagaacuccuccuuccuccagaugaacucccuccgccccgaggacaccgccgucuacuacugcgucaaggacaugcucgccuacuacuacgacggcuccggcauccgcuacaaccucuacggcauggacgucuggggccagggcaccaccgucaccgucuccucc

SEQ ID NO: 20367 - RNA, 390 nt, Artificial Sequence
  derived and/or modified sequence opt2 from anti-influenza_Chain
gagguccagcucgucgaguccggcggcggccucguccagcccggccgcucccuccgccucuccugcgccgucuccggcuucaucuucgaggacuacgccaucaacuggguccgccaggcccccggcaagugccucgagugggucuccaucaucuccugggacuccggccgcaucggcuacgccgacuccguccgcggccgcuucaccaucucccgcgacaacgccaagaacuccuccuuccuccagaugaacucccuccgccccgaggacaccgccgucuacuacugcgucaaggacaugcucgccuacuacuacgacggcuccggcauccgcuacaaccucuacggcauggacgucuggggccagggcaccaccgucaccgucuccucc

SEQ ID NO: 20368 - RNA, 396 nt, Artificial Sequence
  derived and/or modified sequence opt2 from anti-influenza_Chain
cagaucacccucaaggaguccggccccacccucgucaagcccacccagacccucacccucaccugcgucuucuccggcuucucccucuccaucaccggcguccgcgucggcuggauccgccagccccccggcaaggcccucgaguggcucgcccucaucuccugggacgacgagaagcacuacucccccucccuccagucccgccucaccaucaccaaggacaccuccaagaaccaggucguccucaccaugaccaaccucgaccccgucgacaccgccaccuacuacugcgcccgcuccaccgaccgcggccacguccuccgcuacuucggcuggaugcuccccggcgacgccuucgacgucuggggccagggcaccauggucaccgucuccucc

SEQ ID NO: 20369 - RNA, 396 nt, Artificial Sequence
  derived and/or modified sequence opt2 from anti-influenza_Chain
cagguccagcuccaggaguccggccccggccucgucaagcccuccgagacccucucccucaccugcaccgucuccuccggccccauguccgacuacuacugguccuggauccgccagccccccggcaagggccucgaguggaucggccacgucuccgucucccacggcggccgcaccaaguccaaccccuccgucaugucccgcgucaccaucuccgucgagaccuccaagaaccaguucucccucaagcucaccuccgucaccgccgccgacaccgccgucuacuacugcgcccgccucaacuacuacgaccgcuccggcuaccacucccccgacggccccuccaacaacugguucgaccccuggggccagggcacccucgucaccgucuccucc

SEQ ID NO: 20370 - RNA, 396 nt, Artificial Sequence
  derived and/or modified sequence opt2 from anti-influenza_Chain
cagguccagcucguccaguccggcgccgaggucaagaagcccggcgccuccgucaaggucuccugcaagaccuccggcuacaccuucaccgccuacaccauccacuggguccgccaggcccccggccagcgccucgaguggaugggcuggaucaacgccggcaacggccacaccaaguacucccagcgcuucaagggccgcgucaccaucacccgcgacaccuccgcccgcaccaccuacauggagcuccgcucccucaccuccgaggacaccgcccucuacuucugcgcccgcggccccgagaccuacuacuacgacaagaccaacuggcucaacucccaccccgacgaguacuuccagcacuggggccacggcacccaggucaccgucuccucc

SEQ ID NO: 20371 - RNA, 399 nt, Artificial Sequence
  derived and/or modified sequence opt2 from anti-influenza_Chain
cagguccagcucguccaguccggcuccgaggucaagaagcccggcgccuccgucaaggucuccugcaaggccuccggcuacaccuucaccaacuacgacaucaacuggauccgccaggcccccggccagggccucgaguggaugggcuggaucaaccccaacuccggcaccaccggcuccgcccagcgcuuccagggccgcgucaccaucaccgucgacaccuccaucaccaccgucuacauggagcucuccucccuccgcuccgacgacaccgccaucuacuacugcgcccgcggccgcgagcuccuccgccuccagcacuuccucaccgacucccaguccgagcgccgcgacugcuucgaccccuggggccagggcacccucgucaccgucuccucc

SEQ ID NO: 20372 - RNA, 402 nt, Artificial Sequence
  derived and/or modified sequence opt2 from anti-influenza_Chain
gagguccagcucgucgaguccggcggcggccucgucaagcccggcggcucccuccgccucuccugcgccgccuccggccucuccuuccucaacgccuggauguccuggguccgccaggcccccggcaagggccucgagugggucggccgcaucaaguccaacaccgacggcggcaccaccgacuacgccgcccccgucaagggccgcuucaccaucucccgcgacgacuccaagaacacccucuaccuccagauguccucccucaagaccgaggacaccgccgucuacuacugcaccaccgacggccccuacuccgacgacuuccgcuccggcuacgccgcccgcuaccgcuacuucggcauggacgucuggggccagggcaccaccgucaccgucuccucc

SEQ ID NO: 20373 - RNA, 402 nt, Artificial Sequence
  derived and/or modified sequence opt2 from anti-influenza_Chain
gagguccagcucgucgaguccggcggcggccucgucaagcccggcggcucccuccgccucuccugcgccgccuccggcuucuccuuccucaacgccuggauguccuggguccgccaggcccccggcaagggccucgagugggucggccgcaucaaguccaacaccgacggcggcaccaccgacuacgccgcccccgucaagggccgcuucaccaucucccgcgacgacuccaagaacacccucuaccuccagauguccucccucaagaccgaggacaccgccgucuacuacugcaccaccgacggccccuacuccgacgacuuccgcuccggcuacgccgcccgcuaccgcuacuucggcauggacgucuggggccagggcaccaccgucaccgucuccucc

SEQ ID NO: 20374 - RNA, 402 nt, Artificial Sequence
  derived and/or modified sequence opt2 from anti-influenza_Chain
gagguccagcucgucgaguccggcggcggccucgucaagcccggcggcucccuccgccucuccugcgccgccuccggccucaccuuccucaacgccuggauguccuggguccgccaggcccccggcaagggccucgagugggucggccgcaucaaguccaacaccgacggcggcaccaccgacuacgccgcccccgucaagggccgcuucaccaucucccgcgacgacuccaagaacacccucuaccuccagauguccucccucaagaccgaggacaccgccgucuacuacugcaccaccgacggccccuacuccgacgacuuccgcuccggcuacgccgcccgcuaccgcuacuucggcauggacgucuggggccagggcaccaccgucaccgucuccucc

SEQ ID NO: 20375 - RNA, 402 nt, Artificial Sequence
  derived and/or modified sequence opt2 from anti-influenza_Chain
gagguccagcucgucgaguccggcggcggccucgucaagcccggcggcucccuccgccucuccugcgccgccuccggcuucuccuucuccaacgccuggauguccuggguccgccaggcccccggcaagggccucgagugggucggccgcaucaaguccaacaccgacggcggcaccaccgacuacgccgcccccgucaagggccgcuucaccaucucccgcgacgacuccaagaacacccucuaccuccagauguccucccucaagaccgaggacaccgccgucuacuacugcaccaccgacggccccuacuccgacgacuuccgcuccggcuacgccgcccgcuaccgcuacuucggcauggacgucuggggccagggcaccaccgucaccgucuccucc

SEQ ID NO: 20376 - RNA, 402 nt, Artificial Sequence
  derived and/or modified sequence opt2 from anti-influenza_Chain
gagguccagcucgucgaguccggcggcggccucgucaagcccggcggcucccuccgccucuccugcgccgccuccggccucaccuucuccaacgccuggauguccuggguccgccaggcccccggcaagggccucgagugggucggccgcaucaaguccaacaccgacggcggcaccaccgacuacgccgcccccgucaagggccgcuucaccaucucccgcgacgacuccaagaacacccucuaccuccagauguccucccucaagaccgaggacaccgccgucuacuacugcaccaccgacggccccuacuccgacgacuuccgcuccggcuacgccgcccgcuaccgcuacuucggcauggacgucuggggccagggcaccaccgucaccgucuccucc

SEQ ID NO: 20377 - RNA, 402 nt, Artificial Sequence
  derived and/or modified sequence opt2 from anti-influenza_Chain
gagguccagcucgucgaguccggcggcggccucgucaagcccggcggcucccuccgccucuccugcgccgccuccggcuucaccuucuccaacgccuggauguccuggguccgccaggcccccggcaagggccucgagugggucggccgcaucaaguccaacaccgacggcggcaccaccgacuacgccgcccccgucaagggccgcuucaccaucucccgcgacgacuccaagaacacccucuaccuccagauguccucccucaagaccgaggacaccgccgucuacuacugcaccaccgacggccccuacuccgacgacuuccgcuccggcuacgccgcccgcuaccgcuacuucggcauggacgucuggggccagggcaccaccgucaccgucuccucc

SEQ ID NO: 20378 - RNA, 402 nt, Artificial Sequence
  derived and/or modified sequence opt2 from anti-influenza_Chain
gagguccagcucgucgucuccggcggcggccucgucaagcccggcggcucccuccgccucuccugcgccgccuccggccucuccuuccucaacgccuggauguccuggguccgccaggcccccggcaagggccucgagugggucggccgcaucaaguccaacaccgacggcggcaccaccgacuacgccgcccccgucaagggccgcuucuccaucucccgcgacgacuccaagaacaugcucuuccuccacauguccucccuccgcaccgaggacaccgccgucuacuacugcgccaccgacggccccuacuccgacgacuuccgcuccggcuacgccgcccgcuaccgcuacuucggcauggacgucuggggccagggcaccaccgucaccgucuccucc

SEQ ID NO: 20379 - RNA, 402 nt, Artificial Sequence
  derived and/or modified sequence opt2 from anti-influenza_Chain
gagguccagcucgucgucuccggcggcggccucgucaagcccggcggcucccuccgccucuccugcgccgccuccggccucuccuuccucaacgccuggauguccuggguccgccaggcccccggcaagugccucgagugggucggccgcaucaaguccaacaccgacggcggcaccaccgacuacgccgcccccgucaagggccgcuucuccaucucccgcgacgacuccaagaacaugcucuuccuccacauguccucccuccgcaccgaggacaccgccgucuacuacugcgccaccgacggccccuacuccgacgacuuccgcuccggcuacgccgcccgcuaccgcuacuucggcauggacgucuggggccagggcaccaccgucaccgucuccucc

SEQ ID NO: 20380 - RNA, 402 nt, Artificial Sequence
  derived and/or modified sequence opt2 from anti-influenza_Chain
gagguccagcucgucgucuccggcggcggccucgucaagcccggcggcucccuccgccucuccugcgccgccuccggccucuccuuccucaacgccuggauguccuggguccgccaggcccccggcaagggccucgagugggucggccgcaucaaguccaacaccgacggcggcaccaccgacuacgccgcccccgucaagggccgcuucuccaucucccgcgacgacuccaagaacaugcucuuccuccacauguccucccuccgcaccgaggacaccgccgucuacuacugcgccaccgacggccccuacuccgacgacuuccgcuccggcuacgccgcccgcuaccgcuacuucggcauggacgucuggggcugcggcaccaccgucaccgucuccucc

SEQ ID NO: 20381 - RNA, 402 nt, Artificial Sequence
  derived and/or modified sequence opt2 from anti-influenza_Chain
gagguccagcucgucgaguccggcggcggccucgucaagcccggcggcucccuccgccucuccugcgccgccuccggcuucaccuuccucaacgccuggauguccuggguccgccaggcccccggcaagggccucgagugggucggccgcaucaaguccaacaccgacggcggcaccaccgacuacgccgcccccgucaagggccgcuucaccaucucccgcgacgacuccaagaacacccucuaccuccagauguccucccucaagaccgaggacaccgccgucuacuacugcaccaccgacggccccuacuccgacgacuuccgcuccggcuacgccgcccgcuaccgcuacuucggcauggacgucuggggccagggcaccaccgucaccgucuccucc

SEQ ID NO: 20382 - RNA, 402 nt, Artificial Sequence
  derived and/or modified sequence opt2 from anti-influenza_Chain
gagguccagcucgucgaguccggcggcggccucgucaagcccggcggcucccuccgccucuccugcgccgccuccggcuucaccuuccucaacgccuggauguccuggguccgccaggcccccggcaagugccucgagugggucggccgcaucaaguccaacaccgacggcggcaccaccgacuacgccgcccccgucaagggccgcuucaccaucucccgcgacgacuccaagaacacccucuaccuccagauguccucccucaagaccgaggacaccgccgucuacuacugcaccaccgacggccccuacuccgacgacuuccgcuccggcuacgccgcccgcuaccgcuacuucggcauggacgucuggggccagggcaccaccgucaccgucuccucc

SEQ ID NO: 20383 - RNA, 402 nt, Artificial Sequence
  derived and/or modified sequence opt2 from anti-influenza_Chain
gagguccagcucgucgaguccggcggcggccucgucaagcccggcggcucccuccgccucuccugcgccgccuccggcuucaccuuccucaacgccuggauguccuggguccgccaggcccccggcaagggccucgagugggucggccgcaucaaguccaacaccgacggcggcaccaccgacuacgccgcccccgucaagggccgcuucaccaucucccgcgacgacuccaagaacacccucuaccuccagauguccucccucaagaccgaggacaccgccgucuacuacugcaccaccgacggccccuacuccgacgacuuccgcuccggcuacgccgcccgcuaccgcuacuucggcauggacgucuggggcugcggcaccaccgucaccgucuccucc

SEQ ID NO: 20384 - RNA, 414 nt, Artificial Sequence
  derived and/or modified sequence opt2 from anti-influenza_Chain
cagguccagcuccaggaguccggcggcggccucguccagcccggcgagucccuccgccucuccugcgucggcuccggcuccuccuucggcgaguccacccucuccuacuacgccgucuccuggguccgccaggcccccggcaagggccucgaguggcucuccaucaucaacgccggcggcggcgacaucgacuacgccgacuccgucgagggccgcuucaccaucucccgcgacaacuccaaggagacccucuaccuccagaugaccaaccuccgcgucgaggacaccggcgucuacuacugcgccaagcacauguccaugcagcaggucgucuccgccggcugggagcgcgccgaccucgucggcgacgccuucgacgucuggggccagggcaccauggucaccgucuccucc

SEQ ID NO: 20385 - RNA, 465 nt, Artificial Sequence
  derived and/or modified sequence opt2 from anti-influenza_Chain
cucucccgcaucaaccacuucgagaagauccagaucauccccaaguccuccugguccgaccacgaggccuccuccggcgucuccuccgccugccccuaccagggcacccccuccuucuuccgcaacgucgucuggcucaucaagaagaacaacaccuaccccaccaucaagcgcuccuacaacaacaccaaccaggaggaccuccucauccucuggggcauccaccacuccaacgacgccgccgagcagaccaagcucuaccagaaccccaccaccuacaucuccgucggcaccuccacccucaaccagcgccucguccccaagaucgccacccgcuccaaggucaacggccagaacggccgcauggacuucuucuggaccauccucaagcccaacgacgccaucaacuucgaguccaacggcaacuucaucgcccccgaguacgccuacaagaucgucaagaag

SEQ ID NO: 20386 - RNA, 564 nt, Artificial Sequence
  derived and/or modified sequence opt2 from anti-influenza_Chain
aacguccccgagugguccuacaucgucgagaaggccaaccccgccaacgaccucugcuaccccggcaacuucaacgacuacgaggagcucaagcaccuccucucccgcaucaaccacuucgagaagauccagaucauccccaaguccuccugguccgaccacgaggccuccuccggcgucuccuccgccugccccuaccagggcacccccuccuucuuccgcaacgucgucuggcucaucaagaagaacaacaccuaccccaccaucaagcgcuccuacaacaacaccaaccaggaggaccuccucauccucuggggcauccaccacuccaacgacgccgccgagcagaccaagcucuaccagaaccccaccaccuacaucuccgucggcaccuccacccucaaccagcgccucguccccaagaucgccacccgcuccaaggucaacggccagaacggccgcauggacuucuucuggaccauccucaagcccaacgacgccaucaacuucgaguccaacggcaacuucaucgcccccgaguacgccuacaagaucgucaagaag

SEQ ID NO: 20387 - RNA, 609 nt, Artificial Sequence
  derived and/or modified sequence opt2 from anti-influenza_Chain
augcuccgcucccucguccucaacgagaagcuccgcgcccgcguccucgagcgcgccgaggaguuccuccucaacaacaaggccgacgaggaggucugguuccgcgagcucguccucugcauccucaccuccaacuccuccuucaucuccgccuacaaguccaugaacuacauccucgacaagauccucuacauggacgagaaggagaucuccauccuccuccaggaguccggcuaccgcuucuacaaccucaaggccaaguaccucuaccgcgccaagaaccucuacggcaaggucaagaagaccaucaaggagaucgccgacaaggaccagaugcaggcccgcgaguucaucgccacccacaucuacggcaucggcuacaaggaggccucccacuuccuccgcaacgucggcuaccucgaccucgccaucaucgaccgccacauccuccgcuucaucaacaaccucggcauccccaucaagcucaaguccaagcgcgaguaccuccucgccgagucccuccuccgcuccaucgccaacaaccucaacguccaggucggccuccucgaccucuucaucuucuucaagcagaccaacaccaucgucaag

SEQ ID NO: 20388 - RNA, 615 nt, Artificial Sequence
  derived and/or modified sequence opt2 from anti-influenza_Chain
ggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaagaucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgcc

SEQ ID NO: 20389 - RNA, 639 nt, Artificial Sequence
  derived and/or modified sequence opt2 from anti-influenza_Chain
gagaucguccucacccagucccccggcacccucucccucucccccggcgagcgcgccacccucuccugccgcgccucccagcgcgucuccuccuaccucgccugguaccagcagaagcccggccaggccccccgccuccucaucuacggcgccuccacccgcgccgccggcauccccgaccgcuucuccggcuccggcuccggcaccgacuucacccucaccaucucccgccucgagcccgaggacuccgccgucuacuacugccagcaguacggccgcaccccccucaccuucggcggcggcaccaaggucgagaucaagcgcgccgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 20390 - RNA, 639 nt, Artificial Sequence
  derived and/or modified sequence opt2 from anti-influenza_Chain
gacauccagaugacccagucccccuccucccucuccgccucccucggcggcaacgucaccaucaccugcaaggccucccaggacaucaacaaguacaucgccugguaccagcacaagcccggcaagggcccccgccucgucauccacuacaccuccacccuccagcccggcauccccucccgcuucuccggcuccggcuccggcaccgacuacuccuucuccaucuccaaccucgagcccgaggacaucgccaccuacuacugccuccaguacgacauccucuacaccuucggcggcggcaccaagcucgagaucaagcgcgccgacgccgcccccaccgucuccaucuucccccccuccuccgagcagcucaccuccggcggcgccuccgucgucugcuuccucaacaacuucuaccccaaggacaucaacgucaaguggaagaucgacggcuccgagcgccagaacggcguccucaacuccuggaccgaccaggacuccaaggacuccaccuacuccauguccuccacccucacccucaccaaggacgaguacgagcgccacaacuccuacaccugcgaggccacccacaagaccuccaccucccccaucgucaaguccuucaaccgcaacgagugc

SEQ ID NO: 20391 - RNA, 642 nt, Artificial Sequence
  derived and/or modified sequence opt2 from anti-influenza_Chain
gacauccagaugacccagucccccuccucccucuccgccuccgucggcgaccgcgucaccaucaccugccgcgccucccagggcaucuccuccuaccucgccugguaccagcagaagcccggcaagguccccacccuccucaucuacgacgccuccacccuccgcuccggcguccccucccgcuucuccggcuccggcuccgccaccgacuucacccucaccaucuccucccuccagcccgaggacgucgccaccuacuacugccagcgcuacaacuccgccccccccaucaccuucggccagggcacccgccucgagaucaagcgcgccgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 20392 - RNA, 642 nt, Artificial Sequence
  derived and/or modified sequence opt2 from anti-influenza_Chain
gagaucguccucacccagucccccggcacccucucccucucccccggcgagcgcgccacccucuccugccgcgccucccaguccgucuccuccuccuaccucgccugguaccagcagaagcccggccaggccccccgccuccucaucuacggcgccuccucccgcgccaccggcauccccgaccgcuucuccggcuccggcuccggcaccgacuucacccucaccaucucccgccucgagcccgaggacuucgccgucuacuacugccagcaguacggcuccuccccccgcaccuucggcggcggcaccaaggucgagaucaagcgcgccgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 20393 - RNA, 642 nt, Artificial Sequence
  derived and/or modified sequence opt2 from anti-influenza_Chain
uccuacguccucacccagccccccuccgucuccgucgcccccggcgagaccgccaccgucaccugcggcggcaacaacaucggcuccaaguccguccacugguaccagcagaagcccggccaggcccccgucgucgucaucuacuacgacggcgaccgccccuccggcauccccgagcgcuucuccggcuccaacuccggcgacaccgccacccucaccaucucccgcgucgaggccggcgacgaggccgacuacuacugccucgucugggacuacaccuccguccacuacgucuucggcaccggcaccaaggucaccguccucggccagcccaaggccaaccccaccgucacccucuucccccccuccuccgaggagcuccaggccaacaaggccacccucgucugccucaucuccgacuucuaccccggcgccgucaccgucgccuggaaggccgacggcucccccgucaaggccggcgucgagaccaccaagcccuccaagcaguccaacaacaaguacgccgccuccuccuaccucucccucacccccgagcaguggaagucccaccgcuccuacuccugccaggucacccacgagggcuccaccgucgagaagaccgucgcccccaccgagugcucc

SEQ ID NO: 20394 - RNA, 642 nt, Artificial Sequence
  derived and/or modified sequence opt2 from anti-influenza_Chain
gacauccagaugacccagaccuccuccucccucuccgccucccucggcgaccgcgucaccaucuccugccgcgccucccaggacauccgcaacuaccucaacugguaccagcagaagcccgacggcaccgucaagcuccucaucuacuacaccucccgccuccacuccggcguccccucccgcuucuccgacuccggcuccggcaccgacuacucccucaccaucuccaaccucgagcaggaggaccucgccaccuacuucugccagcagaccuacacccuccccuggaccuucggcggcggcaccaagcucgagaucaagcgcgccgacgccgcccccaccgucuccaucuucccccccuccuccgagcagcucaccuccggcggcgccuccgucgucugcuuccucaacaacuucuaccccaaggacaucaacgucaaguggaagaucgacggcuccgagcgccagaacggcguccucaacuccuggaccgaccaggacuccaaggacuccaccuacuccauguccuccacccucacccucaccaaggacgaguacgagcgccacaacuccuacaccugcgaggccacccacaagaccuccaccucccccaucgucaaguccuucaaccgcaacgagugc

SEQ ID NO: 20395 - RNA, 645 nt, Artificial Sequence
  derived and/or modified sequence opt2 from anti-influenza_Chain
gacggcgucaagccccucauccuccgcgacugcuccgucgccggcuggcuccucggcaaccccaugugcgacgaguucaucaacguccccgagugguccuacaucgucgagaaggccaaccccgccaacgaccucugcuaccccggcaacuucaacgacuacgaggagcucaagcaccuccucucccgcaucaaccacuucgagaagauccagaucauccccaaguccuccugguccgaccacgaggccuccuccggcgucuccuccgccugccccuaccagggcacccccuccuucuuccgcaacgucgucuggcucaucaagaagaacaacaccuaccccaccaucaagcgcuccuacaacaacaccaaccaggaggaccuccucauccucuggggcauccaccacuccaacgacgccgccgagcagaccaagcucuaccagaaccccaccaccuacaucuccgucggcaccuccacccucaaccagcgccucguccccaagaucgccacccgcuccaaggucaacggccagaacggccgcauggacuucuucuggaccauccucaagcccaacgacgccaucaacuucgaguccaacggcaacuucaucgcccccgaguacgccuacaagaucgucaagaag

SEQ ID NO: 20396 - RNA, 645 nt, Artificial Sequence
  derived and/or modified sequence opt2 from anti-influenza_Chain
gacauccagaugacccagucccccuccacccucuccgccuccgucggcgaccgcgucaccaucaccugccgcgccucccagaccaucaacaacuaccucgccugguaccagcagaagcccggcaaggcccccaagcuccucaucuacaaggccuccucccucgaguccggcguccccucccgcuucuccggcuccggcuccggcaccgaguucacccucaccaucuccucccuccagcccgacgacuucgccaccuacuacugccaggaguacaacaacgacuccccccucaccuucggcggcggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 20397 - RNA, 645 nt, Artificial Sequence
  derived and/or modified sequence opt2 from anti-influenza_Chain
uccguccucacccagccccccuccgccuccggcucccgcggccaguccaucaccaucuccugcaccggcuccaccuccgacaucggcuccuacaacuacgucuccugguaccagcagcaccccggcaccgcccccaaggucauccucuacgaggucucccagcgccccuccggcguccccgaccgcuucuccggcuccaaguccggcaacaccgccuuccucaccgucuccggccuccaggccgaggacgaggccgacuacuacugcgccuccuacgccggcaacaacaucuacgucuucggcuccggcaccaaggucaccguccucggccagcccaaggccaaccccaccgucacccucuucccccccuccuccgaggagcuccaggccaacaaggccacccucgucugccucaucuccgacuucuaccccggcgccgucaccgucgccuggaaggccgacuccucccccgucaaggccggcgucgagaccaccacccccuccaagcaguccaacaacaaguacgccgccuccuccuaccucucccucacccccgagcaguggaagucccacaaguccuacuccugccaggucacccacgagggcuccaccgucgagaagaccgucgcccccaccgagugcucc

SEQ ID NO: 20398 - RNA, 645 nt, Artificial Sequence
  derived and/or modified sequence opt2 from anti-influenza_Chain
uccgcccucacccagccccccuccgccuccggcucccgcggccaguccaucaccaucuccugcaccggcuccaccuccgacaucggcuccuacaacuacgucuccugguaccagcagcaccccggcaccgcccccaaggucauccucuacgaggucucccagcgccccuccggcguccccgaccgcuucuccggcuccaaguccggcaacaccgccuuccucaccgucuccggccuccaggccgaggacgaggccgacuacuacugcgccuccuacgccggcaacaacaucuacgucuucggcuccggcaccaaggucaccguccucggccagcccaaggccaaccccaccgucacccucuucccccccuccuccgaggagcuccaggccaacaaggccacccucgucugccucaucuccgacuucuaccccggcgccgucaccgucgccuggaaggccgacuccucccccgucaaggccggcgucgagaccaccacccccuccaagcaguccaacaacaaguacgccgccuccuccuaccucucccucacccccgagcaguggaagucccacaaguccuacuccugccaggucacccacgagggcuccaccgucgagaagaccgucgcccccaccgagugcucc

SEQ ID NO: 20399 - RNA, 648 nt, Artificial Sequence
  derived and/or modified sequence opt2 from anti-influenza_Chain
caguccguccucacccagccccccuccgaguccgucucccccggccagaccgccuccgucaccugcuccggccacaagcucggcgacaaguacgucuccugguaccagcagaagcccggccagucccccguccuccucaucuaccaggacaaccgccgccccuccggcauccccgagcgcuucaucggcuccaacuccggcaacaccgccacccucaccaucuccggcacccaggcccucgacgaggccgacuacuacugccaggccugggacuccuccaccgccgucuucggcggcggcaccaagcucaccguccucggcgccgccgccggccagcccaaggccgcccccuccgucacccucuucccccccuccuccgaggagcuccaggccaacaaggccacccucgucugccucaucuccgacuucuaccccggcgccgucaccgucgccuggaaggccgacuccucccccgucaaggccggcgucgagaccaccacccccuccaagcaguccaacaacaaguacgccgccuccuccuaccucucccucacccccgagcaguggaagucccaccgcuccuacuccugccaggucacccacgagggcuccaccgucgagaagaccgucgcccccaccgagugcucc

SEQ ID NO: 20400 - RNA, 648 nt, Artificial Sequence
  derived and/or modified sequence opt2 from anti-influenza_Chain
caguccgcccucacccagcccgccuccgucuccggcucccccggccaguccaucaccaucuccugcaccggcaccuccuccgacgucggcuccuacaaccucgucuccugguaccagcagcaccccggcaaggcccccaagcucaugaucuacgaggucuccaagcgccccuccggcgucuccaaccgcuucuccggcuccaaguccggcaacaccgccucccucaccaucuccggccuccaggccgaggacgaggccgacuacuacugccaccucuacgucggcuccuccaacugggucuucggcggcggcaccaagcucgccguccucggccagcccaaggccgcccccuccgucacccucuucccccccuccuccaaggagcuccaggccaacaaggccacccucgucugccccaucuccgacuucuaccccggcgccgucaccgucgccuggaaggccgacuccucccccgucaaggccggcgucgagaccaccacccccuccaagcaguccaacaacaaguacgccgccuccuccuaccucucccucacccccgagcaguggaagucccacaaguccuacuccugccaggucacccacgagggcuccaccgucgagaagaccgucgcccccaccgagugcucc

SEQ ID NO: 20401 - RNA, 648 nt, Artificial Sequence
  derived and/or modified sequence opt2 from anti-influenza_Chain
gagaucguccucacccagucccccgccacccucuccgucucccccggcgagcgcgccacccucuccugccgcgccucccaguccgucgacuccaaccucgccugguaccagcagaagcccggccaggccccccgccuccucgucuacuccgccuccacccgcgccaccggcauccccgcccgcuucuccggcuccggcuccggcaccgaguucacccucgccaucuccucccuccaguccgaggacuucgccgucuacuacugccagcacuacaccaacuggcccccccgccucaccuucggcggcggcuccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 20402 - RNA, 648 nt, Artificial Sequence
  derived and/or modified sequence opt2 from anti-influenza_Chain
gagaucguccucacccagucccccgccacccucuccgucucccccggcgagcgcgccacccucuccugccgcgccucccaguccgucucccacaaccucgccugguaccagcagaagcccggccaggccccccgccuccucgucuacuccgccuccacccgcgccaccggcauccccgcccgcuucuccggcuccggcuccggcaccgaguucacccucgccaucuccucccuccaguccgaggacuucgccgucuacuacugccagcacuacaccaacuaccccccccgccucaccuucggcggcggcuccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 20403 - RNA, 648 nt, Artificial Sequence
  derived and/or modified sequence opt2 from anti-influenza_Chain
gagaucgucaugacccagucccccgccacccucuccgucucccccggcgagcgcgccacccucuccugccgcgccucccaguccgucgacuccaaccucgccugguaccagcagaagcccggccaggccccccgccuccucgucuacuccgccuccacccgcgccaccggcauccccgcccgcuucuccggcuccggcuccggcaccgaguucacccucgccaucuccucccuccaguccgaggacuucgccgucuacuacugccagcacuacaccaacuggcccccccgccucaccuucggcggcggcuccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 20404 - RNA, 648 nt, Artificial Sequence
  derived and/or modified sequence opt2 from anti-influenza_Chain
gagaucguccucacccagucccccgccacccucuccgucucccccggcgagcgcgccacccucuccugccgcgccucccaguccgucuccuccaaccucgccugguaccagcagaagcccggccaggccccccgccuccucgucuacuccgccuccacccgcgccaccggcauccccgcccgcuucuccggcuccggcuccggcaccgaguucacccucgccaucuccucccuccaguccgaggacuucgccgucuacuacugccagcacuacaccaacuggcccccccgccucaccuucggcggcggcuccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 20405 - RNA, 648 nt, Artificial Sequence
  derived and/or modified sequence opt2 from anti-influenza_Chain
gagaucguccucacccagucccccgccacccucuccgucucccccggcgagcgcgccacccucuccugccgcgccucccaguccgucgaccacaaccucgccugguaccagcagaagcccggccaggccccccgccuccucgucuacuccgccuccacccgcgccaccggcauccccgcccgcuucuccggcuccggcuccggcaccgaguucacccucgccaucuccucccuccaguccgaggacuucgccgucuacuacugccagcacuacaccaacuggcccccccgccucaccuucggcggcggcuccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 20406 - RNA, 648 nt, Artificial Sequence
  derived and/or modified sequence opt2 from anti-influenza_Chain
gagaucguccucacccagucccccgccacccucuccgucucccccggcgagcgcgccacccucuccugccgcgccucccaguccgucucccacaaccucgccugguaccagcagaagcccggccaggccccccgccuccucgucuacuccgccuccacccgcgccaccggcauccccgcccgcuucuccggcuccggcuccggcaccgaguucacccucgccaucuccucccuccaguccgaggacuucgccgucuacuacugccagcacuacaccaacuggcccccccgccucaccuucggcggcggcuccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 20407 - RNA, 648 nt, Artificial Sequence
  derived and/or modified sequence opt2 from anti-influenza_Chain
gagaucguccucacccagucccccgccacccucuccgucucccccggcgagcgcgccacccucuccugccgcgccucccaguccgucucccacaaccucgccugguaccagcagaagcccggccaggccccccgccuccucgucuacuccgccuccacccgcgccaccggcauccccgcccgcuucuccggcuccggcuccggcaccgaguucacccucgccaucuccucccuccaguccgaggacuucgccgucuacuacugccagcacuacaccaacuuccccccccgccucaccuucggcggcggcuccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 20408 - RNA, 648 nt, Artificial Sequence
  derived and/or modified sequence opt2 from anti-influenza_Chain
gagaucguccucacccagucccccgccacccucuccgucucccccggcgagcgcgccacccucuccugccgcgccucccaguccgucgacuccaaccucgccugguaccagcagaagcccggccaggccccccgccuccucgucuacuccgccuccacccgcgccaccggcauccccgcccgcuucuccggcuccggcuccggcaccgaguucacccucgccaucuccucccuccaguccgaggacuucgccgucuacuacugccagcacuacaccaacuuccccccccgccucaccuucggcggcggcuccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 20409 - RNA, 648 nt, Artificial Sequence
  derived and/or modified sequence opt2 from anti-influenza_Chain
gagaucguccucacccagucccccgccacccucuccgucucccccggcgagcgcgccacccucuccugccgcgccucccaguccgucgacuccaaccucgccugguaccagcagaagcccggccaggccccccgccuccucgucuacuccgccuccacccgcgccaccggcauccccgcccgcuucuccggcuccggcuccggcaccgaguucacccucgccaucuccucccuccaguccgaggacuucgccgucuacuacugccagcacuacaccaacuaccccccccgccucaccuucggcggcggcuccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 20410 - RNA, 648 nt, Artificial Sequence
  derived and/or modified sequence opt2 from anti-influenza_Chain
gagaccacccucacccagucccccgccacccucuccgucucccccggcgagcgcgccacccucuccugccgcgccucccaggucaucucccacaaccucgccugguaccagcagaagcccggccaggccccccgccuccucaucuacggcgccuccacccgcgccuccggcauccccgcccgcuucuccggcuccggcuccggcaccgacuacacccucaccaucaccucccuccaguccgaggacuucgccgucuacuacugccagcacuacuccaacuggcccccccgccucaccuucggcggcggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 20411 - RNA, 648 nt, Artificial Sequence; identical to SEQ ID NO: 16292
  derived and/or modified sequence opt2 from anti-influenza_Chain

SEQ ID NO: 20412 - RNA, 648 nt, Artificial Sequence
  derived and/or modified sequence opt2 from anti-influenza_Chain
gagaucguccucacccagucccccgccacccucuccgucucccccggcgagcgcgccacccucuccugccgcgccucccaggucaucucccacaaccucgccugguaccagcagaagcccggccaggccccccgccuccucaucuacggcgccuccacccgcgccuccggcauccccgcccgcuucuccggcuccggcuccggcaccgacuacacccucaccaucaccucccuccagcccgaggacuucgccgucuacuacugccagcacuacuccaacuggcccccccgccucaccuucggcggcggcaccaaggucgagaucaagcgcaccgucgccgcccccuccgucuccaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 20413 - RNA, 648 nt, Artificial Sequence
  derived and/or modified sequence opt2 from anti-influenza_Chain
gagaucgucaugacccagucccccgccacccucuccgucucccccggcgagcgcgccacccucuccugccgcgccucccaggucaucucccacaaccucgccugguaccagcagaagcccggccaggccccccgccuccucaucuacggcgccuccacccgcgccuccggcauccccgcccgcuucuccggcuccggcuccggcaccgacuacacccucaccaucaccucccuccaguccgaggacuucgccgucuacuacugccagcacuacuccaacuggcccccccgccucaccuucggcggcggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 20414 - RNA, 648 nt, Artificial Sequence
  derived and/or modified sequence opt2 from anti-influenza_Chain
gagaucguccucacccagucccccgccacccucuccgucucccccggcgagcgcgccacccucuccugccgcgccucccaggucaucucccacaaccucgccugguaccagcagaagcccggccaggccccccgccuccucaucuacggcgccuccacccgcgccuccggcauccccgcccgcuucuccggcuccggcuccggcaccgacuacacccucaccaucaccucccuccaguccgaggacuucgccgucuacuacugccagcacuacuccaacuuccccccccgccucaccuucggcggcggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 20415 - RNA, 648 nt, Artificial Sequence
  derived and/or modified sequence opt2 from anti-influenza_Chain
gagaucguccucacccagucccccgccacccucuccgucucccccggcgagcgcgccacccucuccugccgcgccucccaggucaucucccacaaccucgccugguaccagcagaagcccggccaggccccccgccuccucaucuacggcgccuccacccgcgccuccggcauccccgcccgcuucuccggcuccggcuccggcaccgacuacacccucaccaucaccucccuccaguccgaggacuucgccgucuacuacugccagcacuacuccaacuaccccccccgccucaccuucggcggcggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 20416 - RNA, 648 nt, Artificial Sequence
  derived and/or modified sequence opt2 from anti-influenza_Chain
gagaucguccucacccagucccccgccacccucuccgucucccccggcgagcgcgucacccucuccugccgcgccucccaguccgucgccaacaaccucgccugguaccagcagaagcccggccaguccccccgccuccucaucuacggcgccuccacccgcgacaccggcauccccgcccgcuucuccggcuccggcuccggcaccgaguucacccucaccaucuccucccuccaguccgaggacuucgccgucuacuacugccagcaguacaacaacuggccccccauguacaccuucggccagggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 20417 - RNA, 648 nt, Artificial Sequence
  derived and/or modified sequence opt2 from anti-influenza_Chain
gacaucgucaugacccagucccccuccacccucuccgccuccgucggcgaccgcgucaccaucaccugccgcgccucccaguccaucggcaacuggcucgccugguaccagcagaagcccggcaaggcccccaagcuccucaucuacaaggucuccacccucgaguccggcguccccucccgcuucuccggcuccggcuccggcaccgaguucacccucaccaucaacucccuccagcccgacgacuucgccaccuacuacugccagcgcuacaccuccaacucccagggcuucaccuucggccagggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 20418 - RNA, 648 nt, Artificial Sequence
  derived and/or modified sequence opt2 from anti-influenza_Chain
gacauccagcucacccaguccccccucuccccccccgucacccucggccagcccgccuccaucuccugccgcuccucccagucccuccucuacaccgacggcuucaccuaccucuccugguaccaccagcgccccggccaguccccccgccgccucaucuacaagaucuccaaccgcgacuccggcguccccgaccgcuucuccggcuccggcuccggcaccgacuucacccucaagaucucccgcgucgaggccgaggacgucggcgucuacuacugcaugcaggccacccacuggccccucaccuucggcgagggcaccaaggucgagaucaagcccaaggccgcccccuccgucacccucuucccccccuccuccgaggagcuccaggccaacaaggccacccucgucugccucaucuccgacuucuaccccggcgccgucaccgucgccuggaaggccgacuccucccccgucaaggccggcgucgagaccaccacccccuccaagcaguccaacaacaaguacgccgccuccuccuaccucucccucacccccgagcaguggaagucccacaaguccuacuccugccaggucacccacgagggcuccaccgucgagaagaccgucgcccccaccgagugcucc

SEQ ID NO: 20419 - RNA, 648 nt, Artificial Sequence
  derived and/or modified sequence opt2 from anti-influenza_Chain
gagaucguccucacccagucccccggcacccucucccucucccccggcgagcgcgccacccucuccugccgcgccucccaguccguccgcuccaacaaccucgccugguaccagcacaagcccggccaggccccccgccuccucaucuucggcgccuccucccgcgccaccggcauccccgaccgcuucuccggcuccggcuccggcaccgacuucacccucaccaucucccgccucgagcccgaggacuucgccgucuacuacugccagcaguacggcuccucccccgcccucaccuucggcggcggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 20420 - RNA, 648 nt, Artificial Sequence
  derived and/or modified sequence opt2 from anti-influenza_Chain
caguccguccucacccagccccccuccgccuccggcucccgcggccaguccaucaccaucuccugcaccggcuccaccuccgacaucggcuccuacaacuacgucuccugguaccagcagcaccccggcaccgcccccaaggucauccucuacgaggucucccagcgccccuccggcguccccgaccgcuucuccggcuccaaguccggcaacaccgccuuccucaccgucuccggccuccagaccgacgacgaggccgacuacuacugcgccuccuacgccggcaacaacaucuacgucuucggcuccggcaccaaggucaccguccucggccagcccaaggccaaccccaccgucacccucuucccccccuccuccgaggagcuccaggccaacaaggccacccucgucugccucaucuccgacuucuaccccggcgccgucaccgucgccuggaaggccgacuccucccccgucaaggccggcgucgagaccaccacccccuccaagcaguccaacaacaaguacgccgccuccuccuaccucucccucacccccgagcaguggaagucccacaaguccuacuccugccaggucacccacgagggcuccaccgucgagaagaccgucgcccccaccgagugcucc

SEQ ID NO: 20421 - RNA, 651 nt, Artificial Sequence
  derived and/or modified sequence opt2 from anti-influenza_Chain
cagcccguccucacccagccccccuccgccuccggcucccccggccagcgcgucaccaucuccugcuccggcuccuccuccaacaucggcuccuacaccgucaacugguaccagcagcuccccggcaccgcccccaagcuccucaucuacucccucaaccagcgccccuccggcguccccgaccgcuucuccggcuccaaguccggcaccuccgccucccucgccaucuccggccuccaguccgaggacgaggccgucuacuacugcgccgccugggacgacucccucuccgcccacgucgucuucggcggcggcaccaagcucaccguccucggccagcccaaggccgcccccuccgucacccucuucccccccuccuccgaggagcuccaggccaacaaggccacccucgucugccucaucuccgacuucuaccccggcgccgucaccgucgccuggaaggccgacuccucccccgucaaggccggcgucgagaccaccacccccuccaagcaguccaacaacaaguacgccgccuccuccuaccucucccucacccccgagcaguggaagucccaccgcuccuacuccugccaggucacccacgagggcuccaccgucgagaagaccgucgcccccaccgagugcucc

SEQ ID NO: 20422 - RNA, 651 nt, Artificial Sequence
  derived and/or modified sequence opt2 from anti-influenza_Chain
cagcccguccucacccagccccccuccgccuccggcacccccggccagcgcgucaccaucuccugcuccggcuccuccuccaacaucggcuccaacaccgucuccugguaccagcagguccccggcaccgcccccaagcuccucaucuacggcaacaacgagcgccccuccggcguccccgaccgcuucuccggcuccaaguccgccaccuccgccucccucgccaucuccggccuccaguccgaggacgaggccgacuacuacugcgccgccugggacgacucccucaacggcuucugggucuucggcggcggcaccaagcucaccguccucggccagcccaaggccgcccccuccgucacccucuucccccccuccuccgaggagcuccaggccaacaaggccacccucgucugccucaucuccgacuucuaccccggcgccgucaccgucgccuggaaggccgacuccucccccgucaaggccggcgucgagaccaccacccccuccaagcaguccaacaacaaguacgccgccuccuccuaccucucccucacccccgagcaguggaagucccacaaguccuacuccugccaggucacccacgagggcuccaccgucgagaagaccgucgcccccaccgagugcucc

SEQ ID NO: 20423 - RNA, 651 nt, Artificial Sequence
  derived and/or modified sequence opt2 from anti-influenza_Chain
uccuacguccucacccagccccccuccgucuccggcacccccggccagcgcgucaucaucuccugcuccggcuacuccuccaacaucggcuccaacaccgucaacugguaccagcaguuccccggcaccgccccccgccuccucaucuacgccaacaaccagcgcccccccggcguccccgaccgcuucuccggcuccaaguccggcaccuccgccucccucgccaucuccggccuccaguccgacgacgaguccgacuacuacugcgccgccugggacgacucccucaacggccacugggucuucggcggcggcaccaagcucaccguccucggccagcccaaggccgcccccuccgucacccucuucccccccuccuccgaggagcuccaggccaacaaggccacccucgucugccucaucuccgacuucuaccccggcgccgucaccgucgccuggaaggccgacuccucccccgucaaggccggcgucgagaccaccacccccuccaagcaguccaacaacaaguacgccgccuccuccuaccucucccucacccccgagcaguggaagucccaccgcuccuacuccugccaggucacccacgagggcuccaccgucgagaagaccgucgcccccaccgagugcucc

SEQ ID NO: 20424 - RNA, 654 nt, Artificial Sequence
  derived and/or modified sequence opt2 from anti-influenza_Chain
uccuacguccucacccagccccccuccgucuccgucgcccccggccagaccgcccgcaucaccugcggcggcaacaacaucggcuccaaguccguccacugguaccagcagaagcccggccaggcccccguccucgucgucuacgacgacuccgaccgccccuccggcauccccgagcgcuucuccggcuccaacuccggcaacaccgccacccucaccaucucccgcgucgaggccggcgacgaggccgacuacuacugccaggucugggacuccuccuccgaccacgccgucuucggcggcggcacccagcucaccguccucggcgccgccgccggccagcccaaggccgcccccuccgucacccucuucccccccuccuccgaggagcuccaggccaacaaggccacccucgucugccucaucuccgacuucuaccccggcgccgucaccgucgccuggaaggccgacuccucccccgucaaggccggcgucgagaccaccacccccuccaagcaguccaacaacaaguacgccgccuccuccuaccucucccucacccccgagcaguggaagucccaccgcuccuacuccugccaggucacccacgagggcuccaccgucgagaagaccgucgcccccaccgagugcucc

SEQ ID NO: 20425 - RNA, 654 nt, Artificial Sequence
  derived and/or modified sequence opt2 from anti-influenza_Chain
caguccgucgucacccagccccccuccgucuccgucgcccccggccagaccgcccgcaucaccugcggcggcaacaacaucggcuccaaguccguccacugguaccagcagaagcccggccaggcccccguccucgucgucuacgacgacuccgaccgccccuccggcauccccgagcgcuucuccggcuccaacuccggcaacaccgccacccucaccaucucccgcgucgaggccggcgacgaggccgacuacuacugccaggucugggacuccuccuccgaccacuacgucuucggcaccggcaccaaggucaccguccucggcgccgccgccggccagcccaaggccgcccccuccgucacccucuucccccccuccuccgaggagcuccaggccaacaaggccacccucgucugccucaucuccgacuucuaccccggcgccgucaccgucgccuggaaggccgacuccucccccgucaaggccggcgucgagaccaccacccccuccaagcaguccaacaacaaguacgccgccuccuccuaccucucccucacccccgagcaguggaagucccaccgcuccuacuccugccaggucacccacgagggcuccaccgucgagaagaccgucgcccccaccgagugcucc

SEQ ID NO: 20426 - RNA, 654 nt, Artificial Sequence
  derived and/or modified sequence opt2 from anti-influenza_Chain
cucucccgcaucaaccacuucgagaagauccagaucauccccaaguccuccugguccgaccacgaggccuccuccggcgucuccuccgccugccccuaccagggcacccccuccuucuuccgcaacgucgucuggcucaucaagaagaacaacaccuaccccaccaucaagcgcuccuacaacaacaccaaccaggaggaccuccucauccucuggggcauccaccacuccaacgacgccgccgagcagaccaagcucuaccagaaccccaccaccuacaucuccgucggcaccuccacccucaaccagcgccucguccccaagaucgccacccgcuccaaggucaacggccagaacggccgcauggacuucuucuggaccauccucaagcccaacgacgccaucaacuucgaguccaacggcaacuucaucgcccccgaguacgccuacaagaucgucaagaagggcgacuccgccaucgucaaguccgaggucgaguacggcaacugcaacaccaagugccagacccccaucggcgccaucaacuccuccaugcccuuccacaacauccacccccucaccaucggcgagugccccaaguacgucaaguccaacaagcucguccucgccaccggccuccgcaacuccccccuc

SEQ ID NO: 20427 - RNA, 657 nt, Artificial Sequence
  derived and/or modified sequence opt2 from anti-influenza_Chain
uccuccgagcucacccagccccccuccgccuccggcacccccggccagcgcgucaccaucuccugcuccggcuccaccuccaacaucggcuacaaccccgucuccugguaccagcagguccccggcaccgcccccaagcuccucaucuacuccaacaccgagcgccccuccggcguccccgaccgcuucuccggcuccaaguccggcaccuccgccucccucgccaucuccggccuccaguccgaggacgaggccgacuacuacugcgccgccugggacgacacccucaacggccccgucuucggcggcggcaccaaggucaccguccucggccagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 20428 - RNA, 657 nt, Artificial Sequence; identical to SEQ ID NO: 16308
  derived and/or modified sequence opt2 from anti-influenza_Chain

SEQ ID NO: 20429 - RNA, 660 nt, Artificial Sequence
  derived and/or modified sequence opt2 from anti-influenza_Chain
uccuacguccucacccagccccccuccgccuccggcacccccggccagcgcgucaccaucuccugcuccggcuccaccuucaacaucggcuccaacgccgucgacugguaccgccagcuccccggcaccgcccccaagcuccucaucuacuccaacaaccagcgccccuccggcguccccgaccgcuucuccggcucccgcuccggcaccuccgccucccucgccaucuccggccuccaguccgaggacgaggccgacuacuacugcgccgccugggacgacauccucaacguccccgucuucggcggcggcaccaagcucaccguccucggcgccgccgccggccagcccaaggccgcccccuccgucacccucuucccccccuccuccgaggagcuccaggccaacaaggccacccucgucugccucaucuccgacuucuaccccggcgccgucaccgucgccuggaaggccgacuccucccccgucaaggccggcgucgagaccaccacccccuccaagcaguccaacaacaaguacgccgccuccuccuaccucucccucacccccgagcaguggaagucccaccgcuccuacuccugccaggucacccacgagggcuccaccgucgagaagaccgucgcccccaccgagugcucc

SEQ ID NO: 20430 - RNA, 660 nt, Artificial Sequence
  derived and/or modified sequence opt2 from anti-influenza_Chain
caguccgcccucacccagcccgccgccgucuccggcucccccggccaguccaucaccaucuccugcaccggcaccuccuccgacgucggcggcuacaacuacgucuccugguaccagcagcaccccggcaaggcccccaagcucaugaucuacgaggucuccaaccgccccuccggcgucuccaaccgcuucuccggcuccaaguccggcaacaccgccucccucaccaucuccggccuccaggccgaggacgaggccgacuacuacugcuccuccuacaccuccuccuccaccuacgucuucggcaccggcaccaaggucaccguccucggcgccgccgccggccagcccaaggccgcccccuccgucacccucuucccccccuccuccgaggagcuccaggccaacaaggccacccucgucugccucaucuccgacuucuaccccggcgccgucaccgucgccuggaaggccgacuccucccccgucaaggccggcgucgagaccaccacccccuccaagcaguccaacaacaaguacgccgccuccuccuaccucucccucacccccgagcaguggaagucccaccgcuccuacuccugccaggucacccacgagggcuccaccgucgagaagaccgucgcccccaccgagugcucc

SEQ ID NO: 20431 - RNA, 660 nt, Artificial Sequence
  derived and/or modified sequence opt2 from anti-influenza_Chain
uccuacguccucacccagccccccuccgucuccggcacccccggccagcgcgucaccaucuccugcuccggcucccgcuccaacgucggcgacaacuccgucuacugguaccagcacguccccgagauggcccccaagcuccucgucuacaagaacacccagcgccccuccggcguccccgcccgcuucuccggcuccaaguccggcaccuccgccucccucgccaucaucggccuccaguccggcgacgaggccgacuacuacugcgucgccugggacgacuccgucgacggcuacgucuucggcuccggcaccaaggucaccguccucggcgccgccgccggccagcccaaggccgcccccuccgucacccucuucccccccuccuccgaggagcuccaggccaacaaggccacccucgucugccucaucuccgacuucuaccccggcgccgucaccgucgccuggaaggccgacuccucccccgucaaggccggcgucgagaccaccacccccuccaagcaguccaacaacaaguacgccgccuccuccuaccucucccucacccccgagcaguggaagucccaccgcuccuacuccugccaggucacccacgagggcuccaccgucgagaagaccgucgcccccaccgagugcucc

SEQ ID NO: 20432 - RNA, 660 nt, Artificial Sequence
  derived and/or modified sequence opt2 from anti-influenza_Chain
uccuacguccucacccagccccccuccgccuccggcacccccggccagcgcgucaccaucuccugcuccggcuccuccuccaacaucggcuccaacuacgucuacugguaccagcagcuccccggcaccgcccccaagcuccucaucuaccgcgacggccagcgccccuccggcguccccgaccgcuucuccggcuccaaguccggcaccuccgccucccucgccaucuccggccuccgcuccgacgacgaggccgacuacuacugcgccaccugggacgacaaccucuccggccccgucuucggcggcggcaccaagcucaccguccucggcgccgccgccggccagcccaaggccgcccccuccgucacccucuucccccccuccuccgaggagcuccaggccaacaaggccacccucgucugccucaucuccgacuucuaccccggcgccgucaccgucgccuggaaggccgacuccucccccgucaaggccggcgucgagaccaccacccccuccaagcaguccaacaacaaguacgccgccuccuccuaccucucccucacccccgagcaguggaagucccaccgcuccuacuccugccaggucacccacgagggcuccaccgucgagaagaccgucgcccccaccgagugcucc

SEQ ID NO: 20433 - RNA, 660 nt, Artificial Sequence
  derived and/or modified sequence opt2 from anti-influenza_Chain
caguccgcccucacccagcccgccuccgucuccggcucccccggccaguccaucaccaucuccugcaccggcaccuccuccgacgucggcggcuacaacuacgucuccugguaccagcagcaccccggcaaggcccccaagcucaugaucuacgaggucuccaaccgccccuccggcgucuccaaccgcuucuccggcuccaaguccggcaacaccgccucccucaccaucuccggccuccaggccgaggacgaggccgacuacuacugcuccuccuacaccuccuccuccacccucgucuucggcaccggcaccaaggucaccguccucggcgccgccgccggccagcccaaggccgcccccuccgucacccucuucccccccuccuccgaggagcuccaggccaacaaggccacccucgucugccucaucuccgacuucuaccccggcgccgucaccgucgccuggaaggccgacuccucccccgucaaggccggcgucgagaccaccacccccuccaagcaguccaacaacaaguacgccgccuccuccuaccucucccucacccccgagcaguggaagucccaccgcuccuacuccugccaggucacccacgagggcuccaccgucgagaagaccgucgcccccaccgagugcucc

SEQ ID NO: 20434 - RNA, 660 nt, Artificial Sequence
  derived and/or modified sequence opt2 from anti-influenza_Chain
accguccucacccagccccccuccgucuccggcgcccccggccagcgcgucaccaucuccugcaccggcuccuccuccaacaucggcgccggcuacgacguccacugguaccagcagcuccccggcaccgcccccaagcuccucaucuacggcaacuccaaccgccccuccggcguccccgaccgcuucuccggcuccaaguccggcaccuccgccacccucggcaucaccggccuccagaccggcgacgaggccgacuacuacugcggcaccugggacuccucccucuccgccuacgucuucggcaccggcaccaaggucaccguccucggcgccgccgccggccagcccaaggccgcccccuccgucacccucuucccccccuccuccgaggagcuccaggccaacaaggccacccucgucugccucaucuccgacuucuaccccggcgccgucaccgucgccuggaaggccgacuccucccccgucaaggccggcgucgagaccaccacccccuccaagcaguccaacaacaaguacgccgccuccuccuaccucucccucacccccgagcaguggaagucccaccgcuccuacuccugccaggucacccacgagggcuccaccgucgagaagaccgucgcccccaccgagugcucc

SEQ ID NO: 20435 - RNA, 663 nt, Artificial Sequence
  derived and/or modified sequence opt2 from anti-influenza_Chain
caguccguccucacccagccccccuccgucuccgccgcccccggccagaaggucaccaucuccugcuccggcuccuccuccaacaucggcaacgacuacgucuccugguaccagcagcuccccggcaccgcccccaagcuccucaucuacgacaacaacaagcgccccuccggcauccccgaccgcuucuccggcuccaaguccggcaccuccgccacccucggcaucaccggccuccagaccggcgacgaggccaacuacuacugcgccaccugggaccgccgccccaccgccuacgucgucuucggcggcggcaccaagcucaccguccucggcgccgccgccggccagcccaaggccgcccccuccgucacccucuucccccccuccuccgaggagcuccaggccaacaaggccacccucgucugccucaucuccgacuucuaccccggcgccgucaccgucgccuggaaggccgacuccucccccgucaaggccggcgucgagaccaccacccccuccaagcaguccaacaacaaguacgccgccuccuccuaccucucccucacccccgagcaguggaagucccaccgcuccuacuccugccaggucacccacgagggcuccaccgucgagaagaccgucgcccccaccgagugcucc

SEQ ID NO: 20436 - RNA, 675 nt, Artificial Sequence
  derived and/or modified sequence opt2 from anti-influenza_Chain
auggucggcuucacccccgucgcccucgccgcccucgccgccaccggcgcccucgccuuccccgccggcaacgccaccgagcucgagaagcgccagaccacccccaacuccgagggcuggcacgacggcuacuacuacuccuggugguccgacggcggcgcccaggccaccuacaccaaccucgagggcggcaccuacgagaucuccuggggcgacggcggcaaccucgucggcggcaagggcuggaaccccggccucaacgcccgcgccauccacuucgagggcgucuaccagcccaacggcaacuccuaccucgccgucuacggcuggacccgcaacccccucgucgaguacuacaucgucgagaacuucggcaccuacgaccccuccuccggcgccaccgaccucggcaccgucgagugcgacggcuccaucuaccgccucggcaagaccacccgcgucaacgcccccuccaucgacggcacccagaccuucgaccaguacugguccguccgccaggacaagcgcaccuccggcaccguccagaccggcugccacuucgacgccugggcccgcgccggccucaacgucaacggcgaccacuacuaccagaucgucgccaccgagggcuacuucuccuccggcuacgcccgcaucaccgucgccgacgucggc

SEQ ID NO: 20437 - RNA, 687 nt, Artificial Sequence
  derived and/or modified sequence opt2 from anti-influenza_Chain
cgcuccgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 20438 - RNA, 696 nt, Artificial Sequence
  derived and/or modified sequence opt2 from anti-influenza_Chain
cacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccgccaacgaccucugcuaccccggcaacuucaacgacuacgaggagcucaagcaccuccucucccgcaucaaccacuucgagaagauccagaucauccccaaguccuccugguccgaccacgaggccuccuccggcgucuccuccgccugccccuaccagggcacccccuccuucuuccgcaacgucgucuggcucaucaagaagaacaacaccuaccccaccaucaagcgcuccuacaacaacaccaaccaggaggaccuccucauccucuggggcauccaccacuccaacgacgccgccgagcagaccaagcucuaccagaaccccaccaccuacaucuccgucggcaccuccacccucaaccagcgccucguccccaagaucgccacccgcuccaaggucaacggccagaacggccgcauggacuucuucuggaccauccucaagcccaacgacgccaucaacuucgaguccaacggcaacuucaucgcccccgaguacgccuacaagaucgucaagaag

SEQ ID NO: 20439 - RNA, 699 nt, Artificial Sequence
  derived and/or modified sequence opt2 from anti-influenza_Chain
augcgccccuccauccaguuccucggccuccuccucuucuggcuccacggcggccagugcgacauccagaugacccagucccccuccucccucuccgccucccucggcggcaacgucaccaucaccugcaaggccucccaggacaucaacaaguacaucgccugguaccagcacaagcccggcaagggcccccgccucgucauccacuacaccuccacccuccagcccggcauccccucccgcuucuccggcuccggcuccggcaccgacuacuccuucuccaucuccaaccucgagcccgaggacaucgccaccuacuacugccuccaguacgacauccucuacaccuucggcggcggcaccaagcucgagaucaagcgcgccgacgccgcccccaccgucuccaucuucccccccuccuccgagcagcucaccuccggcggcgccuccgucgucugcuuccucaacaacuucuaccccaaggacaucaacgucaaguggaagaucgacggcuccgagcgccagaacggcguccucaacuccuggaccgaccaggacuccaaggacuccaccuacuccauguccuccacccucacccucaccaaggacgaguacgagcgccacaacuccuacaccugcgaggccacccacaagaccuccaccucccccaucgucaaguccuucaaccgcaacgagugc

SEQ ID NO: 20440 - RNA, 702 nt, Artificial Sequence
  derived and/or modified sequence opt2 from anti-influenza_Chain
augauguccuccgcccaguuccucggccuccuccuccucugcuuccagggcacccgcugcgacauccagaugacccagaccuccuccucccucuccgccucccucggcgaccgcgucaccaucuccugccgcgccucccaggacauccgcaacuaccucaacugguaccagcagaagcccgacggcaccgucaagcuccucaucuacuacaccucccgccuccacuccggcguccccucccgcuucuccgacuccggcuccggcaccgacuacucccucaccaucuccaaccucgagcaggaggaccucgccaccuacuucugccagcagaccuacacccuccccuggaccuucggcggcggcaccaagcucgagaucaagcgcgccgacgccgcccccaccgucuccaucuucccccccuccuccgagcagcucaccuccggcggcgccuccgucgucugcuuccucaacaacuucuaccccaaggacaucaacgucaaguggaagaucgacggcuccgagcgccagaacggcguccucaacuccuggaccgaccaggacuccaaggacuccaccuacuccauguccuccacccucacccucaccaaggacgaguacgagcgccacaacuccuacaccugcgaggccacccacaagaccuccaccucccccaucgucaaguccuucaaccgcaacgagugc

SEQ ID NO: 20441 - RNA, 702 nt, Artificial Sequence
  derived and/or modified sequence opt2 from anti-influenza_Chain
auggaggcccccgcccagcuccucuuccuccuccuccucuggcuccccgacaccaccggcgagaucguccucacccagucccccgccacccucucccucucccccggcgagcgcgccacccucuccugccgcgccuccgagaacaucuggaacaaccucgccugguaccagcagaagcccggccaggccccccgccuccucaucuccggcgccuccaccggcgccaccggcguccccucccgcuuccgcggcuccggcucccgcaccgaguucacccucaccaucuccucccuccaguccgaggacuucgccaucuacuucugccagcaguacaacuccuggccccgcaccuucggccccggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 20442 - RNA, 705 nt, Artificial Sequence
  derived and/or modified sequence opt2 from anti-influenza_Chain
auggagacccccgcccagcuccucuuccuccuccuccucuggcuccccgacaccaccggcgagaucguccucacccagucccccggcacccucucccucucccccggcgagcgcgccacccucuccugccgcgccucccagucccucuccuccuccucccucgucugguaccagcagaagcccggccaggccccccgccuccucaucuacggcgccuccucccgcgccaccggcauccccgaccgcuucuccggcuccggcuccggcaccgacuucacccucaccaucucccgccucgagcccgaggacuucgccgucuacuacugccagcaguacggcaacucccccuacaccuucggccagggcacccaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 20443 - RNA, 705 nt, Artificial Sequence
  derived and/or modified sequence opt2 from anti-influenza_Chain
auggagacccccgcccagcuccucuuccuccuccuccucuggcuccccgacaccaccggcgagaccguccucacccagucccccggcacccucucccucucccccggcgagcgcgccacccucuccugccgcgccucccaguccgucuccaucuccuaccucgccugguaccagcgcaagcccggccaggccccccgccuccucaucuacggcgccucccgccgcgccaccggcauccccgaccgcuucuccggcuccggcuccggcaccgacuucacccucaccaucucccgccucgagcccgaggacuucgccgucuacuacugccagcaguacggcuccucccccuacaccuucggccagggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 20444 - RNA, 705 nt, Artificial Sequence
  derived and/or modified sequence opt2 from anti-influenza_Chain
auggccuggaugaugcuccuccucacccuccucauccacugcaccggcuccugggcccaguccguccucacccagccccccuccgucuccgccgcccccggccagaaggucaccaucuccugcuccggcuccuccuccaacaucggcaagaacuacgucuccugguaccagcagcuccccggcaccgcccccaagcuccucaucuacgacaacgacaagcgccccuccggcauccccgaccgcuucuccggcuccaaguccggcaccuccgccacccucggcaucaccggccuccagaccggcgacgaggccgacuaccacugcggcgccugggacuccucccucaacggcggcgucuucggcggcggcaccaaggucaccguccucggccagcccaaggccgcccccuccgucacccucuucccccccuccuccgaggagcuccaggccaacaaggccacccucgucugccucaucuccgacuucuaccccggcgccgucaccgucgccuggaaggccgacuccucccccgucaaggccggcgucgagaccaccacccccuccaagcaguccaacaacaaguacgccgccuccuccuaccucucccucacccccgagcaguggaagucccaccgcuccuacuccugccaggucacccacgagggcuccaccgucgagaagaccgucgcccccaccgagugcucc

SEQ ID NO: 20445 - RNA, 714 nt, Artificial Sequence
  derived and/or modified sequence opt2 from anti-influenza_Chain
augaugaagaagaaguccugguucacccucaugaucaccggcgucaucucccucuucuucuccgucuccgccuucgccggcaacgucuucugggagccccucuccuacuucaacuccuccaccuggcagaaggccgacggcuacuccaacggccagauguucaacugcaccuggcgcgccaacaacgucaacuucaccaacgacggcaagcucaagcucucccucaccucccccgccaacaacaaguucgacugcggcgaguaccgcuccaccaacaacuacggcuacggccucuacgaggucuccaugaagcccgccaagaacaccggcaucgucuccuccuucuucaccuacaccggccccucccacggcacccagugggacgagaucgacaucgaguuccucggcaaggacaccaccaagguccaguucaacuacuacaccaacggcgucggcggccacgagaagaucaucaaccucggcuucgacgccuccaccuccuuccacaccuacgccuucgacuggcagcccggcuacaucaagugguacgucgacggcguccucaagcacaccgccaccaccaacauccccuccacccccggcaagaucaugaugaaccucuggaacggcaccggcgucgacuccuggcucggcuccuacaacggcgccaacccccucuacgccgaguacgacugggucaaguacaccuccaac

SEQ ID NO: 20446 - RNA, 729 nt, Artificial Sequence
  derived and/or modified sequence opt2 from anti-influenza_Chain
cagguccagcucguccaguccggcgccgaggucaagaagcccggcuccuccgucaaggucuccugcaaggccuccggcggcaccuucuccuccuacgccaucuccuggguccgccaggcccccggccagggccucgaguggaugggcggcaucaugggcauguucggcaccaccaacuacgcccagaaguuccagggccgcgucaccaucaccgccgacgaguucaccuccgccgccuacauggagcuccgcucccuccgcuccgaggacaccgccgucuacuacugcgcccgcuccuccggcuacuaccccgaguacuuccaggacuggggccagggcacccucgucaccgucuccuccggcaccggcggcuccggcggcaccggcuccggcaccggcggcuccacccaguccguccucacccagccccccuccgaguccgucucccccggccagaccgccuccgucaccugcuccggccacaagcucggcgacaaguacgucuccugguaccagcagaagcccggccagucccccguccuccucaucuaccaggacaaccgccgccccuccggcauccccgagcgcuucaucggcuccaacuccggcaacaccgccacccucaccaucuccggcacccaggcccucgacgaggccgacuacuacugccaggccugggacuccuccaccgccgucuucggcggcggcaccaagcucaccguccucggc

SEQ ID NO: 20447 - RNA, 729 nt, Artificial Sequence
  derived and/or modified sequence opt2 from anti-influenza_Chain
cagguccagcucguccaguccggcgccgaggucaagaagcccggcuccuccgucaaggucuccugcaaggccuccggcggccccuuccgcaacuucgccaucaacuggguccgccaggcccccggccagggccucgaguggaugggcggcaucaucgccgucuucggcaccaccaaguacgcccacaaguuccagggccgcgucaccaucaccgccgacgacuccaccaacaccgccuacauggagcucggcucccucaaguccgaggacaccgccgucuacuacugcgcccgcggcccccacuacuacuccuccuacauggacgucuggggcgagggcaccaccgucaccgucuccuccggcaccggcggcuccggcggcaccggcuccggcaccggcggcuccaccgacauccagcucacccagucccccuccucccucuccgccuccgucggcgaccgcgucaccaucaccugccgcgccucccagggcaucuccaccuaccucgccugguaccagcagaagcccggcaagguccccaagcuccucaucuacgccgccuccacccuccaguccggcguccccucccgcuucuccggcuccggcuccggcaccgacuucacccucaccaucuccucccuccagcccgaggacgucgccaccuacuacugccagaaguacaacuccgcccccuccuucggccccggcaccaaggucgacaucaagcgc

SEQ ID NO: 20448 - RNA, 729 nt, Artificial Sequence
  derived and/or modified sequence opt2 from anti-influenza_Chain
auguccuaccgcgucaagcgcaugcucaugcuccucgucaccggccucuuccucucccucuccaccuucgccgccuccgccuccgcccagaccggcggcuccuucuacgagcccuucaacaacuacaacaccggccucuggcagaaggccgacggcuacuccaacggcaacauguucaacugcaccuggcgcgccaacaacgucuccaugaccucccucggcgagaugcgccucucccucaccucccccuccuacaacaaguucgacugcggcgagaaccgcuccguccagaccuacggcuacggccucuacgaggucaacaugaagcccgccaagaacgucggcaucgucuccuccuucuucaccuacaccggccccaccgacggcacccccugggacgagaucgacaucgaguuccucggcaaggacaccaccaagguccaguucaacuacuacaccaacggcgucggcaaccacgagaagaucgucaaccucggcuucgacgccgccaacuccuaccacaccuacgccuucgacuggcagcccaacuccaucaagugguacgucgacggccagcucaagcacaccgccaccacccagaucccccagacccccggcaagaucaugaugaaccucuggaacggcgccggcgucgacgaguggcucggcuccuacaacggcgucaccccccucucccgcucccuccacuggguccgcuacaccaagcgc

SEQ ID NO: 20449 - RNA, 735 nt, Artificial Sequence
  derived and/or modified sequence opt2 from anti-influenza_Chain
cagguccagcuccagcaguccggcgccgaggucaagaagcccggcuccuccgucaaggucuccugcaaggucuccggcgucaucuucuccggcuccgccaucuccuggguccgccaggcccccggccagggccucgaguggaugggcggcaucuccccccucuucggcaccaccaacuacgcccagaaguuccagggccgcgucaccaucaccgccgaccaguccaccaacaccaccuacauggaggucaacucccuccgcuacgaggacaccgccgucuacuucugcgcccgcggccccaaguacuacuccgaguacauggacgucuggggcaagggcaccaccgucaccgucuccuccggcaccggcggcuccggcggcaccggcuccggcaccggcggcuccaccgacauccagaugacccagucccccuccucccucuccgccuccgucggcgaccgcgucaccaucaccugccgcgccucccagggcaucuccuccuaccucgccugguaccagcagaagcccggcaagguccccacccuccucaucuacgacgccuccacccuccgcuccggcguccccucccgcuucuccggcuccggcuccgccaccgacuucacccucaccaucuccucccuccagcccgaggacgucgccaccuacuacugccagcgcuacaacuccgccccccccaucaccuucggccagggcacccgccucgagaucaagcgc

SEQ ID NO: 20450 - RNA, 735 nt, Artificial Sequence
  derived and/or modified sequence opt2 from anti-influenza_Chain
gagguccagcucgucgaguccggcgccgaggucaagaagcccggcuccuccgucaaggucuccugcaaggccuccggcggcaccuucuccuccuacggcaucuccuggguccgccaggcccccggccagggccucgaguggaugggcgacaucaucggcauguucggcuccaccaacuacgcccagaacuuccagggccgccucaccaucaccgccgacgaguccaccuccaccgccuacauggagcucuccucccuccgcuccgaggacaccgccgucuacuacugcgcccgcuccuccggcuacuaccccgccuaccucccccacuggggccagggcacccucgucaccgucuccuccggcaccggcggcuccggcggcaccggcuccggcaccggcggcuccaccgagaucguccucacccagucccccggcacccucucccucucccccggcgagcgcgccacccucuccugccgcgccucccaguccgucuccuccuccuaccucgccugguaccagcagaagcccggccaggccccccgccuccucaucuacggcgccuccucccgcgccaccggcauccccgaccgcuucuccggcuccggcuccggcaccgacuucacccucaccaucucccgccucgagcccgaggacuucgccgucuacuacugccagcaguacggcuccuccccccgcaccuucggcggcggcaccaaggucgagaucaagcgc

SEQ ID NO: 20451 - RNA, 735 nt, Artificial Sequence
  derived and/or modified sequence opt2 from anti-influenza_Chain
gagguccagcucgucgaguccggcgccgaggucaagaagcccggcuccuccgucaaggucuccugcaaggccuccggcggcaccuucuccuccuacgccaucuccuggguccgccaggcccccggccagggccucgaguggaugggcggcaucaucggcauguucggcaccgccaacuacgcccagaaguuccagggccgcgucaccaucaccgccgacgaguucaccuccaccgccuacauggagcucuccucccuccgcuccgaggacaccgccgucuacuacugcgcccgcggcaacuacuacuacgaguccucccucgacuacuggggccagggcacccucgucaccgucuccuccggcaccggcggcuccggcggcaccggcuccggcaccggcggcuccacccaguccgucgucacccagccccccuccgucuccgucgcccccggccagaccgcccgcaucaccugcggcggcaacaacaucggcuccaaguccguccacugguaccagcagaagcccggccaggcccccguccucgucgucuacgacgacuccgaccgccccuccggcauccccgagcgcuucuccggcuccaacuccggcaacaccgccacccucaccaucucccgcgucgaggccggcgacgaggccgacuacuacugccaggucugggacuccuccuccgaccacuacgucuucggcaccggcaccaaggucaccguccucggc

SEQ ID NO: 20452 - RNA, 735 nt, Artificial Sequence
  derived and/or modified sequence opt2 from anti-influenza_Chain
gagguccagcucguccaguccggcgccgaggucaagaagcccggcgccuccgucaaggucuccugcaaggccuccggcuacaccuucaccggcuacuacgucuacuggguccgccaggcccccggccagggccucgaguggaugggcuggaucuccgccuacaacggcaacaccaacuacgcccagaaguuccagggccgcgucaccaucaccgccgacaaguccaccuccaccgccuacauggagcucuccucccuccgcuccgaggacaccgccgucuacuacugcgcccgcucccgcucccucgacgucuggggccagggcaccaccgucaccgucuccuccggcaccggcggcuccggcggcaccggcuccggcaccggcggcuccaccgacgucgucaugacccagucccccgacucccucgccgucucccucggcgagcgcgccaccaucaacugcaaguccucccaguccguccucuacuccuccaacaacaagaacuaccucgccugguaccagcagaagcccggccagccccccaagcuccucaucuacugggccuccacccgcgaguccggcguccccgaccgcuucuccggcuccggcuccggcaccgacuucacccucaccaucuccucccuccaggccgaggacgucgccgucuacuacugccagcaguacuacuccaccccccucaccuucggcggcggcaccaaggucgacaucaagcgc

SEQ ID NO: 20453 - RNA, 735 nt, Artificial Sequence
  derived and/or modified sequence opt2 from anti-influenza_Chain
gagguccagcucgucgagaccggcgccgaggucaagaagcccggcuccuccgucaagguccccugcaaguccuccggcucccccuuccgcuccaacgccgucuccuggguccgccaggcccccggccagggccucgagugggucggcggcauccucggcgucuucggcucccccuccuacgcccagaaguuccagggccgcgucaccaucaccgccgacgaguccaccaacaccguccacauggagcuccgcggccuccgcuccgaggacaccgccgucuacuacugcgcccgcggccccaccuacuacuacuccuacauggacgucuggggcaagggcaccaccgucaccgucuccuccggcaccggcggcuccggcggcaccggcuccggcaccggcggcuccaccuccuacguccucacccagccccccuccgaguccgucgcccccggccagaccgcccgcaucaccugcggcggcaacaacaucggccgcaacuccguccacugguaccagcagaagcccggccaggcccccguccucgucgucuacgacgacuccgaccgccccuccggcauccccgagcgcuucuccggcuccaaguccggcaacaccgccacccucaucaucucccgcgucgaggucggcgacgaggccgacuacuacugccaggucuggcacuccuccuccgaccacuacgucuucggcaccggcaccaaggucaccguccucggc

SEQ ID NO: 20454 - RNA, 735 nt, Artificial Sequence
  derived and/or modified sequence opt2 from anti-influenza_Chain
cagaugcagcucguccaguccggcgccgaggucaagaagcccggcuccuccgucaaggucuccugcaaggccuccggcggcaccuucuccuccuacgccaucuccuggguccgccaggcccccggccagggccucgaguggaugggcggcaucuucggcauguucggcaccgccaacuacgcccagaaguuccagggccgcgucaccaucaccgccgacgaguucaccuccgccgccuacauggagcucuccucccucggcuccgaggacaccgccauguacuacugcgcccgcuccuccggcuacuacccccaguacuuccaggacuggggccagggcacccucgucaccgucuccuccggcaccggcggcuccggcggcaccggcuccggcaccggcggcuccaccgagaucgucaugacccagucccccggcacccucucccucucccccggccagcgcgccacccucuccugccgcgccucccaguccgucuccuccuccuaccucgccugguaccagcagaagcccggccaggccccccgccuccucauguacggcgccuccucccgcgccaccggcauccccgaccgcuucuccggcuccggcuccggcaccgacuucacccucaccaucucccgccucgagcccgaggacuucgccgucuacuacugccagcaguacggcuccuccucccucaccuucggcggcggcaccaagcucgagaucaagcgc

SEQ ID NO: 20455 - RNA, 735 nt, Artificial Sequence
  derived and/or modified sequence opt2 from anti-influenza_Chain
cagguccagcucguccaguccggcgccgaggucaagaagcccggcuccuccgucaaggucuccugcaaggccuccggcgucaccuucuccuacuacgccauguccuggguccgccaggcccccggccagggccucgaguggaugggcggcaucucccccauguucggcaccaccaccuacgcccagaaguuccagggccgcgucaccaucaccgccgacgacuccaccuccaccgccuacauggagguccgcucccuccgcuccgaggacaccgccgucuacuacugcgcccgcuccuccaacuacuacgacuccgucuacgacuacuggggccagggcacccucgucaccgucuccuccggcaccggcggcuccggcggcaccggcuccggcaccggcggcuccacccaguccgucgucacccagccccccuccgaguccgucgcccccggccagaccgcccgcaucaccugcggcggccacaacaucggcuccaacuccguccacugguaccagcagaagcccggccaggcccccguccucgucgucuacgacaacuccgaccgccccuccggcauccccgagcgcuucuccggcuccaacuccggcaacaccgccacccucaccaucucccgcgucgaggccggcgacgaggccgacuacuacugccaggucuggggcuccuccuccgaccacuacgucuucggcaccggcaccaaggucaccguccucggc

SEQ ID NO: 20456 - RNA, 738 nt, Artificial Sequence
  derived and/or modified sequence opt2 from anti-influenza_Chain
cagguccagcucguccaguccggcggcggccucgucaagcccggcggcucccuccgccucuccugcgccgccuccggcuucaccuucuccuccuacuccaugaacuggguccgccaggcccccggcaagggccucgagugggucuccuccaucuccuccuccuccuccuacaucuacuacgucgacuccgucaagggccgcuucaccaucucccgcgacaacgccaagaacucccucuaccuccagaugaacucccuccgcgccgaggacaccgccgucuacuacugcgcccgcggcggcggcuccuacggcgccuacgagggcuucgacuacuggggccagggcacccucgucaccgucuccuccggcaccggcggcuccggcggcaccggcuccggcaccggcggcuccaccgagaucguccucacccagucccccggcacccucucccucucccccggcgagcgcgccacccucuccugccgcgccucccagcgcgucuccuccuaccucgccugguaccagcagaagcccggccaggccccccgccuccucaucuacggcgccuccacccgcgccgccggcauccccgaccgcuucuccggcuccggcuccggcaccgacuucacccucaccaucucccgccucgagcccgaggacuccgccgucuacuacugccagcaguacggccgcaccccccucaccuucggcggcggcaccaaggucgagaucaagcgc

SEQ ID NO: 20457 - RNA, 738 nt, Artificial Sequence
  derived and/or modified sequence opt2 from anti-influenza_Chain
gagguccagcucgucgaguccggcgccgaggucaagaagcccggcuccuccgucaaggucuccugcaaggccuccggcggccccuuccgcuccuacgccaucuccuggguccgccaggcccccggccagggccccgaguggaugggcggcaucauccccaucuucggcaccaccaaguacgcccccaaguuccagggccgcgucaccaucaccgccgacgacuucgccggcaccgucuacauggagcucuccucccuccgcuccgaggacaccgccauguacuacugcgccaagcacaugggcuaccagguccgcgagaccauggacgucuggggcaagggcaccaccgucaccgucuccuccggcaccggcggcuccggcggcaccggcuccggcaccggcggcuccaccuccuacguccucacccagccccccuccgucuccgucgcccccggccagaccgcccgcaucaccugcggcggcaacaacaucggcuccaaguccguccacugguaccagcagaagcccggccaggcccccguccucgucgucuacgacgacuccgaccgccccuccggcauccccgagcgcuucuccggcuccaacuccggcaacaccgccacccucaccaucucccgcgucgaggccggcgacgaggccgacuacuacugccaggucugggacuccuccuccgaccacgccgucuucggcggcggcacccagcucaccguccucggc

SEQ ID NO: 20458 - RNA, 738 nt, Artificial Sequence
  derived and/or modified sequence opt2 from anti-influenza_Chain
gagguccagcucgucgagaccggcgccgaggucaagaagcccggcgccuccgucaaggucuccugcaaggccuccggcuacaccuucaccuccuacuacaugcacuggguccgccaggcccccggccagggccucgaguggaugggcuggaucaaccccaacuccggcggcaccaacuacgcccagaaguuccagggccgcgucaccaugacccgcgacaccuccaucuccaccgccuacauggagcucucccgccuccgcuccgacgacaccgccgucuacuacugcgcccgcgagggcaaguggggcccccaggccgccuucgacaucuggggccagggcaccauggucaccgucuccuccggcaccggcggcuccggcggcaccggcuccggcaccggcggcuccaccgagaucgucaugacccagucccccggcacccucucccucucccccggcgagcgcgccacccucuccugccgcgccucccaguccgucuccuccuccuaccucgccugguaccagcagaagcccggccaggccccccgccuccucaucuacgacgccuccucccgcgccaccgacauccccgaccgcuucuccggcuccggcuccggcaccgacuucacccucaccaucucccgccucgagcccgaggacuucgccgucuacuacugccagcaguacggcuccucccucuggaccuucggccagggcaccaaggucgagaucaagcgc

SEQ ID NO: 20459 - RNA, 738 nt, Artificial Sequence
  derived and/or modified sequence opt2 from anti-influenza_Chain
gagguccagcucgucgaguccggcggcggccucguccagcccggcggcucccuccgccucuccugcgccgccuccggcuucaccuucuccaucuacgccauguccuggguccgccaggcccccggcaagggccucgagugggucuccgccaucuccuccuccggcgacuccaccuacuacgccgacuccgucaagggccgcuucaccaucucccgcgacaacgcccgcaacacccucuaccuccagaugaacucccuccgcgccgaggacaccgccgucuacuacugcgcccgcgccuacggcuacaccuucgaccccuggggccagggcacccucgucaccgucuccuccggcaccggcggcuccggcggcaccggcuccggcaccggcggcuccaccgagaucguccucacccaguccccccucucccuccccgucacccccggcgagcccgccuccaucuccugccgcuccucccagucccuccuccacuccaacggcuacaacuaccucgacugguaccuccagaagcccggccaguccccccagcuccucaucuaccucggcuccaaccgcgccuccggcguccccgaccgcuucuccggcuccggcuccggcaccgacuucacccucaagaucucccgcgucgaggccgaggacgucggcgucuacuacugcaugcaggcccuccagaccccccucaccuucggcggcggcaccaaggucgagaucaagcgc

SEQ ID NO: 20460 - RNA, 738 nt, Artificial Sequence
  derived and/or modified sequence opt2 from anti-influenza_Chain
gagguccagcucgucgagaccggcgccgaggucaagaagcccggcuccuccgucaaggucuccugcaaggccuccggcggcaccuuccgcacccacgccaucuccuggguccgccaggcccccggccagggccucgaguggaugggcggcaucaucgccaucuucggcaccgccaacuacgcccagaaguuccagggccgcaucaccaucaccgccgacgaguccaccuccaccgccuacauggagcucuccucccuccgcuccgaggacaccgccgucuacuucugcgcccgcggcuccggcuaccacaucuccacccccuucgacaacuggggccagggcacccucgucaccgucuccuccggcaccggcggcuccggcggcaccggcuccggcaccggcggcuccaccuccuacguccucacccagccccccuccgucuccgucgcccccggccagaccgcccgcaucaccugcggcggcaacaacaucggcuccaagggcguccacugguaccagcagaagcccggccaggcccccguccucgucgucuacgacgacuccgaccgccccuccggcauccccgagcgcuucuccggcuccaacuccggcaacaccgccacccucaccaucucccgcgucgaggccggcgacgaggccgacuacuacugccaggucugggacuccuccuccgaccacgucgucuucggcggcggcaccaagcucaccguccucggc

SEQ ID NO: 20461 - RNA, 738 nt, Artificial Sequence
  derived and/or modified sequence opt2 from anti-influenza_Chain
gagguccagcucguccaguccggcgccgaggucaagaagcccggcuccuccgucaaggucuccugcaaggccuccggcggcaucuuccgcuccaacuccaucuccuggguccgccaggcccccggccagggccucgaguggaugggcggcaucuucgcccucuucggcaccaccgacuacgcccagaaguuccagggccgcgucaccaucaccgccgacgaguccuccaccaccgucuaccucgagcucuccucccucaccuccgaggacaccgccgucuacuacugcgcccgcggcuccggcuacaccacccgcaacuacuucgacuacuggggccagggcacccucgucaccgucuccuccggcaccggcggcuccggcggcaccggcuccggcaccggcggcuccaccgagaucguccucacccagucccccggcacccucucccucucccccggcgagcgcgccacccucuccugccgcgccucccaguccgucuccuccaacuaccucggcugguaccagcagaagcccggccaggccccccgccuccucaucuacggcgccuccucccgcgccuccggcauccccgaccgcuucuccggcggcggcuccggcaccgacuucacccucaccaucucccgccucgagcccgaggacuucgccgucuacuacugccagcaguacggcuccuccccccucaccuucggcggcggcaccaaggucgagaucaagcgc

SEQ ID NO: 20462 - RNA, 738 nt, Artificial Sequence
  derived and/or modified sequence opt2 from anti-influenza_Chain
gagguccagcucgucgaguccggcgccgaggucaagaagcccggcuccuccgucaaggucuccugcaaggccuccggcggcaucuucaacuccuacgccaucuccuggguccgccaggcccccggccagggccucgaguggaugggcggcaucaucgccaucuuccacacccccaaguacgcccagaaguuccagggccgcgucaccaucaccgccgacgaguccaccaacaccgccuacauggagcuccgcucccucaaguccgaggacaccgcccucuacuacugcgcccgcggcuccaccuacgacuucuccuccggccucgacuacuggggccagggcacccucgucaccgucuccuccggcaccggcggcuccggcggcaccggcuccggcaccggcggcuccacccaggccggccucacccagccccccuccgucuccgucgcccccggccagaccgcccgcaucaccugcggcggcaacaacaucggcuccaaguccguccacugguaccagcagaagcccggccaggcccccguccucgucgucuacgacgacuccgaccgccccuccggcauccccgagcgcuucuccggcuccaacuccggcaacaccgccacccucaccaucucccgcgucgaggccggcgacgaggccgacuacuacugccaggucugggacuccuccuccgaccacgucgucuucggcggcggcaccaagcucaccguccucggc

SEQ ID NO: 20463 - RNA, 741 nt, Artificial Sequence
  derived and/or modified sequence opt2 from anti-influenza_Chain
cagaugcagcucguccaguccggcgccgaggucaagaagcccggcuccuccgucaaggucuccugcaaggccuccggcggcaccuucuccuccuacgccaucaccuggguccgccaggcccccggccagggccucgaguggaugggcggcaucaucggcauguucggcuccaccaacuacgcccagaacuuccagggccgcgucaccaucaccgccgacgaguccaccuccaccgccuacauggagcucuccucccuccgcuccgaggacaccgccgucuacuacugcgcccgcuccaccggcuacuaccccgccuaccuccaccacuggggccagggcacccucgucaccgucuccuccggcaccggcggcuccggcggcaccggcuccggcaccggcggcuccacccaguccgcccucacccagccccgcuccgucuccggcucccccggccaguccgucaccaucuccugcaccggcaccuccuccgacgucggcggcuacaacuacgucuccugguaccagcagcaccccggcaaggcccccaagcucaugaucuacgacgucuccaagcgccccuccggcguccccgaccgcuucuccggcuccaaguccggcaacaccgccucccucaccaucuccggccuccaggccgaggacgaggccgacuacuacugcuccuccuacaccuccuccuccacccacgucuucggcaccggcaccaaggucaccguccucggc

SEQ ID NO: 20464 - RNA, 744 nt, Artificial Sequence
  derived and/or modified sequence opt2 from anti-influenza_Chain
gagguccagcucgucgaguccggcgccgaggucaagaagcccggcuccuccgucaaggucuccugcaaggccuccggcggccccuuccgcuccuacgccaucuccuggguccgccaggcccccggccagggccccgaguggaugggcggcaucauccccaucuucggcaccaccaaguacgcccccaaguuccagggccgcgucaccaucaccgccgacgacuucgccggcaccgucuacauggagcucuccucccuccgcuccgaggacaccgccauguacuacugcgccaagcacaugggcuaccagguccgcgagaccauggacgucuggggcaagggcaccaccgucaccgucuccuccggcaccggcggcuccggcggcaccggcuccggcaccggcggcuccaccuccuacguccucacccagccccccuccgccuccggcacccccggccagcgcgucaccaucuccugcuccggcuccaccuucaacaucggcuccaacgccgucgacugguaccgccagcuccccggcaccgcccccaagcuccucaucuacuccaacaaccagcgccccuccggcguccccgaccgcuucuccggcucccgcuccggcaccuccgccucccucgccaucuccggccuccaguccgaggacgaggccgacuacuacugcgccgccugggacgacauccucaacguccccgucuucggcggcggcaccaagcucaccguccucggc

SEQ ID NO: 20465 - RNA, 744 nt, Artificial Sequence
  derived and/or modified sequence opt2 from anti-influenza_Chain
cagguccagcucguccaguccggcgccgaggucaagaagcccggcuccuccgucaaggucuccugcaaggccuccggcggccccuuccgcuccuacgccaucuccuggguccgccaggcccccggccagggccccgaguggaugggcggcaucauccccaucuucggcaccaccaaguacgcccccaaguuccagggccgcgucaccaucaccgccgacgacuucgccggcaccgucuacauggagcucuccucccuccgcuccgaggacaccgccauguacuacugcgccaagcacaugggcuaccagguccgcgagaccauggacgucuggggcaagggcaccaccgucaccgucuccuccggcaccggcggcuccggcggcaccggcuccggcaccggcggcuccacccaguccgcccucacccagcccgccgccgucuccggcucccccggccaguccaucaccaucuccugcaccggcaccuccuccgacgucggcggcuacaacuacgucuccugguaccagcagcaccccggcaaggcccccaagcucaugaucuacgaggucuccaaccgccccuccggcgucuccaaccgcuucuccggcuccaaguccggcaacaccgccucccucaccaucuccggccuccaggccgaggacgaggccgacuacuacugcuccuccuacaccuccuccuccaccuacgucuucggcaccggcaccaaggucaccguccucggc

SEQ ID NO: 20466 - RNA, 744 nt, Artificial Sequence
  derived and/or modified sequence opt2 from anti-influenza_Chain
gagguccagcucgucgaguccggcgccgaggucaagaagcccggcuccuccgucaaggucuccugcaaggccuccggcggccccuuccgcuccuacgccaucuccuggguccgccaggcccccggccagggccccgaguggaugggcggcaucauccccaucuucggcaccaccaaguacgcccccaaguuccagggccgcgucaccaucaccgccgacgacuucgccggcaccgucuacauggagcucuccucccuccgcuccgaggacaccgccauguacuacugcgccaagcacaugggcuaccagguccgcgagaccauggacgucuggggcaagggcaccaccgucaccgucuccuccggcaccggcggcuccggcggcaccggcuccggcaccggcggcuccaccuccuacguccucacccagccccccuccgucuccggcacccccggccagcgcgucaccaucuccugcuccggcucccgcuccaacgucggcgacaacuccgucuacugguaccagcacguccccgagauggcccccaagcuccucgucuacaagaacacccagcgccccuccggcguccccgcccgcuucuccggcuccaaguccggcaccuccgccucccucgccaucaucggccuccaguccggcgacgaggccgacuacuacugcgucgccugggacgacuccgucgacggcuacgucuucggcuccggcaccaaggucaccguccucggc

SEQ ID NO: 20467 - RNA, 744 nt, Artificial Sequence
  derived and/or modified sequence opt2 from anti-influenza_Chain
gagguccagcucgucgaguccggcgccgaggucaagaagcccggcuccuccgucaaggucuccugcaaggccuccggcggccccuuccgcuccuacgccaucuccuggguccgccaggcccccggccagggccccgaguggaugggcggcaucauccccaucuucggcaccaccaaguacgcccccaaguuccagggccgcgucaccaucaccgccgacgacuucgccggcaccgucuacauggagcucuccucccuccgcuccgaggacaccgccauguacuacugcgccaagcacaugggcuaccagguccgcgagaccauggacgucuggggcaagggcaccaccgucaccgucuccuccggcaccggcggcuccggcggcaccggcuccggcaccggcggcuccaccuccuacguccucacccagccccccuccgccuccggcacccccggccagcgcgucaccaucuccugcuccggcuccuccuccaacaucggcuccaacuacgucuacugguaccagcagcuccccggcaccgcccccaagcuccucaucuaccgcgacggccagcgccccuccggcguccccgaccgcuucuccggcuccaaguccggcaccuccgccucccucgccaucuccggccuccgcuccgacgacgaggccgacuacuacugcgccaccugggacgacaaccucuccggccccgucuucggcggcggcaccaagcucaccguccucggc

SEQ ID NO: 20468 - RNA, 744 nt, Artificial Sequence
  derived and/or modified sequence opt2 from anti-influenza_Chain
gagguccagcucgucgaguccggcgccgaggucaagaagcccggcuccuccgucaaggucuccugcaaggccuccggcggcaccuucuccuucuacuccauguccuggguccgccaggcccccggccagggccucgaguggaugggcggcaucauccccauguucggcaccaccaacuacgcccagaaguuccagggccgcgucaccaucaccgccgucgaguccaccuccaccgccuacauggaggucuccucccuccgcuccgaggacaccgccgucuacuacugcgcccgcggcgacaagggcaucuacuacuacuacauggacgucuggggcaagggcaccaccgucaccgucuccuccggcaccggcggcuccggcggcaccggcuccggcaccggcggcuccacccaguccgcccucacccagcccgccuccgucuccggcucccccggccaguccaucaccaucuccugcaccggcaccuccuccgacgucggcggcuacaacuacgucuccugguaccagcagcaccccggcaaggcccccaagcucaugaucuacgaggucuccaaccgccccuccggcgucuccaaccgcuucuccggcuccaaguccggcaacaccgccucccucaccaucuccggccuccaggccgaggacgaggccgacuacuacugcuccuccuacaccuccuccuccacccucgucuucggcaccggcaccaaggucaccguccucggc

SEQ ID NO: 20469 - RNA, 744 nt, Artificial Sequence
  derived and/or modified sequence opt2 from anti-influenza_Chain
augucccucuucggcgacaccaucgccuaccuccucucccucaucgaggacggcgagggcaaggccgagcucgccgagaagcuccacugcugguucggcggcaaggaguucgaccucgacuccgcccucgaguggaucaagaacaagcgcugccucaccgacauccagaaggcccucaucggcgccuccaucugcuuccucaagcccaaggaccaggagcgcaagcgccgcuucaucaccgagccccucuccggcaugggcaccaccgccaccaagaagaagggccucauccucgccgagcgcaagaugcgccgcugcgucuccuuccacgaggccuucgagaucgccgagggccacgaguccuccgcccuccucuacugccucauggucauguaccucaaccccgagaacuacuccaugcaggucaagcucggcacccucugcgcccucugcgagaagcaggccucccacucccaccgcgcccacucccgcgccgcccgcuccuccguccccggcguccgccgcgagaugcagauggucuccgccaugaacaccgccaagaccaugaacggcaugggcaagggcgaggacguccagaagcucgccgaggagcuccagaacaacaucggcguccuccgcucccucggcgccucccagaagaacggcgagggcaucgccaaggacgucauggagguccucaagcaguccuccaugggcaacuccgcccucguccgcaaguaccuc

SEQ ID NO: 20470 - RNA, 747 nt, Artificial Sequence
  derived and/or modified sequence opt2 from anti-influenza_Chain
gagguccagcucgucgaguccggcgccgaggucaagaagcccggcuccuccgucaaggucuccugcaaggccuccggcggccccuuccgcuccuacgccaucuccuggguccgccaggcccccggccagggccccgaguggaugggcggcaucauccccaucuucggcaccaccaaguacgcccccaaguuccagggccgcgucaccaucaccgccgacgacuucgccggcaccgucuacauggagcucuccucccuccgcuccgaggacaccgccauguacuacugcgccaagcacaugggcuaccagguccgcgagaccauggacgucuggggcaagggcaccaccgucaccgucuccuccggcaccggcggcuccggcggcaccggcuccggcaccggcggcuccacccaguccguccucacccagccccccuccgucuccgccgcccccggccagaaggucaccaucuccugcuccggcuccuccuccaacaucggcaacgacuacgucuccugguaccagcagcuccccggcaccgcccccaagcuccucaucuacgacaacaacaagcgccccuccggcauccccgaccgcuucuccggcuccaaguccggcaccuccgccacccucggcaucaccggccuccagaccggcgacgaggccaacuacuacugcgccaccugggaccgccgccccaccgccuacgucgucuucggcggcggcaccaagcucaccguccucggc

SEQ ID NO: 20471 - RNA, 750 nt, Artificial Sequence
  derived and/or modified sequence opt2 from anti-influenza_Chain
cagguccagcucguccaguccggcgccgaggucaagaagcccggcuccuccguccgcgucuccugcaaggccuccggcuccaucuuccgcaacuacgccauguccuggguccgccaggcccccggccagggccucgaguggaugggcggcaucaucgccaucuucggcacccccaaguacgcccagaaguuccagggccgcgucaccaucaccgccgacgaguccaccuccaccgucuacauggagcucuccggccuccgcuccgaggacaccgccauguacuacugcgcccgcaucccccacuacaacuucggcuccggcuccuacuucgacuacuggggccagggcacccucgucaccgucuccuccggcaccggcggcuccggcggcaccggcuccggcaccggcggcuccaccaccguccucacccagccccccuccgucuccggcgcccccggccagcgcgucaccaucuccugcaccggcuccuccuccaacaucggcgccggcuacgacguccacugguaccagcagcuccccggcaccgcccccaagcuccucaucuacggcaacuccaaccgccccuccggcguccccgaccgcuucuccggcuccaaguccggcaccuccgccacccucggcaucaccggccuccagaccggcgacgaggccgacuacuacugcggcaccugggacuccucccucuccgccuacgucuucggcaccggcaccaaggucaccguccucggc

SEQ ID NO: 20472 - RNA, 756 nt, Artificial Sequence
  derived and/or modified sequence opt2 from anti-influenza_Chain
gagguccagcucgucgaguccggcgccgaggucaagaagcccggcuccuccgucaaggucuccugcaaggccuccggccacaucuucuccggcuacgccaucuccuggguccgccaggcccccggccagggccucgaguggaugggcggcaucauccccaucuucggcaccaccaacuacgcccagaaguuccagggccgcgucaccaucaccgccgaccaguccaccuccaccgccuacauggaccucuccaaccuccgcuccgaggacaccgccgucuacuacugcgcccgcgucaaggacggcuacugcacccucaccuccugccccgucggcugguacuucgaccucuggggccgcggcacccucgucaccgucuccuccggcaccggcggcuccggcggcaccggcuccggcaccggcggcuccaccgagaucgucaugacccagucccccggcacccucucccucucccccggcgagcgcgccacccucuccugccgcgccucccaguccgucuccuccuccuaccucgccugguaccagcagaagcccggccaggccccccgccuccucaucuucggcgccuccucccgcgccaccggcauccccgaccgcuucuccggcuccggcuccggcaccgacuucacccucaccaucucccgccucgagcccgaggacuucgccgucuacuacugccagcaguacggcuccucccucaccuucggcggcggcaccaagcucgagaucaagcgc

SEQ ID NO: 20473 - RNA, 768 nt, Artificial Sequence
  derived and/or modified sequence opt2 from anti-influenza_Chain
cagguccagcucguccaguccggcgccgaggucaagaagcccggcuccuccgucaaggucuccugcaaggccuccggcggcuucuucuccuccuacgccaucuccuggguccgccaggcccccggccagggccucgaguggaugggcggcgucauccccaucuuccgcaccgccaacuacgcccagaacuuccagggccgcgucaccaucaccgccgacgaguucaccuccuacauggagcucuccucccuccgcuccgacgacaccgccgucuacuacugcgcccgccucaacuaccacgacuccggcaccuacuacaacgccccccgcggcugguucgaccccuggggccagggcacccucgucaccgucuccuccggcaccggcggcuccggcggcaccggcuccggcaccggcggcuccaccgacauccagaugacccagucccccgacucccucgccgucucccucggcgagaaggccaccaucaacugcaaguccucccaguccauccucaacuccuccaacaacaagaacuaccucgccugguaccagcagaagcccggccagccccccaagcuccucaucuacugggccuccacccgcgaguccggcguccccgaccgcuucuccggcuccggcuccggcaccgacuucacccucaccaucuccucccuccaggccgaggacgucgccgucuacuacugccagcaguacuacuccuccccccccaccuucggccagggcaccaaggucgagaucaagcgc

SEQ ID NO: 20474 - RNA, 768 nt, Artificial Sequence; identical to SEQ ID NO: 20473
  derived and/or modified sequence opt2 from anti-influenza_Chain

SEQ ID NO: 20475 - RNA, 771 nt, Artificial Sequence
  derived and/or modified sequence opt2 from anti-influenza_Chain
aucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccgccaacgaccucugcuaccccggcaacuucaacgacuacgaggagcucaagcaccuccucucccgcaucaaccacuucgagaagauccagaucauccccaaguccuccugguccgaccacgaggccuccuccggcgucuccuccgccugccccuaccagggcacccccuccuucuuccgcaacgucgucuggcucaucaagaagaacaacaccuaccccaccaucaagcgcuccuacaacaacaccaaccaggaggaccuccucauccucuggggcauccaccacuccaacgacgccgccgagcagaccaagcucuaccagaaccccaccaccuacaucuccgucggcaccuccacccucaaccagcgccucguccccaagaucgccacccgcuccaaggucaacggccagaacggccgcauggacuucuucuggaccauccucaagcccaacgacgccaucaacuucgaguccaacggcaacuucaucgcccccgaguacgccuacaagaucgucaagaag

SEQ ID NO: 20476 - RNA, 771 nt, Artificial Sequence; identical to SEQ ID NO: 20475
  derived and/or modified sequence opt2 from anti-influenza_Chain

SEQ ID NO: 20477 - RNA, 777 nt, Artificial Sequence
  derived and/or modified sequence opt2 from anti-influenza_Chain
auggucaaguccaaguaccucgucuucaucuccgucuucucccuccucuucggcgucuucgucgucggcuucucccaccagggcgucaaggccgaggaggagcgccccaugggcaccgccuucuacgaguccuucgacgccuucgacgacgagcgcugguccaaggccggcgucuggaccaacggccagauguucaacgccaccugguaccccgagcaggucaccgccgacggccucaugcgccucaccaucgccaagaagaccaccuccgcccgcaacuacaaggccggcgagcuccgcaccaacgacuucuaccacuacggccucuucgaggucuccaugaagcccgccaaggucgagggcaccgucuccuccuucuucaccuacaccggcgagugggacugggacggcgaccccugggacgagaucgacaucgaguuccucggcaaggacaccacccgcauccaguucaacuacuucaccaacggcgucggcggcaacgaguucuacuacgaccucggcuucgacgccuccgaguccuucaacaccuacgccuucgaguggcgcgaggacuccaucaccugguacgucaacggcgaggccguccacaccgccaccgagaacaucccccagaccccccagaagaucaugaugaaccucuggcccggcgucggcgucgacggcuggaccggcgucuucgacggcgacaacacccccgucuacuccuacuacgacuggguccgcuacaccccccuccagaacuaccagauccaccag

SEQ ID NO: 20478 - RNA, 777 nt, Artificial Sequence; identical to SEQ ID NO: 20477
  derived and/or modified sequence opt2 from anti-influenza_Chain

SEQ ID NO: 20479 - RNA, 783 nt, Artificial Sequence
  derived and/or modified sequence opt2 from anti-influenza_Chain
gacauccagaugacccagucccccuccuccgucuccgccuccgucggcgaccgcgucaccaucaccugccgcgccucccaggacaucuccaccuggcucgccugguaccagcagaagcccggcaaggcccccaagcuccucaucuacgccgccuccucccuccaguccggcguccccucccgcuucuccggcuccggcuccggcaccgacuucacccucaccaucuccucccuccagcccgaggacuucgccaccuacuucugccagcaggccaacuccuucccccccaccuucggcugcggcaccaagcucgagaucaagggcggcggcggcuccggcggcggcggcuccggcggcggcggcuccggcggcggcggcuccgagguccagcucgucgucuccggcggcggccucgucaagcccggcggcucccuccgccucuccugcgccgccuccggccucuccuuccucaacgccuggauguccuggguccgccaggcccccggcaagugccucgagugggucggccgcaucaaguccaacaccgacggcggcaccaccgacuacgccgcccccgucaagggccgcuucuccaucucccgcgacgacuccaagaacaugcucuuccuccacauguccucccuccgcaccgaggacaccgccgucuacuacugcgccaccgacggccccuacuccgacgacuuccgcuccggcuacgccgcccgcuaccgcuacuucggcauggacgucuggggccagggcaccaccgucaccgucuccucc

SEQ ID NO: 20480 - RNA, 783 nt, Artificial Sequence; identical to SEQ ID NO: 20479
  derived and/or modified sequence opt2 from anti-influenza_Chain

SEQ ID NO: 20481 - RNA, 789 nt, Artificial Sequence
  derived and/or modified sequence opt2 from anti-influenza_Chain
augggcuucguccucuucucccagcuccccuccuuccuccucgucuccacccuccuccucuuccucgucaucucccacuccugccgcgcccagaacggcggcuccuaccccuacaaguccggcgaguaccgcaccaaguccuucuucggcuacggcuacuacgagguccgcaugaaggccgccaagaacgucggcaucgucuccuccuucuucaccuacaccggccccuccgacaacaaccccugggacgagaucgacaucgaguuccucggcaaggacaccaccaagguccaguucaacugguacaagaacggcgucggcggcaacgaguaccuccacaaccucggcuucgacgccucccaggacuuccacaccuacggcuucgaguggcgccccgacuacaucgacuucuacgucgacggcaagaaggucuaccgcggcacccgcaacauccccgucacccccggcaagaucaugaugaaccucuggcccggcaucggcgucgacgaguggcucggccgcuacgacggccgcaccccccuccaggccgaguacgaguacgucaaguacuaccccaacggccgcuccaagcucgucgucaacacccccuucgucgccgucuucuccaacuucgacuccucccagugggagaaggccgacugggccaacggcuccgucuucaacugcgucuggaagcccucccaggucaccuucuccaacggcaagaugauccucacccucgaccgcgaguacgucgaccaccaccaccaccaccacaaggacgagcuc

SEQ ID NO: 20482 - RNA, 789 nt, Artificial Sequence; identical to SEQ ID NO: 20481
  derived and/or modified sequence opt2 from anti-influenza_Chain

SEQ ID NO: 20483 - RNA, 840 nt, Artificial Sequence
  derived and/or modified sequence opt2 from anti-influenza_Chain
auggcccaggucggccgcggcgccuccccccucucccgcgcccgcguccccccccucccccacccccucgacggcgagcaccucccccacgaccccgccggcggcggccacggcaaggccuccucccaggacgcccccgucggccagcuccccggccaccucgcccgccccgccuucuuccacuaccucaagaacuccuuccucgucugcucccucaccaccgucuucgcccucgccgucgccaccuucgccggcuacgcccucgcccgcuuccgcuuccccggcgccgagcucuucggcggcuccguccucgucacccaggucauccccggcauccucuuccucauccccaucuacaucauguacaucuacguccagaacuggguccgcuccgcccucggccucgagguccgccucgucggcuccuacggcggccucgucuucaccuacaccgccuucuucgucccccucuccaucuggauccuccgcggcuucuucgccuccauccccaaggagcucgaggaggccgccauggucgacggcgccacccccuuccaggccuuccaccgcgucauccucccccucgcccuccccggccucgccgccaccgccgucuacaucuuccucaccgccugggacgagcuccucuucgcccagguccucaccaccgaggccaccgccaccguccccgucggcauccgcaacuucgucggcaacuaccagaaccgcuacgaccucgucauggccgccgccaccgucgccacccuccccguccucguccucuucuucuucguccagcgccagcucauccagggccucaccgccggcgccgucaagggc

SEQ ID NO: 20484 - RNA, 840 nt, Artificial Sequence; identical to SEQ ID NO: 20483
  derived and/or modified sequence opt2 from anti-influenza_Chain

SEQ ID NO: 20485 - RNA, 843 nt, Artificial Sequence
  derived and/or modified sequence opt2 from anti-influenza_Chain
auggccgacaacaugaccaccacccagaucgaggucggccccggcgccaccaacgccaccaucaacuucgaggccggcauccucgagugcuacgagcgcuucuccuggcagcgcgcccucgacuaccccggccaggaccgccuccaccgccucaagcgcaagcucgagucccgcaucaagacccacaacaaguccgagcccgagaacaagcgcaugucccucgaggagcgcaaggccaucggcgucaagaugaugaagguccuccucuucauggaccccuccgccggcaucgagggcuucgagcccuacugcgucaagaaccccuccaccuccaagugccccaacuacgacuggaccgacuacccccccacccccggcaaguaccucgacgacaucgaggaggagcccgagaacgucgaccaccccaucgaggucguccuccgcgacaugaacaacaaggacgcccgccagaagaucaaggacgaggucaacacccagaaggagggcaaguuccgccucaccaucaagcgcgacauccgcaacguccucucccuccgcguccucgucaacggcaccuuccucaagcaccccaacggcgacaagucccucuccacccuccaccgccucaacgccuacgaccagaacggcggccucgucgccaagcucgucgccaccgacgaccgcaccgucgaggacgagaaggacggccaccgcauccucaacucccucuucgagcgcuucgacgagggccacuccaagcccauccgcgccgccgagaccgccgucggcguccucucccaguucggccaggagcaccgccucucccccgaggagggcgacaac

SEQ ID NO: 20486 - RNA, 843 nt, Artificial Sequence; identical to SEQ ID NO: 20485
  derived and/or modified sequence opt2 from anti-influenza_Chain

SEQ ID NO: 20487 - RNA, 858 nt, Artificial Sequence
  derived and/or modified sequence opt2 from anti-influenza_Chain
augugcaccaugccccucaugaagcucaagaagaugaugcgccgcaccgccuuccuccucuccguccucaucggcugcuccaugcucggcuccgaccgcuccgacaaggccccccacugggagcucgucugguccgacgaguucgacuacuccggccuccccgaccccgagaagugggacuacgacgucggcggccacggcuggggcaaccaggagcuccaguacuacacccgcgcccgcaucgagaacgcccgcgucggcggcggcguccucaucaucgaggcccgccacgagcccuacgagggccgcgaguacaccuccgcccgccucgucacccgcggcaaggccuccuggaccuacggccgcuucgagauccgcgcccgccuccccuccggccgcggcaccuggcccgccaucuggaugcuccccgaccgccagaccuacggcuccgccuacuggcccgacaacggcgagaucgacaucauggagcacgucggcuucaaccccgacgucguccacggcaccguccacaccaaggccuacaaccaccuccucggcacccagcgcggcggcuccauccgcguccccaccgcccgcaccgacuuccacgucuacgccaucgaguggacccccgaggagauccgcugguucgucgacgacucccucuacuaccgcuuccccaacgagcgccucaccgaccccgaggccgacuggcgccacuggcccuucgaccagcccuuccaccucaucaugaacaucgccgucggcggcgccuggggcggccagcagggcgucgaccccgaggccuuccccgcccagcucgucgucgacuacguccgcgucuaccgcugggucgag

SEQ ID NO: 20488 - RNA, 858 nt, Artificial Sequence; identical to SEQ ID NO: 20487
  derived and/or modified sequence opt2 from anti-influenza_Chain

SEQ ID NO: 20489 - RNA, 900 nt, Artificial Sequence
  derived and/or modified sequence opt2 from anti-influenza_Chain
aacguccccgagugguccuacaucgucgagaaggccaaccccgccaacgaccucugcuaccccggcaacuucaacgacuacgaggagcucaagcaccuccucucccgcaucaaccacuucgagaagauccagggcuacauccccgaggccccccgcgacggccaggccuacguccgcaaggacggcgaguggguccuccucuccaccuuccuccgcuccgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 20490 - RNA, 900 nt, Artificial Sequence; identical to SEQ ID NO: 20489
  derived and/or modified sequence opt2 from anti-influenza_Chain

SEQ ID NO: 20491 - RNA, 927 nt, Artificial Sequence
  derived and/or modified sequence opt2 from anti-influenza_Chain
auggucaaccgccgcgaccucaucaagugguccgccgucgcccucggcgccggcgccggccucgccggccccgcccccgccgcccacgccgccgaccucgagugggagcaguaccccguccccgccgcccccggcggcaaccgcuccuggcagcuccuccccucccacuccgacgacuucaacuacaccggcaagccccagaccuuccgcggccgcuggcucgaccagcacaaggacggcugguccggccccgccaacucccucuacuccgcccgccacuccugggucgccgacggcaaccucaucgucgagggccgccgcgcccccgacggccgcgucuacugcggcuacgucaccucccgcacccccgucgaguacccccucuacaccgagguccucaugcgcgucuccggccucaagcucuccuccaacuucuggcuccucucccgcgacgacgucaacgagaucgacgucaucgagugcuacggcaacgagucccuccacggcaagcacaugaacaccgccuaccacaucuuccagcgcaaccccuucaccgagcucgcccgcucccagaagggcuacuucgccgacggcuccuacggcuacaacggcgagaccggccaggucuucggcgacggcgccggccagccccuccuccgcaacggcuuccaccgcuacggcguccacuggaucuccgccaccgaguucgacuucuacuucaacggccgccucguccgccgccucaaccgcuccaacgaccuccgcgacccccgcucccgcuucuucgaccagcccaugcaccucauccucaacaccgagucccaccaguggcgcgucgaccgcggcaucgagcccaccgacgccgagcucgccgaccccuccaucaacaacaucuacuaccgcuggguccgcaccuaccaggccguc

SEQ ID NO: 20492 - RNA, 927 nt, Artificial Sequence; identical to SEQ ID NO: 20491
  derived and/or modified sequence opt2 from anti-influenza_Chain

SEQ ID NO: 20493 - RNA, 960 nt, Artificial Sequence
  derived and/or modified sequence opt2 from anti-influenza_Chain
aucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccgccaacgaccucugcuaccccggcaacuucaacgacuacgaggagcucaagcaccuccucucccgcaucaaccacuucgagaagauccagaucauccccaaguccuccugguccgaccacgaggccuccuccggcgucuccuccgccugccccuaccagggcacccccuccuucuuccgcaacgucgucuggcucaucaagaagaacaacaccuaccccaccaucaagcgcuccuacaacaacaccaaccaggaggaccuccucauccucuggggcauccaccacuccaacgacgccgccgagcagaccaagcucuaccagaaccccaccaccuacaucuccgucggcaccuccacccucaaccagcgccucguccccaagaucgccacccgcuccaaggucaacggccagaacggccgcauggacuucuucuggaccauccucaagcccaacgacgccaucaacuucgaguccaacggcaacuucaucgcccccgaguacgccuacaagaucgucaagaagggcgacuccgccaucgucaaguccgaggucgaguacggcaacugcaacaccaagugccagacccccaucggcgccaucaacuccuccaugcccuuccacaacauccacccccucaccaucggcgagugccccaaguacgucaaguccaacaagcucguccucgccaccggccuccgcaacuccccccuc

SEQ ID NO: 20494 - RNA, 960 nt, Artificial Sequence; identical to SEQ ID NO: 20493
  derived and/or modified sequence opt2 from anti-influenza_Chain

SEQ ID NO: 20495 - RNA, 960 nt, Artificial Sequence; identical to SEQ ID NO: 20493
  derived and/or modified sequence opt2 from anti-influenza_Chain

SEQ ID NO: 20496 - RNA, 978 nt, Artificial Sequence
  derived and/or modified sequence opt2 from anti-influenza_Chain
acccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcgacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgc

SEQ ID NO: 20497 - RNA, 978 nt, Artificial Sequence; identical to SEQ ID NO: 20496
  derived and/or modified sequence opt2 from anti-influenza_Chain

SEQ ID NO: 20498 - RNA, 960 nt, Artificial Sequence; identical to SEQ ID NO: 20493
  derived and/or modified sequence opt2 from anti-influenza_Chain

SEQ ID NO: 20499 - RNA, 990 nt, Artificial Sequence
  derived and/or modified sequence opt2 from anti-influenza_Chain
augugcuccuccauccccucccuccgcgaggucuucgccaacgacuuccgcaucggcgccgccgucaaccccgucacccucgaggcccagcagucccuccucauccgccacgucaacucccucaccgccgagaaccacaugaaguucgagcaccuccagcccgaggagggccgcuucaccuucgacaucgccaucaaguccuccaccucccccuucuccucccacggcguccgcggccacacccucgucuggcacaaccagacccccuccugggucuuccaggacucccagggccacuucgucggccgcgacguccuccucgagcgcaugaagucccacaucuccaccgucguccagcgcuacaagggcaaggucuacugcugggacgucaucaacgaggccgucgccgacgagggcuccgaguggcuccgcuccuccaccuggcgccagaucaucggcgacgacuucauccagcaggccuuccucuacgcccacgaggccgaccccgaggcccuccucuucuacaacgacuacaacgagugcuuccccgagaagcgcgagaagaucuacacccucgucaagucccuccgcgacaagggcauccccauccacggcaucggcaugcaggcccacuggucccucaaccgccccacccucgacgagauccgcgccgccaucgagcgcuacgccucccucggcgucauccuccacaucaccgagcucgacaucuccauguucgaguucgacgaccaccgcaaggaccucgccgcccccaccaacgagauggucgagcgccaggccgagcgcuacgagcagaucuucucccucuucaaggaguaccgcgacgucauccagaacgucaccuucuggggcaucgccgacgaccacaccuggcucgaccacuuccccguccagggccgcaagaacuggccccuccucuucgacgagcagcacaaccccaagcccgccuucuggcgcgucgucaacauc

SEQ ID NO: 20500 - RNA, 990 nt, Artificial Sequence; identical to SEQ ID NO: 20499
  derived and/or modified sequence opt2 from anti-influenza_Chain

SEQ ID NO: 20501 - RNA, 1002 nt, Artificial Sequence
  derived and/or modified sequence opt2 from anti-influenza_Chain
augaagaaccgcgucaucucccuccucauggccucccuccuccucguccucuccgucaucgucgcccccuucuacaaggccgaggccgccaccgucgucaacacccccuucgucgccgucuucuccaacuucgacuccucccagugggagaaggccgacugggccaacggcuccgucuucaacugcgucuggaagcccucccaggucaccuucuccaacggcaagaugauccucacccucgaccgcgaguacggcggcuccuaccccuacaaguccggcgaguaccgcaccaaguccuucuucggcuacggcuacuacgagguccgcaugaaggccgccaagaacgucggcaucgucuccuccuucuucaccuacaccggccccuccgacaacaaccccugggacgagaucgacaucgaguuccucggcaaggacaccaccaagguccaguucaacugguacaagaacggcgucggcggcaacgaguaccuccacaaccucggcuucgacgccucccaggacuuccacaccuacggcuucgaguggcgccccgacuacaucgacuucuacgucgacggcaagaaggucuaccgcggcacccgcaacauccccgucacccccggcaagaucaugaugaaccucuggcccggcaucggcgucgacgaguggcucggccgcuacgacggccgcaccccccuccaggccgaguacgaguacgucaaguacuaccccaacggcgucccccaggacaaccccacccccacccccaccaucgcccccuccacccccaccaaccccaaccucccccucaagggcgacgucaacggcgacggccacgucaacuccuccgacuacucccucuucaagcgcuaccuccuccgcgucaucgaccgcuuccccgucggcgaccaguccgucgccgacgucaaccgcgacggccgcaucgacuccaccgaccucaccaugcucaagcgcuaccucauccgcgccauccccucccuc

SEQ ID NO: 20502 - RNA, 1002 nt, Artificial Sequence; identical to SEQ ID NO: 20501
  derived and/or modified sequence opt2 from anti-influenza_Chain

SEQ ID NO: 20503 - RNA, 1041 nt, Artificial Sequence
  derived and/or modified sequence opt2 from anti-influenza_Chain
aucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccgccaacgaccucugcuaccccggcaacuucaacgacuacgaggagcucaagcaccuccucucccgcaucaaccacuucgagaagauccagaucauccccaaguccuccugguccgaccacgaggccuccuccggcgucuccuccgccugccccuaccagggcacccccuccuucuuccgcaacgucgucuggcucaucaagaagaacaacaccuaccccaccaucaagcgcuccuacaacaacaccaaccaggaggaccuccucauccucuggggcauccaccacuccaacgacgccgccgagcagaccaagcucuaccagaaccccaccaccuacaucuccgucggcaccuccacccucaaccagcgccucguccccaagaucgccacccgcuccaaggucaacggccagaacggccgcauggacuucuucuggaccauccucaagcccaacgacgccaucaacuucgaguccaacggcaacuucaucgcccccgaguacgccuacaagaucgucaagaagggcgacuccgccaucgucaaguccgaggucgaguacggcaacugcaacaccaagugccagacccccaucggcgccaucaacuccuccaugcccuuccacaacauccacccccucaccaucggcgagugccccaaguacgucaaguccaacaagcucguccucgccaccggccuccgcaacuccccccucggcuacauccccgaggccccccgcgacggccaggccuacguccgcaaggacggcgaguggguccuccucuccaccuuccuc

SEQ ID NO: 20504 - RNA, 1041 nt, Artificial Sequence; identical to SEQ ID NO: 20503
  derived and/or modified sequence opt2 from anti-influenza_Chain

SEQ ID NO: 20505 - RNA, 1047 nt, Artificial Sequence
  derived and/or modified sequence opt2 from anti-influenza_Chain
augaacaucaagaagaccgccgucaaguccgcccucgccgucgccgccgccgccgccgcccucaccaccaacgucuccgccaaggacuucuccggcgccgagcucuacacccucgaggagguccaguacggcaaguucgaggcccgcaugaagauggccgccgccuccggcaccgucuccuccauguuccucuaccagaacggcuccgagaucgccgacggccgccccugggucgaggucgacaucgagguccucggcaagaaccccggcuccuuccaguccaacaucaucaccggcaaggccggcgcccagaagaccuccgagaagcaccacgccgucucccccgccgccgaccaggccuuccacaccuacggccucgaguggacccccaacuacguccgcuggaccgucgacggccaggagguccgcaagaccgagggcggccaggucuccaaccucaccggcacccagggccuccgcuucaaccucugguccuccgaguccgccgccugggucggccaguucgacgaguccaagcucccccucuuccaguucaucaacugggucaaggucuacaaguacacccccggccagggcgagggcggcuccgacuucacccucgacuggaccgacaacuucgacaccuucgacggcucccgcuggggcaagggcgacuggaccuucgacggcaaccgcgucgaccucaccgacaagaacaucuacucccgcgacggcaugcucauccucgcccucacccgcaagggccaggaguccuucaacggccaggucccccgcgacgacgagcccgccccccaguccuccuccuccgcccccgccuccuccuccuccguccccgccuccuccuccuccguccccgccuccuccuccuccgccuucgucccccccuccuccuccuccgccaccaacgccauccacggcaugcgcaccacccccgccgucgccaaggagcaccgcaaccucgucaacgccaagggcgccaaggucaaccccaacggccacaagcgcuaccgcgucaacuucgagcac

SEQ ID NO: 20506 - RNA, 1047 nt, Artificial Sequence
  derived and/or modified sequence opt2 from anti-influenza_Chain
gagguccagcucgucgaguccggcggcggcgucguccagcccggccgcucccuccgccucuccugcgccgccuccggcuucgccuuccacaaccgcgccaugcacuggguccgccaggcccccggcaagggccucgagugggucgcccucaucuacuucgacggcuccaagcaguacuacgccgacuccgucaagggccgcuucaccaucucccgcgacaacuccaagaacaccgucuuccuccagaugaacucccuccgccccgaggacaccgccgucuacuacugcgccguccccggccccaucuucggcaucuucccccccugguccuacuucgaccacuggggccagggcauccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggc

SEQ ID NO: 20507 - RNA, 1047 nt, Artificial Sequence; identical to SEQ ID NO: 20506
  derived and/or modified sequence opt2 from anti-influenza_Chain

SEQ ID NO: 20508 - RNA, 1047 nt, Artificial Sequence; identical to SEQ ID NO: 20505
  derived and/or modified sequence opt2 from anti-influenza_Chain

SEQ ID NO: 20509 - RNA, 1161 nt, Artificial Sequence
  derived and/or modified sequence opt2 from anti-influenza_Chain
augaacaaguuccucaacaagaaguggucccucauccucaccaugggcggcaucuuccucauggccacccucucccucaucuucgccaccggcaagaaggccuucaacgaccagaccuccgccgaggacauccccucccucgccgaggccuuccgcgacuacuuccccaucggcgccgccaucgagcccggcuacaccaccggccagaucgccgagcucuacaagaagcacgucaacaugcucgucgccgagaacgccaugaagcccgccucccuccagcccaccgagggcaacuuccagugggccgacgccgaccgcaucguccaguucgccaaggagaacggcauggagcuccgcuuccacacccucgucuggcacaaccagacccccaccggcuucucccucgacaaggagggcaagcccauggucgaggagaccgacccccagaagcgcgaggagaaccgcaagcuccuccuccagcgccucgagaacuacauccgcgccgucguccuccgcuacaaggacgacaucaaguccugggacgucgucaacgaggucaucgagcccaacgaccccggcggcaugcgcaacucccccugguaccagaucaccggcaccgaguacaucgaggucgccuuccgcgccacccgcgaggccggcggcuccgacaucaagcucuacaucaacgacuacaacaccgacgaccccgucaagcgcgacauccucuacgagcucgucaagaaccuccucgagaagggcguccccaucgacggcgucggccaccagacccacaucgacaucuacaacccccccgucgagcgcaucaucgaguccaucaagaaguucgccggccucggccucgacaacaucaucaccgagcucgacauguccaucuacuccuggaacgaccgcuccgacuacggcgacuccauccccgacuacauccucacccuccaggccaagcgcuaccaggagcucuucgacgcccucaaggagaacaaggacaucgucuccgccgucgucuucuggggcaucuccgacaaguacuccuggcucaacggcuuccccgucaagcgcaccaacgccccccuccucuucgaccgcaacuucaugcccaagcccgccuucugggccaucgucgaccccucccgccuccgcgag

SEQ ID NO: 20510 - RNA, 1161 nt, Artificial Sequence; identical to SEQ ID NO: 20509
  derived and/or modified sequence opt2 from anti-influenza_Chain

SEQ ID NO: 20511 - RNA, 1221 nt, Artificial Sequence
  derived and/or modified sequence opt2 from anti-influenza_Chain
augcgcaacgucguccgcaagccccucaccaucggccucgcccucacccuccuccuccccaugggcaugaccgccaccuccgccaagaacgccgacuccuacgccaagaagccccacaucuccgcccucaacgccccccagcucgaccagcgcuacaagaacgaguucaccaucggcgccgccgucgagcccuaccagcuccagaacgagaaggacguccagaugcucaagcgccacuucaacuccaucgucgccgagaacgucaugaagcccaucuccauccagcccgaggagggcaaguucaacuucgagcaggccgaccgcaucgucaaguucgccaaggccaacggcauggacauccgcuuccacacccucgucuggcacucccaggucccccagugguucuuccucgacaaggagggcaagcccauggucaacgagaccgaccccgucaagcgcgagcagaacaagcagcuccuccucaagcgccucgagacccacaucaagaccaucgucgagcgcuacaaggacgacaucaaguacugggacgucgucaacgaggucgucggcgacgacggcaagcuccgcaacucccccugguaccagaucgccggcaucgacuacaucaaggucgccuuccaggccgcccgcaaguacggcggcgacaacaucaagcucuacaugaacgacuacaacaccgaggucgagcccaagcgcaccgcccucuacaaccucgucaagcagcucaaggaggagggcguccccaucgacggcaucggccaccagucccacauccagaucggcuggcccuccgaggccgagaucgagaagaccaucaacauguucgccgcccucggccucgacaaccagaucaccgagcucgacgucuccauguacggcuggcccccccgcgccuaccccaccuacgacgccauccccaagcagaaguuccucgaccaggccgcccgcuacgaccgccucuucaagcucuacgagaagcucuccgacaagaucuccaacgucaccuucuggggcaucgccgacaaccacaccuggcucgacucccgcgccgacgucuacuacgacgccaacggcaacgucgucgucgaccccaacgcccccuacgccaaggucgagaagggcaagggcaaggacgcccccuucgucuucggccccgacuacaaggucaagcccgccuacugggccaucaucgaccacaag

SEQ ID NO: 20512 - RNA, 1221 nt, Artificial Sequence; identical to SEQ ID NO: 20511
  derived and/or modified sequence opt2 from anti-influenza_Chain

SEQ ID NO: 20513 - RNA, 1233 nt, Artificial Sequence
  derived and/or modified sequence opt2 from anti-influenza_Chain
cucucccgcaucaaccacuucgagaagauccagaucauccccaaguccuccugguccgaccacgaggccuccuccggcgucuccuccgccugccccuaccagggcacccccuccuucuuccgcaacgucgucuggcucaucaagaagaacaacaccuaccccaccaucaagcgcuccuacaacaacaccaaccaggaggaccuccucauccucuggggcauccaccacuccaacgacgccgccgagcagaccaagcucuaccagaaccccaccaccuacaucuccgucggcaccuccacccucaaccagcgccucguccccaagaucgccacccgcuccaaggucaacggccagaacggccgcauggacuucuucuggaccauccucaagcccaacgacgccaucaacuucgaguccaacggcaacuucaucgcccccgaguacgccuacaagaucgucaagaagggcuacauccccgaggccccccgcgacggccaggccuacguccgcaaggacggcgaguggguccuccucuccaccuuccuccgcuccgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 20514 - RNA, 1233 nt, Artificial Sequence; identical to SEQ ID NO: 20513
  derived and/or modified sequence opt2 from anti-influenza_Chain

SEQ ID NO: 20515 - RNA, 1293 nt, Artificial Sequence
  derived and/or modified sequence opt2 from anti-influenza_Chain
auggacgaccacgccgagaaguuccucuggggcgucgccaccuccgccuaccagaucgagggcgccacccaggaggacggccgcggccccuccaucugggacgccuucgcccgccgccccggcgccauccgcgacggcuccaccggcgagcccgccugcgaccacuaccgccgcuacgaggaggacaucgcccucaugcagucccucggcguccgcgccuaccgcuucuccgucgccuggccccgcauccuccccgagggccgcggccgcaucaaccccaagggccucgccuucuacgaccgccucgucgaccgccuccucgccuccggcaucacccccuuccucacccucuaccacugggaccucccccucgcccucgaggagcgcggcggcuggcgcucccgcgagaccgccuucgccuucgccgaguacgccgaggccgucgcccgcgcccucgccgaccgcguccccuucuucgccacccucaacgagcccuggugcuccgccuuccucggccacuggaccggcgagcacgcccccggccuccgcaaccucgaggccgcccuccgcgccgcccaccaccuccuccucggccacggccucgccgucgaggcccuccgcgccgccggcgcccgccgcgucggcaucguccucaacuucgcccccgccuacggcgaggaccccgaggccgucgacgucgccgaccgcuaccacaaccgcuacuuccucgaccccauccucggcaagggcuaccccgagucccccuuccgcgaccccccccccguccccauccucucccgcgaccucgagcucgucgcccgcccccucgacuuccucggcgucaacuacuacgcccccguccgcgucgcccccggcaccggcacccuccccguccgcuaccucccccccgagggccccgccaccgccaugggcugggaggucuaccccgagggccuccaccaccuccucaagcgccucggccgcgagguccccuggccccucuacgucaccgagaacggcgccgccuaccccgaccucuggaccggcgaggccgucgucgaggaccccgagcgcgucgccuaccucgaggcccacgucgaggccgcccuccgcgcccgcgaggagggcgucgaccuccgcggcuacuucgucuggucccucauggacaacuucgagugggccuucggcuacacccgccgcuucggccucuacuacgucgacuuccccucccagcgccgcauccccaagcgcuccgcccucugguaccgcgagcgcaucgcccgcgcccagacc

SEQ ID NO: 20516 - RNA, 1293 nt, Artificial Sequence
  derived and/or modified sequence opt2 from anti-influenza_Chain
augaccgagaacgccgagaaguuccucuggggcgucgccaccuccgccuaccagaucgagggcgccacccaggaggacggccgcggccccuccaucugggacgccuucgcccagcgccccggcgccauccgcgacggcuccaccggcgagcccgccugcgaccacuaccgccgcuacgaggaggacaucgcccucaugcagucccucggcguccgcgccuaccgcuucuccgucgccuggccccgcauccuccccgagggccgcggccgcaucaaccccaagggccucgccuucuacgaccgccucgucgaccgccuccucgccuccggcaucacccccuuccucacccucuaccacugggaccucccccucgcccucgaggagcgcggcggcuggcgcucccgcgagaccgccuucgccuucgccgaguacgccgaggccgucgcccgcgcccucgccgaccgcguccccuucuucgccacccucaacgagcccuggugcuccgccuuccucggccacuggaccggcgagcacgcccccggccuccgcaaccucgaggccgcccuccgcgccgcccaccaccuccuccucggccacggccucgccgucgaggcccuccgcgccgccggcgcccgccgcgucggcaucguccucaacuucgcccccgccuacggcgaggaccccgaggccgucgacgucgccgaccgcuaccacaaccgcuucuuccucgaccccauccucggcaagggcuaccccgagucccccuuccgcgaccccccccccguccccauccucucccgcgaccucgagcucgucgcccgcccccucgacuuccucggcgucaacuacuacgcccccguccgcgucgcccccggcaccggcacccuccccguccgcuaccucccccccgagggccccgccaccgccaugggcugggaggucuaccccgagggccucuaccaccuccucaagcgccucggccgcgagguccccuggccccucuacgucaccgagaacggcgccgccuaccccgaccucuggaccggcgaggccgucgucgaggaccccgagcgcgucgccuaccucgaggcccacgucgaggccgcccuccgcgcccgcgaggagggcgucgaccuccgcggcuacuucgucuggucccucauggacaacuucgagugggccuucggcuacacccgccgcuucggccucuacuacgucgacuuccccucccagcgccgcauccccaagcgcuccgcccucugguaccgcgagcgcaucgcccgcgcccagacc

SEQ ID NO: 20517 - RNA, 1293 nt, Artificial Sequence
  derived and/or modified sequence opt2 from anti-influenza_Chain
auggccgagaacgccgagaaguuccucuggggcgucgccaccuccgccuaccagaucgagggcgccacccaggaggacggccgcggccccuccaucugggacaccuucgcccgccgccccggcgccauccgcgacggcuccaccggcgagcccgccugcgaccacuaccaccgcuacgaggaggacaucgcccucaugcagucccucggcgucggcgucuaccgcuucuccgucgccuggccccgcauccuccccgagggccgcggccgcaucaaccccaagggccucgccuucuacgaccgccucgucgaccgccuccucgccgccggcaucacccccuuccucacccucuaccacugggaccucccccaggcccucgaggaccgcggcggcuggcgcucccgcgagaccgccuucgccuucgccgaguacgccgaggccgucgcccgcgcccucgccgaccgcguccccuucuucgccacccucaacgagcccuggugcuccgccuuccucggccacuggaccggcgagcacgcccccggccuccgcaaccucgaggccgcccuccgcgccgcccaccaccuccuccucggccacggccucgccgucgaggcccuccgcgccgccggcgccaagcgcgucggcaucguccucaacuucgcccccgucuacggcgaggaccccgaggccgucgacgucgccgaccgcuaccacaaccgcuacuuccucgaccccauccucggccgcggcuaccccgagucccccuuccaggaccccccccccacccccaaccucucccgcgaccucgagcucgucgcccgcccccucgacuuccucggcgucaacuacuacgcccccguccgcgucgcccccggcaccggcccccuccccguccgcuaccucccccccgagggccccgucaccgccaugggcugggaggucuaccccgagggccucuaccaccuccucaagcgccucggccgcgagguccccuggccccucuacaucaccgagaacggcgccgccuaccccgaccucuggaccggcgaggccgucgucgaggaccccgagcgcgucgccuaccucgaggcccacgucgaggccgcccuccgcgcccgcgaggagggcgucgaccuccgcggcuacuucgucuggucccucauggacaacuucgagugggccuucggcuacacccgccgcuucggccucuacuacgucgacuuccccucccagcgccgcauccccaagcgcuccgcccucugguaccgcgagcgcaucgcccgcgcccagcuc

SEQ ID NO: 20518 - RNA, 1293 nt, Artificial Sequence; identical to SEQ ID NO: 20515
  derived and/or modified sequence opt2 from anti-influenza_Chain

SEQ ID NO: 20519 - RNA, 1293 nt, Artificial Sequence; identical to SEQ ID NO: 20516
  derived and/or modified sequence opt2 from anti-influenza_Chain

SEQ ID NO: 20520 - RNA, 1293 nt, Artificial Sequence; identical to SEQ ID NO: 20517
  derived and/or modified sequence opt2 from anti-influenza_Chain

SEQ ID NO: 20521 - RNA, 1296 nt, Artificial Sequence
  derived and/or modified sequence opt2 from anti-influenza_Chain
auguucaagcccaacuaccacuucuuccccaucaccggcuggaugaacgaccccaacggccucaucuucuggaagggcaaguaccacauguucuaccaguacaacccccgcaagcccgaguggggcaacaucugcuggggccacgccgucuccgacgaccucguccacuggcgccaccuccccgucgcccucuaccccgacgacgagacccacggcgucuucuccggcuccgccgucgagaaggacggcaagauguuccucgucuacaccuacuaccgcgaccccacccacaacaagggcgagaaggagacccagugcgucgccauguccgagaacggccucgacuucgucaaguacgacggcaaccccgucaucuccaagccccccgaggagggcacccacgccuuccgcgaccccaaggucaaccgcuccaacggcgaguggcgcaugguccucggcuccggcaaggacgagaagaucggccgcguccuccucuacaccuccgacgaccucuuccacuggaaguacgagggcgucaucuucgaggacgagaccaccaaggagaucgagugccccgaccucguccgcaucggcgagaaggacauccucaucuacuccaucaccuccaccaacuccguccucuucuccaugggcgagcucaaggagggcaagcucaacgucgagaagcgcggccuccucgaccacggcaccgacuucuacgccgcccagaccuucuucggcaccgaccgcgucgucgucaucggcuggcuccaguccuggcuccgcaccggccucuaccccaccaagcgcgagggcuggaacggcgucaugucccucccccgcgagcucuacgucgagaacaacgagcucaaggucaagcccgucgacgagcuccucgcccuccgcaagcgcaaggucuucgagaccgccaaguccggcaccuuccuccucgacgucaaggagaacuccuacgagaucgucugcgaguucuccggcgagaucgagcuccgcaugggcaacgaguccgaggaggucgucaucaccaagucccgcgacgagcucaucgucgacaccacccgcuccggcgucuccggcggcgagguccgcaaguccaccgucgaggacgaggccaccaaccgcauccgcgccuuccucgacuccugcuccgucgaguucuucuucaacgacuccaucgccuucuccuuccgcauccaccccgagaacgucuacaacauccucuccgucaaguccaaccaggucaagcucgaggucuucgagcucgagaacaucuggcuc

SEQ ID NO: 20522 - RNA, 1296 nt, Artificial Sequence; identical to SEQ ID NO: 20521
  derived and/or modified sequence opt2 from anti-influenza_Chain

SEQ ID NO: 20523 - RNA, 1323 nt, Artificial Sequence
  derived and/or modified sequence opt2 from anti-influenza_Chain
gaggucaagcucgucgaguccggcggcggccucguccagcccggcggcucccuccgccucuccugcgccaccuccggcuucaccuucuccgacuacuacauguccuggguccgccagucccccggcaaggcccucgaguggcucggcuucacccgcucccgcguccucggcuacaccaccgacuacuccgccuccgucaagggccgcuucaccaucucccgcgacaacucccaguccauccucuaccuccagaugaacucccuccgcggcgaggacuccgccaccuacuacugcgcccgcgaccgccccauggacuacuggggccagggcaccuccgucaccgucuccuccgccaagaccaccccccccuccgucuacccccucgcccccggcuccgccgcccagaccaacuccauggucacccucggcugccucgucaagggcuacuuccccgagcccgucaccgucaccuggaacuccggcucccucuccuccggcguccacaccuuccccgccguccuccaguccgaccucuacacccucuccuccuccgucaccguccccuccuccaccuggcccuccgagaccgucaccugcaacgucgcccaccccgccuccuccaccaaggucgacaagaagaucgucccccgcgacugcggcugcaagcccugcaucugcaccguccccgaggucuccuccgucuucaucuucccccccaagcccaaggacguccucaccaucacccucacccccaaggucaccugcgucgucgucgacaucuccaaggacgaccccgagguccaguucuccugguucgucgacgacgucgagguccacaccgcccagacccagccccgcgaggagcaguucaacuccaccuuccgcuccgucuccgagcuccccaucaugcaccaggacuggcucaacggcaaggaguucaagugccgcgucaacuccgccgccuuccccgcccccaucgagaagaccaucuccaagaccaagggccgccccaaggccccccaggucuacaccauccccccccccaaggagcagauggccaaggacaaggucucccucaccugcaugaucaccgacuucuuccccgaggacaucaccgucgaguggcaguggaacggccagcccgccgagaacuacaagaacacccagcccaucauggacaccgacggcuccuacuucgucuacuccaagcucaacguccagaaguccaacugggaggccggcaacaccuucaccugcuccguccuccacgagggccuccacaaccaccacaccgagaagucccucucccacucccccggcaag

SEQ ID NO: 20524 - RNA, 1323 nt, Artificial Sequence; identical to SEQ ID NO: 20523
  derived and/or modified sequence opt2 from anti-influenza_Chain

SEQ ID NO: 20525 - RNA, 1329 nt, Artificial Sequence
  derived and/or modified sequence opt2 from anti-influenza_Chain
gagguccagcuccagcaguccggccccgagcucgucaagcccggcgccuccgucaagauguccugcaaggccuccggcuacaccuucaccuccuacgucaugcacugggucaagcagaagcccggccagggccucgaguggaucggcuacaucaaccccuacaacgacggcacccgcuacaacgagaaguuccgcgucaaggccacccucaccuccgacaaguccuccuccaccgccuacauggagcucuccucccucaccuccgaggacuccgccgucuacuacugcgcccgccgcggccucaucaccacccccacccucgacuacuggggccagggcaccacccucaccgucuccuccgccaagaccaccccccccuccgucuacccccucgcccccggcuccgccgcccagaccaacuccauggucacccucggcugccucgucaagggcuacuuccccgagcccgucaccgucaccuggaacuccggcucccucuccuccggcguccacaccuuccccgccguccuccaguccgaccucuacacccucuccuccuccgucaccguccccuccuccaccuggcccuccgagaccgucaccugcaacgucgcccaccccgccuccuccaccaaggucgacaagaagaucgucccccgcgacugcggcugcaagcccugcaucugcaccguccccgaggucuccuccgucuucaucuucccccccaagcccaaggacguccucaccaucacccucacccccaaggucaccugcgucgucgucgacaucuccaaggacgaccccgagguccaguucuccugggucgacgacgucgagguccacaccgcccagacccagccccgcgaggagcaguucaacuccaccuuccgcuccgucuccgagcuccccaucaugcaccaggacuggcucaacggcaaggaguucaagugccgcgucaacuccgccgccuuccccgcccccaucgagaagaccaucuccaagaccaagggccgccccaaggccccccaggucuacaccauccccccccccaaggagcagauggccaaggacaaggucucccucaccugcaugaucaccgacuucuuccccgaggacaucaccgucgaguggcaguggaacggccagcccgccgagaacuacaagaacacccagcccaucauggacaccgacggcuccuacuucgucuacuccaagcucaacguccagaaguccaacugggaggccggcaacaccuucaccugcuccguccuccacgagggccuccacaaccaccacaccgagaagucccucucccacucccccggcaag

SEQ ID NO: 20526 - RNA, 1329 nt, Artificial Sequence; identical to SEQ ID NO: 20525
  derived and/or modified sequence opt2 from anti-influenza_Chain

SEQ ID NO: 20527 - RNA, 1332 nt, Artificial Sequence
  derived and/or modified sequence opt2 from anti-influenza_Chain
aacguccccgagugguccuacaucgucgagaaggccaaccccgccaacgaccucugcuaccccggcaacuucaacgacuacgaggagcucaagcaccuccucucccgcaucaaccacuucgagaagauccagaucauccccaaguccuccugguccgaccacgaggccuccuccggcgucuccuccgccugccccuaccagggcacccccuccuucuuccgcaacgucgucuggcucaucaagaagaacaacaccuaccccaccaucaagcgcuccuacaacaacaccaaccaggaggaccuccucauccucuggggcauccaccacuccaacgacgccgccgagcagaccaagcucuaccagaaccccaccaccuacaucuccgucggcaccuccacccucaaccagcgccucguccccaagaucgccacccgcuccaaggucaacggccagaacggccgcauggacuucuucuggaccauccucaagcccaacgacgccaucaacuucgaguccaacggcaacuucaucgcccccgaguacgccuacaagaucgucaagaagggcuacauccccgaggccccccgcgacggccaggccuacguccgcaaggacggcgaguggguccuccucuccaccuuccuccgcuccgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 20528 - RNA, 1332 nt, Artificial Sequence; identical to SEQ ID NO: 20527
  derived and/or modified sequence opt2 from anti-influenza_Chain

SEQ ID NO: 20529 - RNA, 1341 nt, Artificial Sequence
  derived and/or modified sequence opt2 from anti-influenza_Chain
cagguccagcuccaggaguccggccccggccucgucaagcccuccgagacccucucccucaccugcaccgucuccggcggccucaucggcaccggcuccuacuacuggggcuggauccgccagacccccggcaagggcauggaguggaucggcuccaucuccuacuccggcuccaccuacuaccaccccucccucaagucccgcgucaccaucuccgacgacaccuccaagaaccagcucuuccucaagcuccgcuccgucaccgccgccgacaccgcccaguacuacugcgcccgcuacaacuggggcauccgcuacuucgacuucuggggccgcggcacccucgucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcaccaagaccuacaccugcaacgucgaccacaagcccuccaacaccaaggucgacaagacccgcgaguccaaguacggcccccccugccccuccugccccgcccccgaguuccucggcggccccuccgucuuccucuucccccccaagcccaaggacacccucaugaucucccgcacccccgaggucaccugcgucgucgucgacgucucccaggaggaccccgagguccaguucaacugguacgucgacggcgucgagguccacaacgccaagaccaagccccgcgaggagcaguucaacuccaccuaccgcgucgucuccguccucaccguccuccaccaggacuggcucaacggcaaggaguacaagugcaaggucuccaacaagggccuccccuccuccaucgagaagaccaucuccaaggccaagggccagccccgcgagccccaggucuacacccucccccccgcccaggaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacucccgccucaccgucgacaagucccgcuggcaggagggcaacgucuucuccugcuccgucaugcacgaggcccuccacaaccacuacacccagaagucccucucccucucccucggcaag

SEQ ID NO: 20530 - RNA, 1341 nt, Artificial Sequence; identical to SEQ ID NO: 20529
  derived and/or modified sequence opt2 from anti-influenza_Chain

SEQ ID NO: 20531 - RNA, 1344 nt, Artificial Sequence
  derived and/or modified sequence opt2 from anti-influenza_Chain
gagguccagcuccaggaguccggccccggccucgucaagcccucccagacccucucccucaccugcaacgucuccggcggcuccaucaccggcgacuacaagugguccuggauccgccagccccccggcaagggccucgaguggaucggccacauccacuccaccggcaccaccuacuacaaccccucccuccgcucccgcaucaccaucuccauggacaccuccaagaacaaccucucccuccgccucaccuccgucaccgccgccgacaccgccgucuacuacugcgccucccacacccucaccuccggccacuacccccgcgacuucgacuucuggggccagggcacccucgucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccgucaccuccuccaacuucggcacccagaccuacaccugcaacgucgaccacaagcccuccaacaccaaggucgacaagaccgucgagcgcaagugcugcgucgagugcccccccugccccgccccccccgucgccggccccuccgucuuccucuucccccccaagcccaaggacacccucaugaucucccgcacccccgaggucaccugcgucgucgucgacgucucccacgaggaccccgagguccaguucaacugguacgucgacggcauggagguccacaacgccaagaccaagccccgcgaggagcaguucaacuccaccuuccgcgucgucuccguccucaccgucguccaccaggacuggcucaacggcaaggaguacaagugcaaggucuccaacaagggccuccccgcccccaucgagaagaccaucuccaagaccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccaugcucgacuccgacggcuccuucuuccucuacuccaagcucaccgucgacaagucccgcuggcagcagggcaacgucuucuccugcuccgucaugcacgaggcccuccacaaccacuacacccagaagucccucucccucuccggcaag

SEQ ID NO: 20532 - RNA, 1350 nt, Artificial Sequence
  derived and/or modified sequence opt2 from anti-influenza_Chain
cagguccagcuccagcaguccggcgccgaggucaagaagcccggcuccuccgucaaggucuccugcaaggucuccggcgucaucuucuccggcuccgccaucuccuggguccgccaggcccccggccagggccucgaguggaugggcggcaucuccccccucuucggcaccaccaacuacgcccagaaguuccagggccgcgucaccaucaccgccgaccaguccaccaacaccaccuacauggaggucaacucccuccgcuacgaggacaccgccgucuacuucugcgcccgcggccccaaguacuacuccgaguacauggacgucuggggcaagggcaccaccgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 20533 - RNA, 1350 nt, Artificial Sequence
  derived and/or modified sequence opt2 from anti-influenza_Chain
cagguccagcucguccaguccggcgccgaggucaagaagcccggcuccuccgucaaggucuccugcaaggccuccggcggcaccuucuccuccuacgccaucuccuggguccgccaggcccccggccagggccucgaguggaugggcggcaucaugggcauguucggcaccaccaacuacgcccagaaguuccagggccgcgucaccaucaccgccgacgaguucaccuccgccgccuacauggagcuccgcucccuccgcuccgaggacaccgccgucuacuacugcgcccgcuccuccggcuacuaccccgaguacuuccaggacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 20534 - RNA, 1350 nt, Artificial Sequence
  derived and/or modified sequence opt2 from anti-influenza_Chain
gagguccagcucgucgaguccggcgccgaggucaagaagcccggcuccuccgucaaggucuccugcaaggccuccggcggcaccuucuccuccuacggcaucuccuggguccgccaggcccccggccagggccucgaguggaugggcgacaucaucggcauguucggcuccaccaacuacgcccagaacuuccagggccgccucaccaucaccgccgacgaguccaccuccaccgccuacauggagcucuccucccuccgcuccgaggacaccgccgucuacuacugcgcccgcuccuccggcuacuaccccgccuaccucccccacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 20535 - RNA, 1350 nt, Artificial Sequence
  derived and/or modified sequence opt2 from anti-influenza_Chain
gagguccagcucgucgaguccggcgccgaggucaagaagcccggcuccuccgucaaggucuccugcaaggccuccggcggcaccuucuccuccuacgccaucuccuggguccgccaggcccccggccagggccucgaguggaugggcggcaucaucggcauguucggcaccgccaacuacgcccagaaguuccagggccgcgucaccaucaccgccgacgaguucaccuccaccgccuacauggagcucuccucccuccgcuccgaggacaccgccgucuacuacugcgcccgcggcaacuacuacuacgaguccucccucgacuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 20536 - RNA, 1350 nt, Artificial Sequence
  derived and/or modified sequence opt2 from anti-influenza_Chain
gagguccagcucguccaguccggcgccgaggucaagaagcccggcuccuccaugaaggucuccugcaaggccuccggcuccaucuucuccaacuacggcaucuccuggguccgccaggcccccggccagggccucgaguggaugggcggcaucauccccaucuucggcgccgccaacuacgcccagaaguuccagggccgcgucaccaucaccgccgacgaguccaccuccaccgucuacauggagguccgcucccuccgcuccgaggacaccgccgucuacuacugcgcccgccgccagcagcucuacaagggcuacuaccaccacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 20537 - RNA, 1350 nt, Artificial Sequence
  derived and/or modified sequence opt2 from anti-influenza_Chain
cagguccagcucguccaguccggcgccggcgucaagaagcccggcuccuccaugaaggucuccugcaaggccuccggcuccaucuucuccaacuacggcaucuccuggguccgccaggcccccggccagggccucgaguggaugggcggcaucauccccaucuucggcgccgccaacuacgcccagaaguuccagggccgcgucaccaucaccgccgacgaguccaccuccaccgucuacauggagguccgcucccuccgcuccgaggacaccgccgucuacuacugcgcccgccgccagcagcucuacaagggcuacuaccaccacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 20538 - RNA, 1350 nt, Artificial Sequence
  derived and/or modified sequence opt2 from anti-influenza_Chain
cagguccagcucguccaguccggcgccgagguccgcaagcccggcuccuccgucaaggucuccugcaaggucuccggcggcaucauccgcaaguacgccaucaacuggguccgccaggcccccggccagggccucgaguggaugggcggcaucaucgccaucuucaacaccgccaacuacgcccagaaguuccagggccgcgucaccaucaccgccgacgaguccaccuccaccgucuacauggagcucuccucccuccgcuccgaggacaccgcccucuacuacugcgcccgcggcaugaacuacuacuccgacuacuucgacuacuggggccagggcucccucgucaccgucucccccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 20539 - RNA, 1350 nt, Artificial Sequence; identical to SEQ ID NO: 20538
  derived and/or modified sequence opt2 from anti-influenza_Chain

SEQ ID NO: 20540 - RNA, 1350 nt, Artificial Sequence; identical to SEQ ID NO: 20536
  derived and/or modified sequence opt2 from anti-influenza_Chain

SEQ ID NO: 20541 - RNA, 1350 nt, Artificial Sequence; identical to SEQ ID NO: 20537
  derived and/or modified sequence opt2 from anti-influenza_Chain

SEQ ID NO: 20542 - RNA, 1350 nt, Artificial Sequence; identical to SEQ ID NO: 20532
  derived and/or modified sequence opt2 from anti-influenza_Chain

SEQ ID NO: 20543 - RNA, 1350 nt, Artificial Sequence; identical to SEQ ID NO: 20533
  derived and/or modified sequence opt2 from anti-influenza_Chain

SEQ ID NO: 20544 - RNA, 1350 nt, Artificial Sequence; identical to SEQ ID NO: 20534
  derived and/or modified sequence opt2 from anti-influenza_Chain

SEQ ID NO: 20545 - RNA, 1350 nt, Artificial Sequence; identical to SEQ ID NO: 20535
  derived and/or modified sequence opt2 from anti-influenza_Chain

SEQ ID NO: 20546 - RNA, 1353 nt, Artificial Sequence
  derived and/or modified sequence opt2 from anti-influenza_Chain
gagguccagcucgucgaguccggcgccgaggucaagaagcccggcuccuccgucaaggucuccugcaaggccuccggcggccccuuccgcuccuacgccaucuccuggguccgccaggcccccggccagggccccgaguggaugggcggcaucauccccaucuucggcaccaccaaguacgcccccaaguuccagggccgcgucaccaucaccgccgacgacuucgccggcaccgucuacauggagcucuccucccuccgcuccgaggacaccgccauguacuacugcgccaagcacaugggcuaccagguccgcgagaccauggacgucuggggcaagggcaccaccgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 20547 - RNA, 1353 nt, Artificial Sequence
  derived and/or modified sequence opt2 from anti-influenza_Chain
cagguccagcucguccaguccggcgccgaggucaagaagcccggcuccuccgucaaggucuccugcaaggccuccggcggccccuuccgcuccuacgccaucuccuggguccgccaggcccccggccagggccccgaguggaugggcggcaucauccccaucuucggcaccaccaaguacgcccccaaguuccagggccgcgucaccaucaccgccgacgacuucgccggcaccgucuacauggagcucuccucccuccgcuccgaggacaccgccauguacuacugcgccaagcacaugggcuaccagguccgcgagaccauggacgucuggggcaagggcaccaccgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 20548 - RNA, 1353 nt, Artificial Sequence
  derived and/or modified sequence opt2 from anti-influenza_Chain
gagguccagcucgucgaguccggcgccgaggucaagaagcccggcuccuccgucaaggucuccugcaaggccuccggcggcaccuucuccuucuacuccauguccuggguccgccaggcccccggccagggccucgaguggaugggcggcaucauccccauguucggcaccaccaacuacgcccagaaguuccagggccgcgucaccaucaccgccgucgaguccaccuccaccgccuacauggaggucuccucccuccgcuccgaggacaccgccgucuacuacugcgcccgcggcgacaagggcaucuacuacuacuacauggacgucuggggcaagggcaccaccgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 20549 - RNA, 1353 nt, Artificial Sequence; identical to SEQ ID NO: 20546
  derived and/or modified sequence opt2 from anti-influenza_Chain

SEQ ID NO: 20550 - RNA, 1353 nt, Artificial Sequence; identical to SEQ ID NO: 20547
  derived and/or modified sequence opt2 from anti-influenza_Chain

SEQ ID NO: 20551 - RNA, 1353 nt, Artificial Sequence; identical to SEQ ID NO: 20548
  derived and/or modified sequence opt2 from anti-influenza_Chain

SEQ ID NO: 20552 - RNA, 1356 nt, Artificial Sequence
  derived and/or modified sequence opt2 from anti-influenza_Chain
cagguccagcucguccaguccggcggcggccucgucaagcccggcggcucccuccgccucuccugcgccgccuccggcuucaccuucuccuccuacuccaugaacuggguccgccaggcccccggcaagggccucgagugggucuccuccaucuccuccuccuccuccuacaucuacuacgucgacuccgucaagggccgcuucaccaucucccgcgacaacgccaagaacucccucuaccuccagaugaacucccuccgcgccgaggacaccgccgucuacuacugcgcccgcggcggcggcuccuacggcgccuacgagggcuucgacuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 20553 - RNA, 1356 nt, Artificial Sequence
  derived and/or modified sequence opt2 from anti-influenza_Chain
cagguccagcucguccaguccggcgccgaggucaagcagcccggcgccuccgucaaggucuccugcaaggccuccggcuacaccuucaacgccuacuacauccacuggguccgccaggcccccggccagggccucgaguggaugggcuggaucaaccccaacuucggcggcacccacuacgcccgcaaguuccagggccgcgucaccaugacccgcgacgccuccaucaacaccgccuacauggagcucgaccgccucaucuccgacgacaccgccgucuacuacugcguccgcuggcgcgccgccgccgucaucauggaccaguucuacaagauggacgucuggggccagggcacccucgucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcaccaagaccuacaccugcaacgucgaccacaagcccuccaacaccaaggucgacaagacccgcgaguccaaguacggcccccccugccccuccugccccgcccccgaguuccucggcggccccuccgucuuccucuucccccccaagcccaaggacacccucaugaucucccgcacccccgaggucaccugcgucgucgucgacgucucccaggaggaccccgagguccaguucaacugguacgucgacggcgucgagguccacaacgccaagaccaagccccgcgaggagcaguucaacuccaccuaccgcgucgucuccguccucaccguccuccaccaggacuggcucaacggcaaggaguacaagugcaaggucuccaacaagggccuccccuccuccaucgagaagaccaucuccaaggccaagggccagccccgcgagccccaggucuacacccucccccccgcccaggaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacucccgccucaccgucgacaagucccgcuggcaggagggcaacgucuucuccugcuccgucaugcacgaggcccuccacaaccacuacacccagaagucccucucccucucccucggcaag

SEQ ID NO: 20554 - RNA, 1356 nt, Artificial Sequence
  derived and/or modified sequence opt2 from anti-influenza_Chain
gagguccagcucguccaguccggcgccgaggucaagaagcccggcgccuccgucaaggucuccugcaaggccuccggcuacaucuucaccggcuacuacauccacuggguccgccaggcccccggccagggccucgaguggaugggccgcaucgaccccaacggcgccggcaccaccuacgcccagaaguuccagggccgcgucacccucaccauggacaccuccaucaccaccgccuacauggagcucucccgccuccgcuucgacgacaccgccaucuacuacugcgcccgcugggacuggaacuucgaccucuaccucggcugguucgaccccuggggccagggcacccccgucaccgucgccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugcgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 20555 - RNA, 1356 nt, Artificial Sequence; identical to SEQ ID NO: 20553
  derived and/or modified sequence opt2 from anti-influenza_Chain

SEQ ID NO: 20556 - RNA, 1356 nt, Artificial Sequence; identical to SEQ ID NO: 20552
  derived and/or modified sequence opt2 from anti-influenza_Chain

SEQ ID NO: 20557 - RNA, 1356 nt, Artificial Sequence; identical to SEQ ID NO: 20554
  derived and/or modified sequence opt2 from anti-influenza_Chain

SEQ ID NO: 20558 - RNA, 1359 nt, Artificial Sequence
  derived and/or modified sequence opt2 from anti-influenza_Chain
cagguccagcucguccaguccggcgccgaggucaagaagcccggcuccuccguccgcgucuccugcaaggccuccggcuccaucuuccgcaacuacgccauguccuggguccgccaggcccccggccagggccucgaguggaugggcggcaucaucgccaucuucggcacccccaaguacgcccagaaguuccagggccgcgucaccaucaccgccgacgaguccaccuccaccgucuacauggagcucuccggccuccgcuccgaggacaccgccauguacuacugcgcccgcaucccccacuacaacuucggcuccggcuccuacuucgacuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 20559 - RNA, 1359 nt, Artificial Sequence
  derived and/or modified sequence opt2 from anti-influenza_Chain
cagguccagcucguccaguccggcgccgaggucaagaagcccggcgccuccgucaaggucuccugcaaggccuccggcuacaucuucaccggcuacuacauccacuggguccgccaggcccccggccagggccucgaguggaugggccgcaucgaccccaacggcuccggcaccaccuacgcccagaaguuccagggccgcgucacccucaccauggacaccuccaucaccaccgccuacauggagcucucccgccuccgcuucgacgacaccgccaucuacuacugcgcccgcugggacuggaacuucgaccucuaccucggcugguucgaccccuggggccagggcacccccgucaccgucgccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 20560 - RNA, 1359 nt, Artificial Sequence
  derived and/or modified sequence opt2 from anti-influenza_Chain
gagguccagcucguccaguccggcgccgaggucaagaagcccggcgccuccgucaaggucuccugcaaggccuccggcuacaucuucaccggcuacuacauccacuggguccgccaggcccccggccagggccucgaguggaugggccgcaucgaccccaacggcgccggcaccaccuacgcccagaaguuccagggccgcgucacccucaccauggacaccuccaucaccaccgccuacauggagcucucccgccuccgcuucgacgacaccgccaucuacuacugcgcccgcugggacuggaacuucgaccucuaccucggcugguucgaccccuggggccagggcacccccgucaccgucgccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 20561 - RNA, 1359 nt, Artificial Sequence
  derived and/or modified sequence opt2 from anti-influenza_Chain
cagguccagcucguccaguccggcgccgaggucaagaagcccggcgccuccgucaaggucuccugcaaggccuccggcuacaccuucaacgcccaccacaugcacuggguccgccaggcccccggccagggccucggcuggaugggcuggaucgaccccaacaacgacggcaccaucuacgcccagaaguuccagggccgcgucacccucaccauggacaccuccauccacaccgccuacauggagcucuccggccuccgcuacgacgacaccgccaucuacuacugcguccgcugggccuggaacuucgacuucuuccucggcugguucgaccccuggggccagggcacccucgucaccgucgccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 20562 - RNA, 1359 nt, Artificial Sequence
  derived and/or modified sequence opt2 from anti-influenza_Chain
gagguccagcucguccaguccggcgccgaggucaagaagcccggcgagucccucaagaucuccugcaaggucuccggcuacuccuucaccucccaguggaucggcuggguccgccagaugcccggcaagggccucgaguggaucggcaugauguaccccggcgacuccgacaccaucuacucccccuccuuccagggccaggucaccaucuccgccgacaacuccaucuccaccgccuaccuccagugguccucccucaaggccuccgacaccgccaucuacuacugcgccuccggccccggcuacuccggcuaccacuacggcugguucgacaccuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 20563 - RNA, 1359 nt, Artificial Sequence
  derived and/or modified sequence opt2 from anti-influenza_Chain
gagguccagcucguccaguccggcgccgaggucaagaagcccggcgagucccucaagaucuccugcaaggucuccggcuacuccuucaccucccaguggaucggcuggguccgccagaugcccggcaagggccucgaguggaucggcaugauguaccccggcgacgccgacgccaucuacucccccuccuuccagggccaggucaccaucuccgccgacaacuccaucuccaccgccuaccuccagugguccucccucaaggccuccgacaccgccaucuacuacugcgccuccggccccggcuacuccggcuaccacuacggcugguucgacaccuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 20564 - RNA, 1359 nt, Artificial Sequence; identical to SEQ ID NO: 16307
  derived and/or modified sequence opt2 from anti-influenza_Chain

SEQ ID NO: 20565 - RNA, 1359 nt, Artificial Sequence
  derived and/or modified sequence opt2 from anti-influenza_Chain
gagguccagcucguccaguccggcgccgaggucaagaagcccggcgagucccucaagaucuccugcaaggucuccggcuacuccuucaccucccaguggaucggcuggguccgccagaugcccggcaagggccucgaguggaucggcaugauguaccccggcgacgccgacaccaucuacucccccuccuuccagggccaggucaccaucuccgccgacaacuccaucuccaccgccuaccuccagugguccucccucaaggccuccgacaccgccaucuacuacugcgccuccggccccggcuacuccggcuaccacuacggcugguucgacaccuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 20566 - RNA, 1359 nt, Artificial Sequence
  derived and/or modified sequence opt2 from anti-influenza_Chain
gagguccagcucguccaguccggcgccgaggucaagaagcccggcgagucccucaagaucuccugcaaggucuccggcuacuccuucaccucccaguggaucggcuggguccgccagaugcccggcaagggccucgaguggaucggcaugauguaccccggcuccuccgacaccaucuacucccccuccuuccagggccaggucaccaucuccgccgacaacuccaucuccaccgccuaccuccagugguccucccucaaggccuccgacaccgccaucuacuacugcgccuccggccccggcuacuccggcuaccacuacggcugguucgacaccuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 20567 - RNA, 1359 nt, Artificial Sequence
  derived and/or modified sequence opt2 from anti-influenza_Chain
gagguccagcucguccaguccggcgccgaggucaagaagcccggcgagucccucaagaucuccugcaaggucuccggcuacuccuucaccucccaguggaucggcuggguccgccagaugcccggcaagggccucgaguggaucggcaugauguaccccggcgacuccgacgccaucuacucccccuccuuccagggccaggucaccaucuccgccgacaacuccaucuccaccgccuaccuccagugguccucccucaaggccuccgacaccgccaucuacuacugcgccuccggccccggcuacuccggcuaccacuacggcugguucgacaccuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 20568 - RNA, 1359 nt, Artificial Sequence
  derived and/or modified sequence opt2 from anti-influenza_Chain
gagguccagcucguccaguccggcgccgaggucaagaagcccggcgagucccucaagaucuccugcaaggucuccggcuacuccuucaccucccaguggaucggcuggguccgccagaugcccggcaagggccucgaguggaucggcaugauguaccccggcgacaccgacaccaucuacucccccuccuuccagggccaggucaccaucuccgccgacaacuccaucuccaccgccuaccuccagugguccucccucaaggccuccgacaccgccaucuacuacugcgccuccggccccggcuacuccggcuaccacuacggcugguucgacaccuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 20569 - RNA, 1359 nt, Artificial Sequence
  derived and/or modified sequence opt2 from anti-influenza_Chain
gagguccagcucguccaguccggcgccgaggucaagaagcccggcgagucccucaagaucuccugcaaggucuccggcuacuccuucaccucccaguggaucggcuggguccgccagaugcccggcaagggccucgaguggaucggcaugauguaccccggcgaguccgacaccaucuacucccccuccuuccagggccaggucaccaucuccgccgacaacuccaucuccaccgccuaccuccagugguccucccucaaggccuccgacaccgccaucuacuacugcgccuccggccccggcuacuccggcuaccacuacggcugguucgacaccuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 20570 - RNA, 1359 nt, Artificial Sequence; identical to SEQ ID NO: 20558
  derived and/or modified sequence opt2 from anti-influenza_Chain

SEQ ID NO: 20571 - RNA, 1359 nt, Artificial Sequence; identical to SEQ ID NO: 20559
  derived and/or modified sequence opt2 from anti-influenza_Chain

SEQ ID NO: 20572 - RNA, 1359 nt, Artificial Sequence; identical to SEQ ID NO: 20560
  derived and/or modified sequence opt2 from anti-influenza_Chain

SEQ ID NO: 20573 - RNA, 1359 nt, Artificial Sequence; identical to SEQ ID NO: 20561
  derived and/or modified sequence opt2 from anti-influenza_Chain

SEQ ID NO: 20574 - RNA, 1359 nt, Artificial Sequence; identical to SEQ ID NO: 20562
  derived and/or modified sequence opt2 from anti-influenza_Chain

SEQ ID NO: 20575 - RNA, 1359 nt, Artificial Sequence; identical to SEQ ID NO: 20563
  derived and/or modified sequence opt2 from anti-influenza_Chain

SEQ ID NO: 20576 - RNA, 1359 nt, Artificial Sequence; identical to SEQ ID NO: 16307
  derived and/or modified sequence opt2 from anti-influenza_Chain

SEQ ID NO: 20577 - RNA, 1359 nt, Artificial Sequence; identical to SEQ ID NO: 20565
  derived and/or modified sequence opt2 from anti-influenza_Chain

SEQ ID NO: 20578 - RNA, 1359 nt, Artificial Sequence; identical to SEQ ID NO: 20566
  derived and/or modified sequence opt2 from anti-influenza_Chain

SEQ ID NO: 20579 - RNA, 1359 nt, Artificial Sequence; identical to SEQ ID NO: 20567
  derived and/or modified sequence opt2 from anti-influenza_Chain

SEQ ID NO: 20580 - RNA, 1359 nt, Artificial Sequence; identical to SEQ ID NO: 20568
  derived and/or modified sequence opt2 from anti-influenza_Chain

SEQ ID NO: 20581 - RNA, 1359 nt, Artificial Sequence; identical to SEQ ID NO: 20569
  derived and/or modified sequence opt2 from anti-influenza_Chain

SEQ ID NO: 20582 - RNA, 1365 nt, Artificial Sequence
  derived and/or modified sequence opt2 from anti-influenza_Chain
cagguccagcucgucgaguccggcggcggcgucguccagcccggccgcucccuccgccucuccugcgccgccuccggcuucgccuuccacaaccgcgccaugcacuggguccgccaggcccccggcaagggccucgagugggucgcccucaucuacuucgacggcuccaagcaguacuacgccgacuccgucaagggccgcuucaccaucucccgcgacaacuccaagaacaccgucuuccuccagaugaacucccuccgccccgaggacaccgccgucuacuacugcgccguccccggccccaucuucggcaucuucccccccugguccuacuucgaccacuggggccagggcauccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 20583 - RNA, 1365 nt, Artificial Sequence
  derived and/or modified sequence opt2 from anti-influenza_Chain
gagguccagcucgucgaguccggcggcggcgucguccagcccggccgcucccuccgccucuccugcgccgccuccggcuucgccuuccacaaccgcgccaugcacuggguccgccaggcccccggcaagggccucgagugggucgcccucaucuacuucgacggcuccaagcaguacuacgccgacuccgucaagggccgcuucaccaucucccgcgacaacuccaagaacaccgucuuccuccagaugaacucccuccgccccgaggacaccgccgucuacuacugcgccguccccggccccaucuucggcaucuucccccccugguccuacuucgaccacuggggccagggcauccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 20584 - RNA, 1365 nt, Artificial Sequence
  derived and/or modified sequence opt2 from anti-influenza_Chain
gagguccagcucguccaguccggcggcggcgucguccagcccggcaagucccuccgccucuccugcgccgccuccggccucaccuucuccuccuacgccguccacuggguccgccaggcccccggcaagggccucgagugggucacccucaucuccuacgacggcgccaaccaguacuacgccgacuccgucaagggccgcuucaccaucucccgcgacaacuccaagaacaccgucuaccuccagaugaacucccuccgccccgaggacaccgccgucuacuacugcgccguccccggccccgucuucggcaucuucccccccugguccuacuucgacaacuggggccagggcauccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 20585 - RNA, 1365 nt, Artificial Sequence
  derived and/or modified sequence opt2 from anti-influenza_Chain
cagguccagcucgucgaguccggcggcggcgucguccagcccggcaagucccuccgccucuccugcgccgccuccggccucaccuucuccuccuacgccguccacuggguccgccaggcccccggcaagggccucgagugggucacccucaucuccuacgacggcgccaaccaguacuacgccgacuccgucaagggccgcuucaccaucucccgcgacaacuccaagaacaccgucuaccuccagaugaacucccuccgccccgaggacaccgccgucuacuacugcgccguccccggccccgucuucggcaucuucccccccugguccuacuucgacaacuggggccagggcauccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 20586 - RNA, 1365 nt, Artificial Sequence
  derived and/or modified sequence opt2 from anti-influenza_Chain
cagguccagcucgucgaguccggcggcggcgucguccagcccggcaaguccccccgccucuccugcgccgccuccggccccaccuucuccuccuacgccguccacuggguccgccaggcccccggcaagggccucgagugggucacccucaucuccuacgacggcgccaaccaguacuacgccgacuccgucaagggccgcuucaccaucucccgcgacaacuccaagaacaccgucuaccuccagaugaacucccuccgccccgaggacaccgccgucuacuacugcgccguccccggccccgucuucggcaucuucccccccugguccuacuucgacaacuggggccagggcauccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 20587 - RNA, 1365 nt, Artificial Sequence; identical to SEQ ID NO: 16291
  derived and/or modified sequence opt2 from anti-influenza_Chain

SEQ ID NO: 20588 - RNA, 1365 nt, Artificial Sequence
  derived and/or modified sequence opt2 from anti-influenza_Chain
cagguccagcucguccaguccggcgccgagcucaagcgccccggcgccuccgucaaggucuccugcaagaccuccggcuacuccuucaacaacuacggcaucaacuggguccgccaggcccccggccagggccucgaguggaugggcuggaucuccgccuacaccggcaacacccacuacgccaagaacuucgagggccgcgucacccucaccaccgacaccuccaccuccaccgccuacauggagguccgcucccuccgcuccgacgacuccgccgucuacuucugcgcccgcgccaugauccagggcgucgucacccucuaccuccgccccggcgacuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 20589 - RNA, 1365 nt, Artificial Sequence; identical to SEQ ID NO: 20582
  derived and/or modified sequence opt2 from anti-influenza_Chain

SEQ ID NO: 20590 - RNA, 1365 nt, Artificial Sequence; identical to SEQ ID NO: 20583
  derived and/or modified sequence opt2 from anti-influenza_Chain

SEQ ID NO: 20591 - RNA, 1365 nt, Artificial Sequence; identical to SEQ ID NO: 20584
  derived and/or modified sequence opt2 from anti-influenza_Chain

SEQ ID NO: 20592 - RNA, 1365 nt, Artificial Sequence; identical to SEQ ID NO: 20585
  derived and/or modified sequence opt2 from anti-influenza_Chain

SEQ ID NO: 20593 - RNA, 1365 nt, Artificial Sequence; identical to SEQ ID NO: 20586
  derived and/or modified sequence opt2 from anti-influenza_Chain

SEQ ID NO: 20594 - RNA, 1365 nt, Artificial Sequence; identical to SEQ ID NO: 16291
  derived and/or modified sequence opt2 from anti-influenza_Chain

SEQ ID NO: 20595 - RNA, 1365 nt, Artificial Sequence; identical to SEQ ID NO: 20588
  derived and/or modified sequence opt2 from anti-influenza_Chain

SEQ ID NO: 20596 - RNA, 1368 nt, Artificial Sequence
  derived and/or modified sequence opt2 from anti-influenza_Chain
gagguccagcucguccaguccggcggcggcgucguccagccccgccgcucccuccgccucuccugcgccgccuccggcuucaccuucuccuccuacgccaugcacuggguccgccaggcccccggcaagggccucgagugggucgccgucaucuccuacgacggccgcaacaaguacuacgccgacuccgucaagggccgcuucaccgucucccgcgacaacuccaagaacacccucuaccuccagaugaacucccuccgcgccgaggacaccuccgucuacuacugcgcccgcgagcuccucauggacuacuacgaccacaucggcuacucccccggccccaccuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 20597 - RNA, 1371 nt, Artificial Sequence
  derived and/or modified sequence opt2 from anti-influenza_Chain
auggucauccagcgcaacuccauccuccuccucaucaucaucuucgccuccuccaucuccaccugccgcuccaacgucaucgacgacaaccucuucaagcaggucuacgacaacauccucgagcaggaguucgcccacgacuuccaggccuaccucuccuaccucuccaagaacaucgaguccaacaacaacaucgacaaggucgacaagaacggcaucaaggucaucaacguccucuccuucggcgccaagggcgacggcaagaccuacgacaacaucgccuucgagcaggccuggaacgaggccugcuccucccgcacccccguccaguucgucguccccaagaacaagaacuaccuccucaagcagaucaccuucuccggccccugccgcuccuccaucuccgucaagaucuucggcucccucgaggccuccuccaagaucuccgacuacaaggaccgccgccucuggaucgccuucgacuccguccagaaccucgucgucggcggcggcggcaccaucaacggcaacggccaggucugguggcccuccuccugcaagaucaacaagucccuccccugccgcgacgcccccaccgcccucaccuucuggaacugcaagaaccucaaggucaacaaccucaaguccaagaacgcccagcagauccacaucaaguucgaguccugcaccaacgucgucgccuccaaccucaugaucaacgccuccgccaagucccccaacaccgacggcguccacgucuccaacacccaguacauccagaucuccgacaccaucaucggcaccggcgacgacugcaucuccaucgucuccggcucccagaacguccaggccaccaacaucaccugcggccccggccacggcaucuccaucggcucccucggcuccggcaacuccgaggccuacgucuccaacgucaccgucaacgaggccaagaucaucggcgccgagaacggcguccgcaucaagaccuggcagggcggcuccggccaggccuccaacaucaaguuccucaacgucgagaugcaggacgucaaguaccccaucaucaucgaccagaacuacugcgaccgcgucgagcccugcauccagcaguucuccgccguccaggucaagaacgucgucuacgagaacaucaagggcaccuccgccaccaaggucgccaucaaguucgacugcuccaccaacuuccccugcgagggcaucaucauggagaacaucaaccucgucggcgaguccggcaagcccuccgaggccaccugcaagaacguccacuucaacaacgccgagcacgucaccccccacugcaccucccucgagaucuccgaggacgaggcccuccucuacaacuac

SEQ ID NO: 20598 - RNA, 1371 nt, Artificial Sequence; identical to SEQ ID NO: 20597
  derived and/or modified sequence opt2 from anti-influenza_Chain

SEQ ID NO: 20599 - RNA, 1380 nt, Artificial Sequence
  derived and/or modified sequence opt2 from anti-influenza_Chain
augaagcucuggcucaacuggaucuuccucgucacccuccucaacgacauccagugcgaggucaagcucgucgaguccggcggcggccucguccagcccggcggcucccuccgccucuccugcgccaccuccggcuucaccuucuccgacuacuacauguccuggguccgccagucccccggcaaggcccucgaguggcucggcuucacccgcucccgcguccucggcuacaccaccgacuacuccgccuccgucaagggccgcuucaccaucucccgcgacaacucccaguccauccucuaccuccagaugaacucccuccgcggcgaggacuccgccaccuacuacugcgcccgcgaccgccccauggacuacuggggccagggcaccuccgucaccgucuccuccgccaagaccaccccccccuccgucuacccccucgcccccggcuccgccgcccagaccaacuccauggucacccucggcugccucgucaagggcuacuuccccgagcccgucaccgucaccuggaacuccggcucccucuccuccggcguccacaccuuccccgccguccuccaguccgaccucuacacccucuccuccuccgucaccguccccuccuccaccuggcccuccgagaccgucaccugcaacgucgcccaccccgccuccuccaccaaggucgacaagaagaucgucccccgcgacugcggcugcaagcccugcaucugcaccguccccgaggucuccuccgucuucaucuucccccccaagcccaaggacguccucaccaucacccucacccccaaggucaccugcgucgucgucgacaucuccaaggacgaccccgagguccaguucuccugguucgucgacgacgucgagguccacaccgcccagacccagccccgcgaggagcaguucaacuccaccuuccgcuccgucuccgagcuccccaucaugcaccaggacuggcucaacggcaaggaguucaagugccgcgucaacuccgccgccuuccccgcccccaucgagaagaccaucuccaagaccaagggccgccccaaggccccccaggucuacaccauccccccccccaaggagcagauggccaaggacaaggucucccucaccugcaugaucaccgacuucuuccccgaggacaucaccgucgaguggcaguggaacggccagcccgccgagaacuacaagaacacccagcccaucauggacaccgacggcuccuacuucgucuacuccaagcucaacguccagaaguccaacugggaggccggcaacaccuucaccugcuccguccuccacgagggccuccacaaccaccacaccgagaagucccucucccacucccccggcaag

SEQ ID NO: 20600 - RNA, 1380 nt, Artificial Sequence; identical to SEQ ID NO: 20599
  derived and/or modified sequence opt2 from anti-influenza_Chain

SEQ ID NO: 20601 - RNA, 1386 nt, Artificial Sequence
  derived and/or modified sequence opt2 from anti-influenza_Chain
auggagugguccuggaucuuccucuuccuccucuccggcaccgccggcguccacuccgagguccagcuccagcaguccggccccgagcucgucaagcccggcgccuccgucaagauguccugcaaggccuccggcuacaccuucaccuccuacgucaugcacugggucaagcagaagcccggccagggccucgaguggaucggcuacaucaaccccuacaacgacggcacccgcuacaacgagaaguuccgcgucaaggccacccucaccuccgacaaguccuccuccaccgccuacauggagcucuccucccucaccuccgaggacuccgccgucuacuacugcgcccgccgcggccucaucaccacccccacccucgacuacuggggccagggcaccacccucaccgucuccuccgccaagaccaccccccccuccgucuacccccucgcccccggcuccgccgcccagaccaacuccauggucacccucggcugccucgucaagggcuacuuccccgagcccgucaccgucaccuggaacuccggcucccucuccuccggcguccacaccuuccccgccguccuccaguccgaccucuacacccucuccuccuccgucaccguccccuccuccaccuggcccuccgagaccgucaccugcaacgucgcccaccccgccuccuccaccaaggucgacaagaagaucgucccccgcgacugcggcugcaagcccugcaucugcaccguccccgaggucuccuccgucuucaucuucccccccaagcccaaggacguccucaccaucacccucacccccaaggucaccugcgucgucgucgacaucuccaaggacgaccccgagguccaguucuccugggucgacgacgucgagguccacaccgcccagacccagccccgcgaggagcaguucaacuccaccuuccgcuccgucuccgagcuccccaucaugcaccaggacuggcucaacggcaaggaguucaagugccgcgucaacuccgccgccuuccccgcccccaucgagaagaccaucuccaagaccaagggccgccccaaggccccccaggucuacaccauccccccccccaaggagcagauggccaaggacaaggucucccucaccugcaugaucaccgacuucuuccccgaggacaucaccgucgaguggcaguggaacggccagcccgccgagaacuacaagaacacccagcccaucauggacaccgacggcuccuacuucgucuacuccaagcucaacguccagaaguccaacugggaggccggcaacaccuucaccugcuccguccuccacgagggccuccacaaccaccacaccgagaagucccucucccacucccccggcaag

SEQ ID NO: 20602 - RNA, 1386 nt, Artificial Sequence
  derived and/or modified sequence opt2 from anti-influenza_Chain
cagguccagcucguccaguccggcgccgaggucaagaagcccggcgccuccgucaaggucuccugcaagaccuccggcuacaccuucaccgccuacaccauccacuggguccgccaggcccccggccagcgccucgaguggaugggcuggaucaacgccggcaacggccacaccaaguacucccagcgcuucaagggccgcgucaccaucacccgcgacaccuccgcccgcaccaccuacauggagcuccgcucccucaccuccgaggacaccgcccucuacuucugcgcccgcggccccgagaccuacuacuacgacaagaccaacuggcucaacucccaccccgacgaguacuuccagcacuggggccacggcacccaggucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 20603 - RNA, 1386 nt, Artificial Sequence; identical to SEQ ID NO: 20602
  derived and/or modified sequence opt2 from anti-influenza_Chain

SEQ ID NO: 20604 - RNA, 1386 nt, Artificial Sequence; identical to SEQ ID NO: 20601
  derived and/or modified sequence opt2 from anti-influenza_Chain

SEQ ID NO: 20605 - RNA, 1398 nt, Artificial Sequence
  derived and/or modified sequence opt2 from anti-influenza_Chain
augcuccccuccaccguccagacccucacccuccuccucaccuccggcggcguccuccucucccucuacgucuccgccucccucuccuaccuccucuacuccgacguccuccucaaguucuccuccaccaagaccaccgcccccaccaugucccucgagugcaccaacgccuccaacgcccagaccgucaaccacuccgccaccaaggagaugaccuuccccccccccgagcccgaguggaccuacccccgccucuccugccagggcuccaccuuccagaaggcccuccucaucuccccccaccgcuucggcgagaucaagggcaacuccgccccccucaucauccgcgagcccuucgucgccugcggccccaaggagugccgccacuucgcccucacccacuacgccgcccagcccggcggcuacuacaacggcacccgcaaggaccgcaacaagcuccgccaccucgucuccgucaagcucggcaagauccccaccgucgagaacuccaucuuccacauggccgccugguccggcuccgccugccacgacggccgcgaguggaccuacaucggcgucgacggccccgacaacgacgcccucgucaagaucaaguacggcgaggccuacaccgacaccuaccacuccuacgcccacaacauccuccgcacccaggaguccgccugcaacugcaucggcggcgacugcuaccucaugaucaccgacggcuccgccuccggcaucuccaagugccgcuuccucaagauccgcgagggccgcaucaucaaggagauccuccccaccggccgcgucgagcacaccgaggagugcaccugcggcuucgccuccaacaagaccaucgagugcgccugccgcgacaacuccuacaccgccaagcgccccuucgucaagcucaacgucgagaccgacaccgccgagauccgccucaugugcaccaagaccuaccucgacaccccccgccccgacgacggcuccaucgccggccccugcgaguccaacggcgacaaguggcucggcggcaucaagggcggcuucguccaccagcgcauggccuccaagaucggccgcugguacucccgcaccauguccaagaccaaccgcaugggcauggagcucuacgucaaguacgacggcgaccccuggaccgacuccgacgcccucacccucuccggcgucauggucuccaucgaggagcccggcugguacuccuucggcuucgagaucaaggacaagaagugcgacguccccugcaucggcaucgagaugguccacgacggcggcaaggacaccuggcacuccgccgccaccgccaucuacugccucaugggcuccggccagcuccucugggacaccgucaccggcgucgacauggcccuc

SEQ ID NO: 20606 - RNA, 1398 nt, Artificial Sequence; identical to SEQ ID NO: 20605
  derived and/or modified sequence opt2 from anti-influenza_Chain

SEQ ID NO: 20607 - RNA, 1407 nt, Artificial Sequence
  derived and/or modified sequence opt2 from anti-influenza_Chain
auggacuggaccuggcgcuuccucuucgucgucgccgccgccaccggcguccagucccagguccagcucguccaguccggcgccgaggucaagaagcccggcuccuccgucaaggucuccugcaaggccuccggcggcacccucaacaacuacgccaucuccuggguccgccaggcccccggccagggccucgaguggaugggcggcaucucccccaucuucggcacccucaacuacgccgagcgcuuccagggccgcgucaccaucaccgccgacgucuucaccaacaccgucuacauggagcucuccucccuccgcuccgaggacaccgccgucuacuucugcgcccgcggcugcggcuacaacugcuacuacuucgacggcuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgagggccuccacaaccacuacacccagaagucccucucccucucccccggcaag

SEQ ID NO: 20608 - RNA, 1407 nt, Artificial Sequence; identical to SEQ ID NO: 20607
  derived and/or modified sequence opt2 from anti-influenza_Chain

SEQ ID NO: 20609 - RNA, 1407 nt, Artificial Sequence; identical to SEQ ID NO: 20607
  derived and/or modified sequence opt2 from anti-influenza_Chain

SEQ ID NO: 20610 - RNA, 1413 nt, Artificial Sequence
  derived and/or modified sequence opt2 from anti-influenza_Chain
gacggcgucaagccccucauccuccgcgacugcuccgucgccggcuggcuccucggcaaccccaugugcgacgaguucaucaacguccccgagugguccuacaucgucgagaaggccaaccccgccaacgaccucugcuaccccggcaacuucaacgacuacgaggagcucaagcaccuccucucccgcaucaaccacuucgagaagauccagaucauccccaaguccuccugguccgaccacgaggccuccuccggcgucuccuccgccugccccuaccagggcacccccuccuucuuccgcaacgucgucuggcucaucaagaagaacaacaccuaccccaccaucaagcgcuccuacaacaacaccaaccaggaggaccuccucauccucuggggcauccaccacuccaacgacgccgccgagcagaccaagcucuaccagaaccccaccaccuacaucuccgucggcaccuccacccucaaccagcgccucguccccaagaucgccacccgcuccaaggucaacggccagaacggccgcauggacuucuucuggaccauccucaagcccaacgacgccaucaacuucgaguccaacggcaacuucaucgcccccgaguacgccuacaagaucgucaagaagggcuacauccccgaggccccccgcgacggccaggccuacguccgcaaggacggcgaguggguccuccucuccaccuuccuccgcuccgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 20611 - RNA, 1413 nt, Artificial Sequence; identical to SEQ ID NO: 20610
  derived and/or modified sequence opt2 from anti-influenza_Chain

SEQ ID NO: 20612 - RNA, 1416 nt, Artificial Sequence
  derived and/or modified sequence opt2 from anti-influenza_Chain
auggacuggaccuggcgcuuccucuucgucgucgccgccgccaccggcguccagugccagguccagcucguccaguccggcgccgaggucaagaugcccggcuccuccgucaaggucuccugcaagaccuccggcgucuucuucuccucccacgccaucuccuggguccgccaggcccccggccagggccucgaguggaugggcggcaucucccccauguucggcaccacccacuacgcccagaaguuccagggccgcgucaccaucaccgccgaccaguccaccaccaccgccuacauggagcucaccucccucaccuccgaggacaccgccgucuacuacugcgcccgcgacggcgccggcuccuacuacccccucaacugguucgaccccuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgagggccuccacaaccacuacacccagaagucccucucccucucccccggcaag

SEQ ID NO: 20613 - RNA, 1416 nt, Artificial Sequence; identical to SEQ ID NO: 20612
  derived and/or modified sequence opt2 from anti-influenza_Chain

SEQ ID NO: 20614 - RNA, 1416 nt, Artificial Sequence; identical to SEQ ID NO: 20612
  derived and/or modified sequence opt2 from anti-influenza_Chain

SEQ ID NO: 20615 - RNA, 1419 nt, Artificial Sequence
  derived and/or modified sequence opt2 from anti-influenza_Chain
augaccgaguccgccaugaccucccgcgccggccgcggccgcggcgccgaccucgucgccgccgucguccagggccacgccgccgccuccgacgccgccggcgaccucuccuuccccgacggcuucaucuggggcgccgccaccgccgccuaccagaucgagggcgccuggcgcgaggacggccgcggccucugggacgucuucucccacacccccggcaaggucgccuccggccacaccggcgacaucgccugcgaccacuaccaccgcuacgccgacgacguccgccucauggccggccucggcgaccgcgucuaccgcuucuccgucgccuggccccgcaucguccccgacggcuccggccccgucaaccccgccggccucgacuucuacgaccgccucgucgacgagcuccucggccacggcaucacccccuaccccacccucuaccacugggaccucccccagacccucgaggaccgcggcggcugggccgcccgcgacaccgccuaccgcuucgccgaguacgcccucgccguccaccgccgccucggcgaccgcguccgcugcuggaucacccucaacgagcccugggucgccgccuuccucgccacccaccgcggcgcccccggcgccgccgacgucccccgcuuccgcgccguccaccaccuccuccucggccacggccucggccuccgccuccgcuccgccggcgccggccagcucggccucacccucucccucucccccgucaucgaggcccgccccggcguccgcggcggcggccgccgcgucgacgcccucgccaaccgccaguuccucgaccccgcccuccgcggccgcuaccccgaggagguccucaagaucauggccggccacgcccgccucggccaccccggccgcgaccucgagaccauccaccagcccgucgaccuccucggcgucaacuacuacucccacguccgccucgccgccgagggcgagcccgccaaccgccuccccggcuccgagggcauccgcuucgagcgccccaccgccgucaccgccuggcccggcgaccgccccgacggccuccgcacccuccuccuccgccucucccgcgacuaccccggcgucggccucaucaucaccgagaacggcgccgccuucgacgaccgcgccgacggcgaccgcguccacgaccccgagcgcauccgcuaccucaccgccacccuccgcgccguccacgacgccaucauggccggcgccgaccuccgcggcuacuucgucugguccguccucgacaacuucgagugggccuacggcuaccacaagcgcggcaucgucuacgucgacuacaccaccaugcgccgcaucccccgcgaguccgcccucugguaccgcgacgucguccgccgcaacggccuccgcaacggcgag

SEQ ID NO: 20616 - RNA, 1419 nt, Artificial Sequence; identical to SEQ ID NO: 20615
  derived and/or modified sequence opt2 from anti-influenza_Chain

SEQ ID NO: 20617 - RNA, 1422 nt, Artificial Sequence
  derived and/or modified sequence opt2 from anti-influenza_Chain
cucucccgcaucaaccacuucgagaagauccagaucauccccaaguccuccugguccgaccacgaggccuccuccggcgucuccuccgccugccccuaccagggcacccccuccuucuuccgcaacgucgucuggcucaucaagaagaacaacaccuaccccaccaucaagcgcuccuacaacaacaccaaccaggaggaccuccucauccucuggggcauccaccacuccaacgacgccgccgagcagaccaagcucuaccagaaccccaccaccuacaucuccgucggcaccuccacccucaaccagcgccucguccccaagaucgccacccgcuccaaggucaacggccagaacggccgcauggacuucuucuggaccauccucaagcccaacgacgccaucaacuucgaguccaacggcaacuucaucgcccccgaguacgccuacaagaucgucaagaagggcgacuccgccaucgucaaguccgaggucgaguacggcaacugcaacaccaagugccagacccccaucggcgccaucaacuccuccaugcccuuccacaacauccacccccucaccaucggcgagugccccaaguacgucaaguccaacaagcucguccucgccaccggccuccgcaacuccccccucggcuacauccccgaggccccccgcgacggccaggccuacguccgcaaggacggcgaguggguccuccucuccaccuuccuccgcuccgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 20618 - RNA, 1422 nt, Artificial Sequence; identical to SEQ ID NO: 20617
  derived and/or modified sequence opt2 from anti-influenza_Chain

SEQ ID NO: 20619 - RNA, 1428 nt, Artificial Sequence
  derived and/or modified sequence opt2 from anti-influenza_Chain
auggaguucggccucuccugggucuuccucgucgcccuccuccgcggcguccagugccagguccagcucgucgaguccggcggcggcgucguccagcccggccgcucccuccgccucuccugcgccgccuccggcuucaccuucucccgcuucggcauccacuggguccgccaggcccccggcaagggccucgaguggauggccgucaucugguacgacggcuccaacaaguucuacgccgacuccgucaagggccgcuucaccaucucccgcgacaacuccaagaacaccgucuaccuccagaugaacucccuccgcgccgaggacaccgccgucuacuacugcgccaaggacucccgcggcuacugcuccuccaucaucugcuucgagggcggccucgacaacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgagggccuccacaaccacuacacccagaagucccucucccucucccccggcaag

SEQ ID NO: 20620 - RNA, 1428 nt, Artificial Sequence; identical to SEQ ID NO: 20619
  derived and/or modified sequence opt2 from anti-influenza_Chain

SEQ ID NO: 20621 - RNA, 1428 nt, Artificial Sequence; identical to SEQ ID NO: 20619
  derived and/or modified sequence opt2 from anti-influenza_Chain

SEQ ID NO: 20622 - RNA, 1440 nt, Artificial Sequence
  derived and/or modified sequence opt2 from anti-influenza_Chain
augcccuccgucaagaucggcaucaucggcgccggcuccgccgucuucucccuccgccucgucuccgaccucugcaagacccccggccucuccggcuccaccgucacccucauggacaucgacgaggagcgccucgacgccauccucaccaucgccaagaaguacgucgaggaggucggcgccgaccucaaguucgagaagaccaugaaccucgacgacgucaucaucgacgccgacuucgucaucaacaccgccauggucggcggccacaccuaccucgagaagguccgccagaucggcgagaaguacggcuacuaccgcggcaucgacgcccaggaguucaacauggucuccgacuacuacaccuucuccaacuacaaccagcucaaguacuucgucgacaucgcccgcaagaucgagaagcucucccccaaggccugguaccuccaggccgccaaccccaucuucgagggcaccacccucgucacccgcaccguccccaucaaggccgucggcuucugccacggccacuacggcgucauggagaucgucgagaagcucggccucgaggaggagaaggucgacuggcaggucgccggcgucaaccacggcaucuggcucaaccgcuuccgcuacaacggcggcaacgccuacccccuccucgacaaguggaucgaggagaaguccaaggacuggaagcccgagaaccccuucaacgaccagcucucccccgccgccaucgacauguaccgcuucuacggcgucaugcccaucggcgacaccguccgcaacuccuccuggcgcuaccaccgcgaccucgagaccaagaagaagugguacggcgagcccuggggcggcgccgacuccgagaucggcuggaagugguaccaggacacccucggcaaggucaccgagaucaccaagaaggucgccaaguucaucaaggagaaccccuccguccgccucuccgaccucggcuccguccucggcaaggaccucuccgagaagcaguucguccucgaggucgagaagauccucgaccccgagcgcaaguccggcgagcagcacauccccuucaucgacgcccuccucaacgacaacaaggcccgcuucgucgucaacauccccaacaagggcaucauccacggcaucgacgacgacgucgucgucgagguccccgcccucgucgacaagaacggcauccaccccgagaagaucgagcccccccuccccgaccgcgucgucaaguacuaccuccgcccccgcaucaugcgcauggagauggcccucgaggccuuccucaccggcgacauccgcaucaucaaggagcuccucuaccgcgacccccgcaccaaguccgacgagcaggucgagaaggucaucgaggagauccucgcccuccccgagaacgaggagaugcgcaagcacuaccucaagcgc

SEQ ID NO: 20623 - RNA, 1440 nt, Artificial Sequence; identical to SEQ ID NO: 20622
  derived and/or modified sequence opt2 from anti-influenza_Chain

SEQ ID NO: 20624 - RNA, 1443 nt, Artificial Sequence
  derived and/or modified sequence opt2 from anti-influenza_Chain
augaaguuccccaaggacuucaugaucggcuacuccuccucccccuuccaguucgaggccggcauccccggcuccgaggaccccaacuccgacuggugggucuggguccacgaccccgagaacaccgccgccggccucgucuccggcgacuuccccgagaacggccccggcuacuggaaccucaaccagaacgaccacgaccucgccgagaagcucggcgucaacaccauccgcgucggcgucgaguggucccgcaucuuccccaagcccaccuucaacgucaagguccccgucgagcgcgacgagaacggcuccaucguccacgucgacgucgacgacaaggccgucgagcgccucgacgagcucgccaacaaggaggccgucaaccacuacgucgagauguacaaggacugggucgagcgcggccgcaagcucauccucaaccucuaccacuggccccucccccucuggcuccacaaccccaucaugguccgccgcaugggccccgaccgcgcccccuccggcuggcucaacgaggaguccgucgucgaguucgccaaguacgccgccuacaucgccuggaagaugggcgagcuccccgucaugugguccaccaugaacgagcccaacgucgucuacgagcagggcuacauguucgucaagggcggcuucccccccggcuaccucucccucgaggccgccgacaaggcccgccgcaacaugauccaggcccacgcccgcgccuacgacaacaucaagcgcuucuccaagaagcccgucggccucaucuacgccuuccagugguucgagcuccucgagggccccgccgaggucuucgacaaguucaaguccuccaagcucuacuacuucaccgacaucgucuccaagggcuccuccaucaucaacgucgaguaccgccgcgaccucgccaaccgccucgacuggcucggcgucaacuacuacucccgccucgucuacaagaucgucgacgacaagcccaucauccuccacggcuacggcuuccucugcacccccggcggcaucucccccgccgagaaccccugcuccgacuucggcugggaggucuaccccgagggccucuaccuccuccucaaggagcucuacaaccgcuacggcgucgaccucaucgucaccgagaacggcgucuccgacucccgcgacgcccuccgccccgccuaccucgucucccacgucuacuccgucuggaaggccgccaacgagggcauccccgucaagggcuaccuccacuggucccucaccgacaacuacgagugggcccagggcuuccgccagaaguucggccucgucauggucgacuucaagaccaagaagcgcuaccuccgccccuccgcccucgucuuccgcgagaucgccacccacaacggcauccccgacgagcuccagcaccucacccucauccag

SEQ ID NO: 20625 - RNA, 1443 nt, Artificial Sequence; identical to SEQ ID NO: 20624
  derived and/or modified sequence opt2 from anti-influenza_Chain

SEQ ID NO: 20626 - RNA, 1464 nt, Artificial Sequence
  derived and/or modified sequence opt2 from anti-influenza_Chain
cacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccgccaacgaccucugcuaccccggcaacuucaacgacuacgaggagcucaagcaccuccucucccgcaucaaccacuucgagaagauccagaucauccccaaguccuccugguccgaccacgaggccuccuccggcgucuccuccgccugccccuaccagggcacccccuccuucuuccgcaacgucgucuggcucaucaagaagaacaacaccuaccccaccaucaagcgcuccuacaacaacaccaaccaggaggaccuccucauccucuggggcauccaccacuccaacgacgccgccgagcagaccaagcucuaccagaaccccaccaccuacaucuccgucggcaccuccacccucaaccagcgccucguccccaagaucgccacccgcuccaaggucaacggccagaacggccgcauggacuucuucuggaccauccucaagcccaacgacgccaucaacuucgaguccaacggcaacuucaucgcccccgaguacgccuacaagaucgucaagaagggcuacauccccgaggccccccgcgacggccaggccuacguccgcaaggacggcgaguggguccuccucuccaccuuccuccgcuccgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 20627 - RNA, 1464 nt, Artificial Sequence; identical to SEQ ID NO: 20626
  derived and/or modified sequence opt2 from anti-influenza_Chain

SEQ ID NO: 20628 - RNA, 1473 nt, Artificial Sequence
  derived and/or modified sequence opt2 from anti-influenza_Chain
augcucuccuuccccaagggcuucaaguucggcuggucccaguccggcuuccaguccgagaugggcacccccggcuccgaggaccccaacuccgacuggcacgucuggguccacgaccgcgagaacaucgucucccaggucgucuccggcgaccuccccgagaacggccccggcuacuggggcaacuacaagcgcuuccacgacgaggccgagaagaucggccucaacgccguccgcaucaacgucgaguggucccgcaucuucccccgcccccuccccaagcccgagaugcagaccggcaccgacaaggagaacucccccgucaucuccgucgaccucaacgaguccaagcuccgcgagauggacaacuacgccaaccacgaggcccucucccacuaccgccagauccucgaggaccuccgcaaccgcggcuuccacaucguccucaacauguaccacuggacccuccccaucuggcuccacgaccccauccgcguccgccgcggcgacuucaccggccccaccggcuggcucaacucccgcaccgucuacgaguucgcccgcuucuccgccuacgucgccuggaagcucgacgaccucgccuccgaguacgccaccaugaacgagcccaacgucgucuggggcgccggcuacgccuucccccgcgccggcuucccccccaacuaccucuccuuccgccucuccgagaucgccaaguggaacaucauccaggcccacgcccgcgccuacgacgccaucaaguccgucuccaagaaguccgucggcaucaucuacgccaacaccuccuacuacccccuccgcccccaggacaacgaggccgucgagaucgccgagcgccucaaccgcugguccuucuucgacuccaucaucaagggcgagaucaccuccgagggccagaacguccgcgaggaccuccgcaaccgccucgacuggaucggcgucaacuacuacacccgcaccgucgucaccaaggccgaguccggcuaccucacccuccccggcuacggcgaccgcugcgagcgcaacucccucucccucgccaaccuccccaccuccgacuucggcugggaguucuuccccgagggccucuacgacguccuccucaaguacuggaaccgcuacggccucccccucuacgucauggagaacggcaucgccgacgacgccgacuaccagcgccccuacuaccucgucucccacaucuaccagguccaccgcgcccucaacgagggcgucgacguccgcggcuaccuccacuggucccucgccgacaacuacgagugguccuccggcuucuccaugcgcuucggccuccucaaggucgacuaccucaccaagcgccucuacuggcgccccuccgcccucgucuaccgcgagaucacccgcuccaacggcauccccgaggagcucgagcaccucaaccgcgucccccccaucaagccccuccgccac

SEQ ID NO: 20629 - RNA, 1473 nt, Artificial Sequence; identical to SEQ ID NO: 20628
  derived and/or modified sequence opt2 from anti-influenza_Chain

SEQ ID NO: 20630 - RNA, 1494 nt, Artificial Sequence
  derived and/or modified sequence opt2 from anti-influenza_Chain
auggccucccagggcaccaagcgcuccuacgagcagauggagaccgacggcgagcgccagaacgccaccgagauccgcgccuccgucggcaagaugaucggcggcaucggccgcuucuacauccagaugugcaccgagcucaagcucuccgacuacgagggccgccucauccagaacucccucaccaucgagcgcaugguccucuccgccuucgacgagcgccgcaacaaguaccucgaggagcaccccuccgccggcaaggaccccaagaagaccggcggccccaucuaccgccgcgucaacggcaaguggaugcgcgagcucauccucuacgacaaggaggagauccgccgcaucuggcgccaggccaacaacggcgacgacgccaccgccggccucacccacaugaugaucuggcacuccaaccucaacgacgccaccuaccagcgcacccgcgcccucguccgcaccggcauggacccccgcaugugcucccucaugcagggcuccacccucccccgccgcuccggcgccgccggcgccgccgucaagggcgucggcaccauggucauggagcucguccgcaugaucaagcgcggcaucaacgaccgcaacuucuggcgcggcgagaacggccgcaagacccgcaucgccuacgagcgcaugugcaacauccucaagggcaaguuccagaccgccgcccagaaggccaugauggaccagguccgcgagucccgcgaccccggcaacgccgaguucgaggaccucaccuuccucgcccgcuccgcccucauccuccgcggcuccgucgcccacaaguccugccuccccgccugcgucuacggccccgccgucgccuccggcuacgacuucgagcgcgagggcuacucccucgucggcaucgaccccuuccgccuccuccagaacucccaggucuacucccucauccgccccaacgagaaccccgcccacaagucccagcucgucuggauggccugccacuccgccgccuucgaggaccuccgcguccucuccuucaucaagggcaccaaggucgucccccgcggcaagcucuccacccgcggcguccagaucgccuccaacgagaacauggagaccauggaguccuccacccucgagcuccgcucccgcuacugggccauccgcacccgcuccggcggcaacaccaaccagcagcgcgccuccgccggccagaucuccauccagcccaccuucuccguccagcgcaaccuccccuucgaccgcaccaccgucauggccgccuucaccggcaacaccgagggccgcaccuccgacaugcgcaccgagaucauccgcaugauggaguccgcccgccccgaggacgucuccuuccagggccgcggcgucuucgagcucuccgacgagaaggccgccucccccaucguccccuccuucgacauguccaacgagggcuccuacuucuucggcgacaacgccgaggaguacgacaac

SEQ ID NO: 20631 - RNA, 1494 nt, Artificial Sequence
  derived and/or modified sequence opt2 from anti-influenza_Chain
auggccucccagggcaccaagcgcuccuacgagcagauggagaccgacggcgagcgccagaacgccaccgagauccgcgccuccgucggcaagaugaucgacggcaucggccgcuucuacauccagaugugcaccgagcucaagcucuccgacuacgagggccgccucauccagaacucccucaccaucgagcgcaugguccucuccgccuucgacgagcgccgcaacaaguaccucgaggagcaccccuccgccggcaaggaccccaagaagaccggcggccccaucuacaagcgcgucgacggcaaguggaugcgcgagcucguccucuacgacaaggaggagauccgccgcaucuggcgccaggccaacaacggcgacgacgccaccgccggccucacccacaugaugaucuggcacuccaaccucaacgacaccaccuaccagcgcacccgcgcccucguccgcaccggcauggacccccgcaugugcucccucaugcagggcuccacccucccccgccgcuccggcgccgccggcgccgccgucaagggcgucggcaccauggucauggagcucauccgcaugaucaagcgcggcaucaacgaccgcaacuucuggcgcggcgagaacggccgcaagacccgcuccgccuacgagcgcaugugcaacauccucaagggcaaguuccagaccgccgcccagcgcgccaugauggaccagguccgcgagucccgcaaccccggcaacgccgagaucgaggaccucaucuuccucgcccgcuccgcccucauccuccgcggcuccgucgcccacaaguccugccuccccgccugcgucuacggccccgccaucgccuccggcuacaacuucgagaaggagggcuacucccucgucggcaucgaccccuucaagcuccuccagaacucccaggucuacucccucauccgccccaacgagaaccccgcccacaagucccagcucgucuggauggccugcaacuccgccgccuucgaggaccuccgcguccucuccuucauccgcggcaccaaggucuccccccgcggcaagcucuccacccgcggcguccagaucgccuccaacgagaacauggacaccauggaguccuccacccucgagcuccgcucccgcuacugggccauccgcacccgcuccggcggcaacaccaaccagcagcgcgccuccgccggccagaucuccguccagcccgccuucuccguccagcgcaaccuccccuucgacaagcccaccaucauggccgccuucaccggcaacaccgagggccgcaccuccgacaugcgcgccgagaucauccgcaugauggagggcgccaagcccgaggagauguccuuccagggccgcggcgucuucgagcucuccgacgagaaggccaccaaccccaucguccccuccuucgacauguccaacgagggcuccuacuucuucggcgacaacgccgaggaguacgacaac

SEQ ID NO: 20632 - RNA, 1494 nt, Artificial Sequence
  derived and/or modified sequence opt2 from anti-influenza_Chain
auggccucccagggcaccaagcgcuccuacgagcagauggagaccggcggcgagcgccagaacgccaccgagauccgcgccuccgucggccgcauggucggcggcaucggccgcuucuacguccagaugugcaccgagcucaagcucuccgaccaggagggccgccucauccagaacuccaucaccaucgagcgcaugguccucuccgccuucgacgagcgccgcaaccgcuaccucgaggagcaccccuccgccggcaaggaccccaagaagaccggcggccccaucuaccgccgccgcgacggcaaguggguccgcgagcucauccucuacgacaaggaggagauccgccgcaucuggcgccaggccaacaacggcgaggacgccaccgccggccucacccacaugaugaucuggcacuccaaccucaacgacgccaccuaccagcgcacccgcgcccucguccgcaccggcauggacccccgcaugugcucccucaugcagggcuccacccucccccgccgcuccggcgccgccggcgccgccaucaagggcgucggcaccauggucauggagcucauccgcaugaucaagcgcggcaucaacgaccgcaacuucuggcgcggcgacaacggccgccgcacccgcaucgccuacgagcgcaugugcaacauccucaagggcaaguuccagaccgccgcccagcgcgccaugauggaccagguccgcgagucccgcaaccccggcaacgccgagaucgaggaccucaucuuccucgcccgcuccgcccucauccuccgcggcuccgucgcccacaaguccugccuccccgccugcgucuacggccucgccgucgccuccggcuacgacuucgagcgcgagggcuacucccucgucggcaucgaccccuuccgccuccuccagaacucccaggucuucucccucauccgccccaacgagaaccccgcccacaagucccagcucgucuggauggccugccacuccgccgccuucgaggaccuccgcgucuccuccuucauccgcggcacccgcgucaucccccgcggccagcucuccacccgcggcguccagaucgccuccaacgagaacgucgaggccauggacuccuccacccucgagcuccgcucccgcuacugggccauccgcacccgcuccggcggcaacaccaaccagcagcgcgccuccgccggccagaucuccguccagcccaccuucuccguccagcgcaaccuccccuucgagcgccccaccaucauggccgccuucaagggcaacaccgagggccgcaccuccgacaugcgcaccgagaucauccgcaugauggaguccgcccgccccgaggacgucuccuuccagggccgcggcgucuucgagcucuccgacgagaaggccaccaaccccaucguccccuccuucgacauguccaacgagggcuccuacuucuucggcgacaacgccgaggaguacgacaac

SEQ ID NO: 20633 - RNA, 1494 nt, Artificial Sequence; identical to SEQ ID NO: 20630
  derived and/or modified sequence opt2 from anti-influenza_Chain

SEQ ID NO: 20634 - RNA, 1494 nt, Artificial Sequence; identical to SEQ ID NO: 20631
  derived and/or modified sequence opt2 from anti-influenza_Chain

SEQ ID NO: 20635 - RNA, 1494 nt, Artificial Sequence; identical to SEQ ID NO: 20632
  derived and/or modified sequence opt2 from anti-influenza_Chain

SEQ ID NO: 20636 - RNA, 1530 nt, Artificial Sequence
  derived and/or modified sequence opt2 from anti-influenza_Chain
auguuccccgagaaguuccucuggggcgucgcccaguccggcuuccaguucgagaugggcgacaagcuccgccgcaacaucgacaccaacaccgacugguggcacuggguccgcgacaagaccaacaucgagaagggccucgucuccggcgaccuccccgaggagggcaucaacaacuacgagcucuacgagaaggaccacgagaucgcccgcaagcucggccucaacgccuaccgcaucggcaucgaguggucccgcaucuuccccuggcccaccaccuucaucgacgucgacuacuccuacaacgaguccuacaaccucaucgaggacgucaagaucaccaaggacacccucgaggagcucgacgagaucgccaacaagcgcgaggucgccuacuaccgcuccgucaucaacucccuccgcuccaagggcuucaaggucaucgucaaccucaaccacuucacccuccccuacuggcuccacgaccccaucgaggcccgcgagcgcgcccucaccaacaagcgcaacggcugggucaacccccgcaccgucaucgaguucgccaaguacgccgccuacaucgccuacaaguucggcgacaucgucgacaugugguccaccuucaacgagcccauggucgucgucgagcucggcuaccucgcccccuacuccggcuucccccccggcguccucaaccccgaggccgccaagcucgccauccuccacaugaucaacgcccacgcccucgccuaccgccagaucaagaaguucgacaccgagaaggccgacaaggacuccaaggagcccgccgaggucggcaucaucuacaacaacaucggcgucgccuaccccaaggaccccaacgacuccaaggacgucaaggccgccgagaacgacaacuucuuccacuccggccucuucuucgaggccauccacaagggcaagcucaacaucgaguucgacggcgagaccuucaucgacgcccccuaccucaagggcaacgacuggaucggcgucaacuacuacacccgcgaggucgucaccuaccaggagcccauguuccccuccaucccccucaucaccuucaagggcguccagggcuacggcuacgccugccgccccggcacccucuccaaggacgaccgccccgucuccgacaucggcugggagcucuaccccgagggcauguacgacuccaucgucgaggcccacaaguacggcguccccgucuacgucaccgagaacggcaucgccgacuccaaggacauccuccgccccuacuacaucgccucccacaucaagaugaccgagaaggccuucgaggacggcuacgaggucaagggcuacuuccacugggcccucaccgacaacuucgagugggcccucggcuuccgcaugcgcuucggccucuacgaggucaaccucaucaccaaggagcgcaucccccgcgagaaguccgucuccaucuuccgcgagaucgucgccaacaacggcgucaccaagaagaucgaggaggagcuccuccgcggc

SEQ ID NO: 20637 - RNA, 1530 nt, Artificial Sequence; identical to SEQ ID NO: 20636
  derived and/or modified sequence opt2 from anti-influenza_Chain

SEQ ID NO: 20638 - RNA, 1536 nt, Artificial Sequence
  derived and/or modified sequence opt2 from anti-influenza_Chain
augaagcgcaaggucaagaagauggccgccauggccaccuccaucaucauggccaucaugaucauccuccacuccauccccguccucgccggccgcaucaucuacgacaacgagaccggcacccacggcggcuacgacuacgagcucuggaaggacuacggcaacaccaucauggagcucaacgacggcggcaccuucuccugccagugguccaacaucggcaacgcccucuuccgcaagggccgcaaguucaacuccgacaagaccuaccaggagcucggcgacaucgucgucgaguacggcugcgacuacaaccccaacggcaacuccuaccucugcgucuacggcuggacccgcaacccccucgucgaguacuacaucgucgaguccuggggcuccuggcgcccccccggcgccacccccaagggcaccaucacccaguggauggccggcaccuacgagaucuacgagaccacccgcgucaaccagcccuccaucgacggcaccgccaccuuccagcaguacugguccguccgcaccuccaagcgcaccuccggcaccaucuccgucaccgagcacuucaagcagugggagcgcaugggcaugcgcaugggcaagauguacgaggucgcccucaccgucgagggcuaccaguccuccggcuacgccaacgucuacaagaacgagauccgcaucggcgccaaccccacccccgcccccucccagucccccauccgccgcgacgccuucuccaucaucgaggccgaggaguacaacuccaccaacuccuccacccuccaggucaucggcacccccaacaacggccgcggcaucggcuacaucgagaacggcaacaccgucaccuacuccaacaucgacuucggcuccggcgccaccggcuucuccgccaccgucgccaccgaggucaacaccuccauccagauccgcuccgacucccccaccggcacccuccucggcacccucuacgucuccuccaccggcuccuggaacaccuaccagaccgucuccaccaacaucuccaagaucaccggcguccacgacaucguccucgucuucuccggccccgucaacgucgacaacuucaucuucucccgcuccucccccguccccgcccccggcgacaacacccgcgacgccuacuccaucauccaggccgaggacuacgacuccuccuacggccccaaccuccagaucuucucccuccccggcggcggcuccgccaucggcuacaucgagaacggcuacuccaccaccuacaagaacaucgacuucggcgacggcgccaccuccgucaccgcccgcgucgccacccagaacgccaccaccauccagguccgccucggcucccccuccggcacccuccucggcaccaucuacgucggcuccaccggcuccuucgacaccuaccgcgacgucuccgccaccaucuccaacaccgccggcgucaaggacaucguccucgucuucuccggccccgucaacgucgacugguucgucuucuccaaguccggcacc

SEQ ID NO: 20639 - RNA, 1536 nt, Artificial Sequence; identical to SEQ ID NO: 20638
  derived and/or modified sequence opt2 from anti-influenza_Chain

SEQ ID NO: 20640 - RNA, 1539 nt, Artificial Sequence
  derived and/or modified sequence opt2 from anti-influenza_Chain
aucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccgccaacgaccucugcuaccccggcaacuucaacgacuacgaggagcucaagcaccuccucucccgcaucaaccacuucgagaagauccagaucauccccaaguccuccugguccgaccacgaggccuccuccggcgucuccuccgccugccccuaccagggcacccccuccuucuuccgcaacgucgucuggcucaucaagaagaacaacaccuaccccaccaucaagcgcuccuacaacaacaccaaccaggaggaccuccucauccucuggggcauccaccacuccaacgacgccgccgagcagaccaagcucuaccagaaccccaccaccuacaucuccgucggcaccuccacccucaaccagcgccucguccccaagaucgccacccgcuccaaggucaacggccagaacggccgcauggacuucuucuggaccauccucaagcccaacgacgccaucaacuucgaguccaacggcaacuucaucgcccccgaguacgccuacaagaucgucaagaagggcuacauccccgaggccccccgcgacggccaggccuacguccgcaaggacggcgaguggguccuccucuccaccuuccuccgcuccgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 20641 - RNA, 1539 nt, Artificial Sequence; identical to SEQ ID NO: 20640
  derived and/or modified sequence opt2 from anti-influenza_Chain

SEQ ID NO: 20642 - RNA, 1593 nt, Artificial Sequence
  derived and/or modified sequence opt2 from anti-influenza_Chain
acccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcgacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaagaucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgcc

SEQ ID NO: 20643 - RNA, 1593 nt, Artificial Sequence
  derived and/or modified sequence opt2 from anti-influenza_Chain
acccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccugcaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcgacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaagaucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgcc

SEQ ID NO: 20644 - RNA, 1593 nt, Artificial Sequence
  derived and/or modified sequence opt2 from anti-influenza_Chain
acccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaacaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcgacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaagaucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgcc

SEQ ID NO: 20645 - RNA, 1593 nt, Artificial Sequence
  derived and/or modified sequence opt2 from anti-influenza_Chain
acccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucggccccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcgacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaagaucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgcc

SEQ ID NO: 20646 - RNA, 1593 nt, Artificial Sequence; identical to SEQ ID NO: 20642
  derived and/or modified sequence opt2 from anti-influenza_Chain

SEQ ID NO: 20647 - RNA, 1593 nt, Artificial Sequence; identical to SEQ ID NO: 20643
  derived and/or modified sequence opt2 from anti-influenza_Chain

SEQ ID NO: 20648 - RNA, 1593 nt, Artificial Sequence; identical to SEQ ID NO: 20644
  derived and/or modified sequence opt2 from anti-influenza_Chain

SEQ ID NO: 20649 - RNA, 1593 nt, Artificial Sequence; identical to SEQ ID NO: 20645
  derived and/or modified sequence opt2 from anti-influenza_Chain

SEQ ID NO: 20650 - RNA, 1605 nt, Artificial Sequence
  derived and/or modified sequence opt2 from anti-influenza_Chain
gccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccgaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgcc

SEQ ID NO: 20651 - RNA, 1605 nt, Artificial Sequence
  derived and/or modified sequence opt2 from anti-influenza_Chain
gccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccgcgccggcgccaagggcuucuacaagaaccucaucuggcucgucaagaagggcaacuccuaccccaagcucaacaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgagauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucgacaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgcc

SEQ ID NO: 20652 - RNA, 1605 nt, Artificial Sequence; identical to SEQ ID NO: 20650
  derived and/or modified sequence opt2 from anti-influenza_Chain

SEQ ID NO: 20653 - RNA, 1605 nt, Artificial Sequence; identical to SEQ ID NO: 20651
  derived and/or modified sequence opt2 from anti-influenza_Chain

SEQ ID NO: 20654 - RNA, 1644 nt, Artificial Sequence
  derived and/or modified sequence opt2 from anti-influenza_Chain
cagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccccuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacauc

SEQ ID NO: 20655 - RNA, 1644 nt, Artificial Sequence; identical to SEQ ID NO: 20654
  derived and/or modified sequence opt2 from anti-influenza_Chain

SEQ ID NO: 20656 - RNA, 1647 nt, Artificial Sequence
  derived and/or modified sequence opt2 from anti-influenza_Chain
augcucaccuuccaccgcaucauccgcaagggcuggauguuccuccucgccuuccuccucaccgcccuccucuucugccccaccggccagcccgccaaggccgccgcccccuucaacggcaccaugaugcaguacuucgagugguaccuccccgacgacggcacccucuggaccaaggucgccaacgaggccaacaaccucuccucccucggcaucaccgcccucuggcucccccccgccuacaagggcaccucccgcuccgacgucggcuacggcgucuacgaccucuacgaccucggcgaguucaaccagaagggcgccguccgcaccaaguacggcaccaaggcccaguaccuccaggccauccaggccgcccacgccgccggcaugcaggucuacgccgacgucgucuucgaccacaagggcggcgccgacggcaccgagugggucgacgccgucgaggucaaccccuccgaccgcaaccaggagaucuccggcaccuaccagauccaggccuggaccaaguucgacuuccccggccgcggcaacaccuacuccuccuucaaguggcgcugguaccacuucgacggcgucgacugggacgagucccgcaagcucucccgcaucuacaaguuccgcggcaucggcaaggccugggacugggaggucgacaccgagaacggcaacuacgacuaccucauguacgccgaccucgacauggaccaccccgaggucgucaccgagcucaaguccuggggcaagugguacgucaacaccaccaacaucgacggcuuccgccucgacgccgucaagcacaucaaguucuccuucuuccccgacuggcucuccgacguccgcucccagaccggcaagccccucuucaccgucggcgaguacugguccuacgacaucaacaagcuccacaacuacaucaugaagaccaacggcaccaugucccucuucgacgccccccuccacaacaaguucuacaccgccuccaaguccggcggcaccuucgacaugcgcacccucaugaccaacacccucaugaaggaccagcccacccucgccgucaccuucgucgacaaccacgacaccgagcccggccaggcccuccaguccugggucgaccccugguucaagccccucgccuacgccuucauccucacccgccaggagggcuaccccugcgucuucuacggcgacuacuacggcaucccccaguacaacauccccucccucaaguccaagaucgacccccuccucaucgcccgccgcgacuacgccuacggcacccagcacgacuaccucgaccacuccgacaucaucggcuggacccgcgagggcgucaccgagaagcccggcuccggccucgccgcccucaucaccgacggccccggcggcuccaaguggauguacgucggcaagcagcacgccggcaaggucuucuacgaccucaccggcaaccgcuccgacaccgucaccaucaacuccgacggcuggggcgaguucaaggucaacggcggcuccgucuccgucugggucccccgcaagaccaccgucuccaccaucgccugguccaucaccacccgccccuggaccgacgaguucguccgcuggaccgagccccgccucgucgccuggccc

SEQ ID NO: 20657 - RNA, 1647 nt, Artificial Sequence
  derived and/or modified sequence opt2 from anti-influenza_Chain
aucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccgccaacgaccucugcuaccccggcaacuucaacgacuacgaggagcucaagcaccuccucucccgcaucaaccacuucgagaagauccagaucauccccaaguccuccugguccgaccacgaggccuccuccggcgucuccuccgccugccccuaccagggcacccccuccuucuuccgcaacgucgucuggcucaucaagaagaacaacaccuaccccaccaucaagcgcuccuacaacaacaccaaccaggaggaccuccucauccucuggggcauccaccacuccaacgacgccgccgagcagaccaagcucuaccagaaccccaccaccuacaucuccgucggcaccuccacccucaaccagcgccucguccccaagaucgccacccgcuccaaggucaacggccagaacggccgcauggacuucuucuggaccauccucaagcccaacgacgccaucaacuucgaguccaacggcaacuucaucgcccccgaguacgccuacaagaucgucaagaagggcgacuccgccaucgucaaguccgaggucgaguacggcaacugcaacaccaagugccagacccccaucggcgccaucaacuccuccaugcccuuccacaacauccacccccucaccaucggcgagugccccaaguacgucaaguccaacaagcucguccucgccaccggccuccgcaacuccccccuccgcuccgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 20658 - RNA, 1647 nt, Artificial Sequence; identical to SEQ ID NO: 20657
  derived and/or modified sequence opt2 from anti-influenza_Chain

SEQ ID NO: 20659 - RNA, 1647 nt, Artificial Sequence; identical to SEQ ID NO: 20656
  derived and/or modified sequence opt2 from anti-influenza_Chain

SEQ ID NO: 20660 - RNA, 1650 nt, Artificial Sequence
  derived and/or modified sequence opt2 from anti-influenza_Chain
gaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccaccaacgaccucugcuaccccggcuccuucaacgacuacgaggagcucaagcaccuccucucccgcaucaaccacuucgagaagauccagaucauccccaaguccuccugguccgaccacgaggccuccuccggcgucuccuccgccugccccuaccucggcucccccuccuucuuccgcaacgucgucuggcucaucaagaagaacuccaccuaccccaccaucaagaaguccuacaacaacaccaaccaggaggaccuccucguccucuggggcauccaccaccccaacgacgccgccgagcagacccgccucuaccagaaccccaccaccuacaucuccaucggcaccuccacccucaaccagcgccucguccccaagaucgccacccgcuccaaggucaacggccaguccggccgcauggaguucuucugggccauccucaagcccaacgacgccaucaacuucgaguccaacggcaacuucaucgcccccgaguacgccuacaagaucgucaagaagggcgacuccgccaucaugaaguccgagcucgaguacggcaacugcaacaccaagugccagacccccaugggcgccaucaacuccuccaugcccuuccacaacauccacccccucaccaucggcgagugccccaaguacgucaaguccaaccgccucguccucgccaccggccuccgcaacuccccccagcgcgagucccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccauccgcaacggcaccuacaacccccaguacuccgaggaggcccgccucaagcgcgaggagaucuccggcgucaagcucgaguccaucggcaccuaccagauccucuccaucuacuccaccgucgccuccucccucgcccucgccaucaugaucgccggccucucccucuggaugugcuccaacggcucccuccagugccgcaucugcauc

SEQ ID NO: 20661 - RNA, 1650 nt, Artificial Sequence; identical to SEQ ID NO: 20660
  derived and/or modified sequence opt2 from anti-influenza_Chain

SEQ ID NO: 20662 - RNA, 1656 nt, Artificial Sequence
  derived and/or modified sequence opt2 from anti-influenza_Chain
augaacauccagauccucgccuucaucgccugcguccucaccggcgccaagggcgacaagaucugccucggccaccacgccgucgccaacggcaccaaggucaacacccucaccgagaagggcaucgaggucgucaacgccaccgagaccgucgagaccgccgacgucaagaagaucugcacccagggcaagcgcgccaccgaccucggccgcugcggccuccucggcacccucaucggccccccccagugcgaccaguuccucgaguucuccuccgaccucaucaucgagcgccgcgagggcaccgacgucugcuaccccggccgcuucaccaacgaggagucccuccgccagauccuccgccgcuccggcggcaucggcaaggaguccaugggcuucaccuacuccggcauccgcaccaacggcgccgccuccgccugcacccgcuccggcuccuccuucuacgccgagaugaaguggcuccucuccaacuccgacaacuccgccuucccccagaugaccaaggccuaccgcaacccccgcaacaagcccgcccucaucaucuggggcguccaccacuccgaguccgccuccgagcagaccaagcucuacggcuccggcaacaagcucaucaccguccgcuccuccaaguaccagcaguccuucacccccucccccggcacccgccgcaucgacuuccacuggcuccuccucgaccccaacgacaccgucaccuucaccuucaacggcgccuucaucgcccccgaccgcgccuccuucuuccgcggcgagucccucggcguccaguccgacgccccccucgacuccuccugccgcggcgacugcuuccacuccggcggcaccaucgucuccucccuccccuuccagaacaucaacucccgcaccgucggccgcugcccccgcuacgucaagcagaagucccuccuccucgccaccggcaugcgcaacguccccgagaagcccaagccccgcggccucuucggcgccaucgccggcuucaucgagaacggcugggagggccucaucaacggcugguacggcuuccgccaccagaacgcccagggcgagggcaccgccgccgacuacaaguccacccaguccgccaucgaccagaucaccggcaagcucaaccgccucaucggcaagaccaaccagcaguucgagcucaucgacaacgaguucaacgagaucgagcagcagaucggcaacgucaucaacuggacccgcgacgccaugaccgagaucugguccuacaacgccgagcuccucgucgccauggagaaccagcacaccaucgaccucgccgacuccgagauguccaagcucuacgagcgcgucaagaagcagcuccgcgagaacgccgaggaggacggcaccggcugcuucgagaucuuccacaagugcgacgaccagugcauggaguccauccgcaacaacaccuacgaccacacccaguaccgcaccgagucccuccagaaccgcauccagaucgaccccgucaagcucuccuccggcuacaaggacaucauccucugguucuccuucggcgccuccugcuucauccuccucgccaucgccaugggccucgucuucaucugcaucaagaacggcaacaugcagugcaccaucugcauc

SEQ ID NO: 20663 - RNA, 1656 nt, Artificial Sequence
  derived and/or modified sequence opt2 from anti-influenza_Chain
augaacacccagauccucgccuucaucgccugcguccucaccggcgucaagggcgacaagaucugccucggccaccacgccgucgccaacggcaccaaggucaacacccucaccgagaagggcaucgaggucgucaacgccaccgagaccgucgagaccgccgacgucaagaagaucugcacccagggcaagcgcgccaccgaccucggccgcugcggccuccucggcacccucaucggccccccccagugcgaccaguuccucgaguucuccuccgaccucaucaucgagcgccgcgagggcaccgacgucugcuaccccggccgcuucaccaacgaggagucccuccgccagauccuccgccgcuccggcggcaucggcaaggaguccaugggcuucaccuacuccggcauccgcaccaacggcgccaccuccgccugcacccgcuccggcuccuccuucuacgccgagaugaaguggcuccucuccaacuccgacaacuccgccuucccccagaugaccaaggccuaccgcaacccccgcaacaagcccgcccucaucaucuggggcguccaccacuccgaguccgucuccgagcagaccaagcucuacggcuccggcaacaagcucaucaccguccgcuccuccaaguaccagcaguccuucacccccucccccggcgcccgccgcaucgacuuccacuggcuccuccucgaccccaacgacaccgucaccuucaccuucaacggcgccuucaucgcccccgaccgcgccuccuucuuccgcggcgagucccucggcguccaguccgacgucccccucgacuccuccugccgcggcgacugcuuccacuccggcggcaccaucgucuccucccuccccuuccagaacaucaacucccgcaccgucggcaagugcccccgcuacgucaagcagaagucccuccuccucgccaccggcaugcgcaacguccccgagaagcccaagccccgcggccucuucggcgccaucgccggcuucaucgagaacggcugggagggccucaucaacggcugguacggcuuccgccaccagaacgcccagggcgagggcaccgccgccgacuacaaguccacccaguccgccaucgaccagaucaccggcaagcucaaccgccucaucggcaagaccaaccagcaguucgagcucaucgacaacgaguucaacgagaucgagcagcagaucggcaacgucaucaacuggacccgcgacgccaugaccgagaucugguccuacaacgccgagcuccucgucgccauggagaaccagcacaccaucgaccucgccgacuccgagauguccaagcucuacgagcgcgucaagaagcagcuccgcgagaacgccgaggaggacggcaccggcugcuucgagaucuuccacaagugcgacgaccagugcauggaguccauccgcaacaacaccuacgaccacacccaguaccgcaccgagucccuccagaaccgcauccagaucgaccccgucaagcucuccuccggcuacaaggacaucauccucugguucuccuucggcgccuccugcuuccuccuccucgccaucgccaugggccucgucuucaucugcaucaagaacggcaacaugcagugcaccaucugcauc

SEQ ID NO: 20664 - RNA, 1656 nt, Artificial Sequence
  derived and/or modified sequence opt2 from anti-influenza_Chain
augaacauccagauccucgccuucaucgccugcguccucaccggcgccaagggcgacaagaucugccucggccaccacgccgucgccaacggcaccaaggucaacacccucaccgagaagggcaucgaggucgucaacgccaccgagaccgucgagaccgccaacaucaagaagaucugcacccagggcaagcgccccaccgaccucggccagugcggccuccucggcacccucaucggccccccccagugcgaccaguuccucgaguucuccuccgaccucaucaucgagcgccgcgagggcaccgacgucugcuaccccggcaaguucaccaacgaggagucccuccgccagauccuccgccgcuccggcggcaucggcaaggaguccaugggcuucaccuacuccggcauccgcaccaacggcgccaccuccgccugcacccgcuccggcuccuccuucuacgccgagaugaaguggcuccucuccaacuccgacaacgccgccuucccccagaugaccaaguccuaccgcaacccccgcaacaagcccgcccucaucaucuggggcguccaccacuccgaguccgucuccgagcagaccaagcucuacggcuccggcaacaagcucaucaagguccgcuccuccaaguaccagcaguccuucacccccaaccccggcgcccgccgcaucgacuuccacuggcuccuccucgaccccaacgacaccgucaccuucaccuucaacggcgccuucaucgcccccgaccgcgccuccuucuuccgcggcgaguccaucggcguccaguccgacgccccccucgacuccuccugcggcggcaacugcuuccacaacggcggcaccaucgucuccucccuccccuuccagaacaucaacccccgcaccgucggcaagugcccccgcuacgucaagcagaagucccuccuccucgccaccggcaugcgcaacguccccgagaagcccaagaagcgcggccucuucggcgccaucgccggcuucaucgagaacggcugggagggccucaucaacggcugguacggcuuccgccaccagaacgcccagggcgagggcaccgccgccgacuacaaguccacccaguccgccaucgaccagaucaccggcaagcucaaccgccucaucggcaagaccaaccagcaguucgagcucaucaacaacgaguucaacgaggucgagcagcagaucggcaacgucaucaacuggacccaggacgccaugaccgaggucugguccuacaacgccgagcuccucgucgccauggagaaccagcacaccaucgaccucaccgacuccgagauguccaagcucuacgagcgcguccgcaagcagcuccgcgagaacgccgaggaggacggcaccggcugcuucgagaucuuccacaagugcgacgaccacugcauggaguccauccgcaacaacaccuacgaccacacccaguaccgcaccgagucccuccagaaccgcauccagaucgaccccgucaagcucuccggcggcuacaaggacaucauccucugguucuccuucggcgccuccugcuuccuccuccucgccaucgccaugggccucgucuucaucugcaucaagaacggcaacaugcagugcaccaucugcauc

SEQ ID NO: 20665 - RNA, 1656 nt, Artificial Sequence
  derived and/or modified sequence opt2 from anti-influenza_Chain
gaccagaucugcaucggcuaccacgccaacaacuccaccgagcaggucgacaccaucauggagaagaacgucaccgucacccacgcccagaacauccucgagaagacccacaacggcaagcucugcgaccucgacggcgucaagccccucauccuccgcgacugcuccgucgccggcuggcuccucggcaaccccaugugcgacgaguuccucaacguccccgagugguccuacaucgucgagaagaucaaccccgccaacgaccucugcuaccccggcaacuucaacgacuacgaggagcucaagcaccuccucucccgcaucaaccacuucgagaagauccagaucauccccaaguccuccugguccgaccacgaggccuccuccggcgucuccuccgccugccccuaccagggccgcuccuccuucuuccgcaacgucgucuggcucaucaagaaggacaacgccuaccccaccaucaagcgcuccuacaacaacaccaaccaggaggaccuccucguccucuggggcauccaccaccccaacgacgccgccgagcagacccgccucuaccagaaccccaccaccuacaucuccgucggcaccuccacccucaaccagcgccucguccccaagaucgccacccgcuccaaggucaacggccaguccggccgcauggaguucuucuggaccauccucaagcccaacgacgccaucaacuucgaguccaacggcaacuucaucgcccccgagaacgccuacaagaucgucaagaagggcgacuccaccaucaugaaguccgagcucgaguacggcaacugcaacaccaagugccagacccccaucggcgccaucaacuccuccaugcccuuccacaacauccacccccucaccaucggcgagugccccaaguacgucaaguccaacaagcucguccucgccaccggccuccgcaacuccccccagggcgagcgccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagauccgccuccagcuccgcgacaacgccaaggagcucggcaacggcugcuucgaguucuaccaccgcugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucacccucgccaucauggucgccggccucucccucuggaugugcuccaacggcucccuccagugccgcaucugcauc

SEQ ID NO: 20666 - RNA, 1656 nt, Artificial Sequence
  derived and/or modified sequence opt2 from anti-influenza_Chain
gaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccaccaacgaccucugcuaccccggcuccuucaacgacuacgaggagcucaagcaccuccucucccgcaucaaccacuucgagaagauccagaucauccccaaguccuccugguccgaccacgaggccuccuccggcgucuccuccgccugccccuaccucggcucccccuccuucuuccgcaacgucgucuggcucaucaagaagaacuccaccuaccccaccaucaagaaguccuacaacaacaccaaccaggaggaccuccucguccucuggggcauccaccaccccaacgacgccgccgagcagacccgccucuaccagaaccccaccaccuacaucuccaucggcaccuccacccucaaccagcgccucguccccaagaucgccacccgcuccaaggucaacggccaguccggccgcauggaguucuucuggaccauccucaaccccaacgacgccaucaacuucgaguccaacggcaacuucaucgcccccgaguacgccuacaagaucgucaagaagggcgacuccgccaucaugaaguccgagcucgaguacggcaacugcaacaccaagugccagacccccaugggcgccaucaacuccuccaugcccuuccacaacauccacccccucaccaucggcgagugccccaaguacgucaaguccaaccgccucguccucgccaccggccuccgcaacuccccccagcgcgagucccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccauccgcaacggcaccuacaacuacccccaguacuccgaggaggcccgccucaagcgcgaggagaucuccggcgucaagcucgaguccaucggcaccuaccagauccucuccaucuacuccaccgucgccuccucccucgcccucgccaucaugauggccggccucucccucuggaugugcuccaacggcucccuccagugccgcaucugcauc

SEQ ID NO: 20667 - RNA, 1656 nt, Artificial Sequence; identical to SEQ ID NO: 20662
  derived and/or modified sequence opt2 from anti-influenza_Chain

SEQ ID NO: 20668 - RNA, 1656 nt, Artificial Sequence; identical to SEQ ID NO: 20663
  derived and/or modified sequence opt2 from anti-influenza_Chain

SEQ ID NO: 20669 - RNA, 1656 nt, Artificial Sequence; identical to SEQ ID NO: 20664
  derived and/or modified sequence opt2 from anti-influenza_Chain

SEQ ID NO: 20670 - RNA, 1656 nt, Artificial Sequence; identical to SEQ ID NO: 20665
  derived and/or modified sequence opt2 from anti-influenza_Chain

SEQ ID NO: 20671 - RNA, 1656 nt, Artificial Sequence; identical to SEQ ID NO: 20666
  derived and/or modified sequence opt2 from anti-influenza_Chain

SEQ ID NO: 20672 - RNA, 1680 nt, Artificial Sequence
  derived and/or modified sequence opt2 from anti-influenza_Chain
auguccaacauggacaucgacuccaucaacaccggcaccaucgacaagacccccgaggagcucacccccggcaccuccggcgccacccgccccaucaucaagcccgccacccucgccccccccuccaacaagcgcacccgcaaccccucccccgagcgcaccaccaccuccuccgagaccgacaucggccgcaagauccagaagaagcagacccccaccgagaucaagaaguccgucuacaagauggucgucaagcucggcgaguucuacaaccagaugauggucaaggccggccucaacgacgacauggagcgcaaccucauccagaacgcccaggccgucgagcgcauccuccucgccgccaccgacgacaagaagaccgaguaccagaagaagcgcaacgcccgcgacgucaaggagggcaaggaggagaucgaccacaacaagaccggcggcaccuucuacaagaugguccgcgacgacaagaccaucuacuucucccccaucaagaucaccuuccucaaggaggaggucaagaccauguacaagaccaccaugggcuccgacggcuucuccggccucaaccacaucaugaucggccacucccagaugaacgacgucugcuuccagcgcuccaagggccucaagcgcgucggccucgaccccucccucaucuccaccuucgccggcuccacccucccccgccgcuccggcaccaccggcgucgccaucaagggcggcggcacccucgucgacgaggccauccgcuucaucggccgcgccauggccgaccgcggccuccuccgcgacaucaaggccaagaccgccuacgagaagauccuccucaaccucaagaacaagugcuccgccccccagcagaaggcccucgucgaccaggucaucggcucccgcaaccccggcaucgccgacaucgaggaccucacccuccucgcccgcuccauggucgucguccgccccuccgucgccuccaaggucguccuccccaucuccaucuacgccaagaucccccagcucggcuucaacaccgaggaguacuccauggucggcuacgaggccauggcccucuacaacauggccacccccgucuccauccuccgcaugggcgacgacgccaaggacaagucccagcucuucuucauguccugcuucggcgccgccuacgaggaccuccgcguccucuccgcccucaccggcaccgaguucaagccccgcuccgcccucaagugcaagggcuuccacguccccgccaaggagcaggucgagggcaugggcgccgcccucauguccaucaagcuccaguucugggcccccaugacccgcuccggcggcaacgaggucuccggcgagggcggcuccggccagaucuccugcucccccgucuucgccgucgagcgccccaucgcccucuccaagcaggccguccgccgcaugcucuccaugaacgucgagggccgcgacgccgacgucaagggcaaccuccucaagaugaugaacgacuccauggccaagaagaccuccggcaacgccuucaucggcaagaagauguuccagaucuccgacaagaacaaggucaaccccaucgagauccccaucaagcagaccauccccaacuucuucuucggccgcgacaccgccgaggacuacgacgaccucgacuac

SEQ ID NO: 20673 - RNA, 1680 nt, Artificial Sequence
  derived and/or modified sequence opt2 from anti-influenza_Chain
augaacacccagauccucgcccucaucgccuacaugcucaucggcgccaagggcgacaagaucugccucggccaccacgccgucgccaacggcaccaaggucaacacccucaccgagcgcggcaucgaggucgucaacgccaccgagaccgucgagaccgucaacaucaagaagaucugcacccagggcaagcgccccaccgaccucggccagugcggccuccucggcacccucaucggccccccccagugcgaccaguuccucgaguucgacgccgaccucaucaucgagcgccgcgagggcaccgacgucugcuaccccggcaaguucaccaacgaggagucccuccgccagauccuccgcggcuccggcggcaucgacaaggaguccaugggcuucaccuacuccggcauccgcaccaacggcgucaccuccgccugccgccgcuccggcuccuccuucuacgccgagaugaaguggcuccucuccaacuccgacaacgccgccuucccccagaugaccaaguccuaccgcaacccccgcaacaagcccgcccucaucaucuggggcguccaccacuccggcuccgccaccgagcagaccaagcucuacggcuccggcaacaagcucaucaccgucggcuccuccaaguaccagcaguccuucacccccucccccggcgcccgcccccaggucaacggccaguccggccgcaucgacuuccacuggcuccuccucgaccccaacgacaccgucaccuucaccuucaacggcgccuucaucgcccccgaccgcgccuccuucuuccgcggcgagucccucggcguccaguccgacgucccccucgacuccggcugcgagggcgacugcuuccacucccgcggcaccaucgucuccucccuccccuuccagaacaucaacccccgcaccgucggcaagugcccccgcuacgucaagcagaccucccuccuccucgccaccggcaugcgcaacguccccgagaaccccaagacccgcggccucuucggcgccaucgccggcuucaucgagaacggcugggagggccucaucgacggcugguacggcuuccgccaccagaacgcccagggcgagggcaccgccgccgacuacaaguccacccaguccgccaucgaccagaucaccggcaagcucaaccgccucaucgacaagaccaaccagcaguucgagcucaucgacaacgaguucuccgagaucgagcagcagaucggcaacgucaucaacuggacccgcgacuccaugaccgaggucugguccuacaacgccgagcuccucgucgccauggagaaccagcacaccaucgaccucgccgacuccgagaugaacaagcucuacgagcgcguccgcaagcagcuccgcgagaacgccgaggaggacggcaccggcugcuucgagaucuuccacaagugcgacgaccagugcauggaguccauccgcaacaacaccuacgaccacacccaguaccgcaccgagucccuccagaaccgcauccagaucgaccccgucaagcucuccuccggcuacaaggacaucauccucugguucuccuucggcgccuccugcuuccuccuccucgccaucgccaugggccucgucuucaucugcaucaagaacggcaacaugcgcugcaccaucugcauc

SEQ ID NO: 20674 - RNA, 1680 nt, Artificial Sequence
  derived and/or modified sequence opt2 from anti-influenza_Chain
augaacacccagauccucgcccucaucgccugcaugcucaucggcgccaagggcgacaagaucugccucggccaccacgccgucgccaacggcaccaaggucaacacccucaccgagcgcggcaucgaggucgucaacgccaccgagaccgucgagaccgccaacaucaagaagaucugcacccagggcaagcgccccaccgaccucggccagugcggccuccucggcacccucaucggccccccccagugcgaccaguuccucgaguucgacgccgaccucaucaucgagcgccgcgagggcaccgacgucugcuaccccggcaaguucaccaacgaggagucccuccgccagauccuccgcggcuccggcggcaucgacaaggaguccaugggcuucaccuacuccggcauccgcaccaacggcgccaccuccgccugccgccgcuccggcuccuccuucuacgccgagaugaaguggcuccucuccaacuccgacaacgccgccuucccccagaugaccaaguccuaccgcaacccccgcaacaagcccgcccucaucaucuggggcguccaccacuccggcuccgccaccgagcagaccaagcucuacggcuccggcaacaagcucaucaccgucggcuccuccaaguaccagcaguccuucacccccucccccggcgcccgcccccaggucaacggccaguccggccgcaucgacuuccacuggcuccuccucgaccccaacgacaccgucaccuucaccuucaacggcgccuucaucgcccccgaccgcgccuccuucuuccgcggcggcucccucggcguccaguccgacgucccccucgacuccggcugcgagggcgacugcuuccacuccggcggcaccaucgucuccucccuccccuuccagaacaucaacccccgcaccgucggcaagugcccccgcuacgucaagcagaccucccuccuccucgccaccggcaugcgcaacguccccgagaaccccaagacccgcggccucuucggcgccaucgccggcuucaucgagaacggcugggagggccucaucgacggcugguacggcuuccgccaccagaacgcccagggcgagggcaccgccgccgacuacaaguccacccaguccgccaucgaccagaucaccggcaagcucaaccgccucaucgacaagaccaaccagcaguucgagcucaucgacaacgaguucaacgagaucgagcagcagaucggcaacgucaucaacuggacccgcgacuccaugaccgaggucugguccuacaacgccgagcuccucgucgccauggagaaccagcacaccaucgaccucgccgacuccgagaugaacaagcucuacgagcgcguccgcaagcagcuccgcgagaacgccgaggaggacggcaccggcugcuucgagaucuuccacaagugcgacgaccagugcauggaguccauccgcaacaacaccuacgaccacacccaguaccgcaccgagucccuccagaaccgcauccagaucaaccccgucaagcucuccuccggcuacaaggacaucauccucugguucuccuucggcgccuccugcuuccuccuccucgccaucgccaugggccucgucuucaucugcaucaagaacggcaacaugcgcugcaccaucugcauc

SEQ ID NO: 20675 - RNA, 1680 nt, Artificial Sequence
  derived and/or modified sequence opt2 from anti-influenza_Chain
auggagcgcaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguuccucaacguccccgagugguccuacaucgucgagaagaucaaccccgccaacgaccucugcuaccccggcaacuucaacgacuacgaggagcucaagcaccuccucucccgcaucaaccacuucgagcgcauccagaucauccccaaguccuccugguccgaccacgaggccuccuccggcgucuccuccgccugccccuaccagggccgcuccuccuucuuccgcaacgucgucuggcucaucaagaagaacaacgccuaccccaccaucaagcgcuccuacaacaacaccaaccaggaggaccuccucguccucuggggcauccaccaccccaacgacgccgccgagcagacccgccucuaccagaaccccaccaccuacaucuccgucggcaccuccacccucaaccagcgccucguccccaagaucgccacccgcuccaaggucaacggccaguccggccgcauggaguucuucuggaccauccucaagcccaacgacgccaucaacuucgaguccaacggcaacuucaucgcccccgagaacgccuacaagaacugccagaagggcgacuccaccaucaugaaguccgagcucgaguacggcaacugcaacaccaagugccagacccccaucggcgccaucaacuccuccaugcccuuccacaacauccacccccucaccaucggcgagugccccaaguacgucaaguccaaccgccucguccucgccaccggccuccgcaacuccccccagggcgagcgccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccaccgcugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucucccucuggaugugcuccaacggc

SEQ ID NO: 20676 - RNA, 1680 nt, Artificial Sequence; identical to SEQ ID NO: 20672
  derived and/or modified sequence opt2 from anti-influenza_Chain

SEQ ID NO: 20677 - RNA, 1680 nt, Artificial Sequence; identical to SEQ ID NO: 20673
  derived and/or modified sequence opt2 from anti-influenza_Chain

SEQ ID NO: 20678 - RNA, 1680 nt, Artificial Sequence; identical to SEQ ID NO: 20674
  derived and/or modified sequence opt2 from anti-influenza_Chain

SEQ ID NO: 20679 - RNA, 1680 nt, Artificial Sequence; identical to SEQ ID NO: 20675
  derived and/or modified sequence opt2 from anti-influenza_Chain

SEQ ID NO: 20680 - RNA, 1686 nt, Artificial Sequence
  derived and/or modified sequence opt2 from anti-influenza_Chain
augccccgcgcccuccgccgcguccccggcucccgcgucaugcuccgcgucggcgucgucgucgccguccucgcccucgucgccgcccucgccaaccucgccgucccccgccccgcccgcgccgccggcggcggcuacuggcacaccuccggccgcgagauccucgacgccaacaacguccccguccgcaucgccggcaucaacugguucggcuucgagaccugcaacuacgucguccacggccucuggucccgcgacuaccgcuccaugcucgaccagaucaagucccucggcuacaacaccauccgccuccccuacuccgacgacauccucaagcccggcaccaugcccaacuccaucaacuucuaccagaugaaccaggaccuccagggccucaccucccuccaggucauggacaagaucgucgccuacgccggccagaucggccuccgcaucauccucgaccgccaccgccccgacugcuccggccaguccgcccucugguacaccuccuccgucuccgaggccaccuggaucuccgaccuccaggcccucgcccagcgcuacaagggcaaccccaccgucgucggcuucgaccuccacaacgagccccacgaccccgccugcuggggcugcggcgaccccuccaucgacuggcgccucgccgccgagcgcgccggcaacgccguccucuccgucaaccccaaccuccucaucuucgucgagggcguccaguccuacaacggcgacuccuacugguggggcggcaaccuccagggcgccggccaguaccccgucguccucaacguccccaaccgccucgucuacuccgcccacgacuacgccaccuccgucuacccccagaccugguucuccgaccccaccuuccccaacaacaugcccggcaucuggaacaagaacuggggcuaccucuucaaccagaacaucgcccccgucuggcucggcgaguucggcaccacccuccaguccaccaccgaccagaccuggcucaagacccucguccaguaccuccgccccaccgcccaguacggcgccgacuccuuccaguggaccuucugguccuggaaccccgacuccggcgacaccggcggcauccucaaggacgacuggcagaccgucgacaccgucaaggacggcuaccucgcccccaucaaguccuccaucuucgaccccgucggcgccuccgccucccccuccucccagcccucccccuccgucucccccucccccucccccucccccuccgccucccgcacccccacccccacccccacccccaccgccucccccacccccacccucacccccaccgccacccccacccccaccgccucccccacccccucccccaccgccgccuccggcgcccgcugcaccgccuccuaccaggucaacuccgacuggggcaacggcuucaccgucaccgucgccgucaccaacuccggcuccgucgccaccaagaccuggaccgucuccuggaccuucggcggcaaccagaccaucaccaacuccuggaacgccgccgucacccagaacggccaguccgucaccgcccgcaacauguccuacaacaacgucauccagcccggccagaacaccaccuucggcuuccaggccuccuacaccggcuccaacgccgcccccaccgucgccugcgccgccucc

SEQ ID NO: 20681 - RNA, 1686 nt, Artificial Sequence
  derived and/or modified sequence opt2 from anti-influenza_Chain
auggagcgcgucugguggaaggaggccgucgucuaccagaucuacccccgcuccuucuacgacuccaacggcgacggcaucggcgacauccgcggcaucaucgccaagcucgacuaccucaaggagcucggcgucgacgucgucuggcucucccccgucuacaagucccccaacgacgacaacggcuacgacaucuccgacuaccgcgacaucauggacgaguucggcaccauggccgacuggaagaccaugcucgaggagaugcacaagcgcggcaucaagcucgucauggaccucgucgucaaccacaccuccgacgagcaccccugguucaucgagucccgcaaguccaaggacaaccccuaccgcgacuacuacaucuggcgccccggcaagaacggcaaggagcccaacaacugggaguccgucuucuccggcuccgccugggaguacgacgagaugaccggcgaguacuaccuccaccucuucuccaagaagcagcccgaccucaacugggagaaccccaagguccgccgcgaggucuacgagaugaugaaguucuggcucgacaagggcgucgacggcuuccgcauggacgucaucaacaugaucuccaagguccccgagcuccccgacggcgagccccaguccggcaagaaguacgccuccggcucccgcuacuacaugaacggcccccgcguccacgaguuccuccaggagaugaaccgcgagguccucuccaaguacgacaucaugaccgucggcgagacccccggcgucacccccaaggagggcauccucuacaccgaccccucccgccgcgagcucaacauggucuuccaguucgagcacauggaccucgacuccggccccggcggcaagugggacauccgccccuggucccucgccgaccucaagaagaccaugaccaaguggcagaaggagcucgagggcaagggcuggaacucccucuaccucaacaaccacgaccagccccgcgccgucucccgcuucggcgacgacggcaaguaccgcgucgaguccgccaagaugcucgccaccuuccuccacaugaugcagggcacccccuacaucuaccagggcgaggagaucggcaugaccaacguccgcuuccccuccaucgaggacuaccgcgacaucgagacccucaacauguacaaggagcgcgucgaggaguacggcgaggacccccaggaggucauggagaagaucuacuacaagggccgcgacaacgcccgcacccccaugcagugggacgacuccgagaacgccggcuucaccgccggcacccccuggauccccgucaaccccaacuacaaggagaucaacgucaaggccgcccucgaggaccccaacuccgucuuccacuacuacaagaagcucauccagcuccgcaagcagcacgacaucaucgucuacggcaccuacgaccucauccucgaggacgaccccuacaucuaccgcuacacccgcacccucggcaacgagcagcucaucgucaucaccaacuucuccgagaagacccccgucuuccgccuccccgaccacaucaucuacaagaccaaggagcuccucaucuccaacuacgacgucgacgaggccgaggagcucaaggagauccgccuccgccccugggaggcccgcgucuacaagauccgccucccc

SEQ ID NO: 20682 - RNA, 1686 nt, Artificial Sequence; identical to SEQ ID NO: 20680
  derived and/or modified sequence opt2 from anti-influenza_Chain

SEQ ID NO: 20683 - RNA, 1686 nt, Artificial Sequence; identical to SEQ ID NO: 20681
  derived and/or modified sequence opt2 from anti-influenza_Chain

SEQ ID NO: 20684 - RNA, 1689 nt, Artificial Sequence
  derived and/or modified sequence opt2 from anti-influenza_Chain
auggagaagaucguccuccucuucgccaucgucucccucgucaaguccgaccagaucugcaucggcuaccacgccaacaacuccaccgagcaggucgacaccaucauggagaagaacgucaccgucacccacgcccaggacauccucgagaagaagcacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccgucaacgaccucugcuaccccggcgacuucaacgacuacgaggagcucaagcaccuccucucccgcaucaaccacuucgagaagauccagaucauccccaaguccuccugguccucccacgaggccucccucggcgucuccuccgccugccccuaccagggcaagaccuccuucuuccgcaacgucgucuggcucaucaagaagaacuccaccuaccccaccaucaagcgcuccuacaacaacaccaaccaggaggaccuccucguccucuggggcauccaccaccccaacgacgccgccgagcagaccaagcucuaccagaaccccaccaccuacaucuccgucggcaccuccacccucaaccagcgccucgucccccgcaucgccacccgcuccaaggucaacggccaguccggccgcauggaguucuucuggaccauccucaagcccaacgacgccaucaacuucgaguccaacggcaacuucaucgcccccgaguacgccuacaagaucgucaagaagggcgacuccaccaucaugaaguccgagcucgaguacggcaacugcaacaccaagugccagacccccaugggcgccaucaacuccuccaugcccuuccacaacauccacccccucaccaucggcgagugccccaaguacgucaaguccaaccgccucguccucgccaccggccuccgcaacuccccccagcgcgagacccgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucuccggcgucaagcucgaguccaucggcaucuaccagauccucuccaucuacuccaccgucgccuccucccucgcccucgccaucauggucgccggccucucccucuggaugugcuccaacggcucccuccagugccgcaucugc

SEQ ID NO: 20685 - RNA, 1689 nt, Artificial Sequence; identical to SEQ ID NO: 20684
  derived and/or modified sequence opt2 from anti-influenza_Chain

SEQ ID NO: 20686 - RNA, 1692 nt, Artificial Sequence
  derived and/or modified sequence opt2 from anti-influenza_Chain
auggagaagaucguccuccucuucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcucccucaacggcgucaagccccucauccuccgcgacugcuccgucgccggcuggcuccucggcaaccccaugugcgacgaguuccucaacguccccgagugguccuacaucgucgagaaggacucccccaucaacggccucugcuaccccggcgacuucaacgacuacgaggagcucaagcaccuccucuccuccaccaaccacuucgagaagauccagaucaucccccgcuccuccugguccgaccacgacgccuccuccggcgucuccuccgccugccccuacaacggccgcuccuccuucuuccgcaacgucgucuggcucaucaagaagaacaacgccuaccccaccaucaagcgcaacuacaacaacaccaaccaggaggaccuccucguccucuggggcauccaccaccccaacgacgccaccgagcagaccaagcucuaccagaaccccaccaccuacgucuccgucggcaccuccacccucaaccagcgcuccguccccgagaucgccacccgccccaaggucaacggccaguccggccgcaucgaguucuucuggaccauccucaagcccaacgacgccaucaacuucgaguccaacggcaacuucaucgcccccgaguacgccuacaagaucgccaagaagggcgacuccgccaucaugaaguccggccucgaguacggcaacugcaacaccaagugccagacccccaugggcgccaucaacuccuccaugcccuuccacaacauccacccccucaccaucggcgagugcccccgcuacgucaaguccgaccgccucguccucgccaccggccuccgcaacgucccccagcgcgagacccgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcaucaccaacaaggucaacuccaucaucgacaagaugaacacccaguucgaggccgucggcaaggaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacgacgagugcauggaguccguccgcaacggcaccuacgacuacccccaguacuccgaggaggcccgccucaaccgcgaggagaucuccggcgucaagcucgaguccaucggcaccuaccagauccucuccaucuacuccaccgucgccuccucccucgcccucgccaucauggucgccggccucuccuucuggaugugcuccaacggcucccuccagugccgcaucugcauc

SEQ ID NO: 20687 - RNA, 1692 nt, Artificial Sequence; identical to SEQ ID NO: 20686
  derived and/or modified sequence opt2 from anti-influenza_Chain

SEQ ID NO: 20688 - RNA, 1695 nt, Artificial Sequence
  derived and/or modified sequence opt2 from anti-influenza_Chain
auggagaagaucguccuccucuucgccaucgucucccucgucaaguccgaccagaucugcaucggcuaccacgccaacaacuccaccgagcaggucgacaccaucauggagaagaacgucaccgucacccacgcccaggacauccucgagaagaagcacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccgucaacgaccucugcuaccccggcgacuucaacgacuacgaggagcucaagcaccuccucucccgcaucaaccacuucgagaagauccagaucauccccaaguccuccugguccucccacgaggccucccucggcgucuccuccgccugccccuaccagggcaaguccuccuucuuccgcaacgucgucuggcucaucaagaagaacuccaccuaccccaccaucaagcgcuccuacaacaacaccaaccaggaggaccuccucguccucuggggcauccaccaccccaacgacgccgccgagcagaccaagcucuaccagaaccccaccaccuacaucuccgucggcaccuccacccucaaccagcgccucgucccccgcaucgccacccgcuccaaggucaacggccaguccggccgcauggaguucuucuggaccauccucaagcccaacgacgccaucaacuucgaguccaacggcaacuucaucgcccccgaguacgccuacaagaucgucaagaagggcgacuccaccaucaugaaguccgagcucgaguacggcaacugcaacaccaagugccagacccccaugggcgccaucaacuccuccaugcccuuccacaacauccacccccucaccaucggcgagugccccaaguacgucaaguccaaccgccucguccucgccaccggccuccgcaacuccccccagcgcgagcgccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucuccggcgucaagcucgaguccaucggcaucuaccagauccucuccaucuacuccaccgucgccuccucccucgcccucgccaucauggucgccggccucucccucuggaugugcuccaacggcucccuccagugccgc

SEQ ID NO: 20689 - RNA, 1695 nt, Artificial Sequence
  derived and/or modified sequence opt2 from anti-influenza_Chain
auggagaagaucguccuccucuucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccgucaacgaccucugcuaccccggcgacuucaacgacuacgaggagcucaagcaccuccucucccgcaucaaccacuucgagaagauccagaucauccccaaguccuccugguccucccacgaggccucccucggcgucuccuccgccugccccuaccagggcaaguccuccuucuuccgcaacgucgucuggcucaucaagaagaacuccaccuaccccaccaucaagcgcuccuacaacaacaccaaccaggaggaccuccucguccucuggggcauccaccaccccaacgacgccgccgagcagaccaagcucuaccagaaccccaccaccuacaucuccgucggcaccuccacccucaaccagcgccucgucccccgcaucgccacccgcuccaaggucaacggccaguccggccgcauggaguucuucuggaccauccucaagcccaacgacgccaucaacuucgaguccaacggcaacuucaucgcccccgaguacgccuacaagaucgucaagaagggcgacuccaccaucaugaaguccgagcucgaguacggcaacugcaacaccaagugccagacccccaugggcgccaucaacuccuccaugcccuuccacaacauccacccccucaccaucggcgagugccccaaguacgucaaguccaaccgccucguccucgccaccggccuccgcaacuccccccagcgcgagcgccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucuccggcgucaagcucgaguccaucggcaucuaccagauccucuccaucuacuccaccgucgccuccucccucgcccucgccaucauggucgccggccucucccucuggaugugcuccaacggcucccuccagugccgc

SEQ ID NO: 20690 - RNA, 1695 nt, Artificial Sequence
  derived and/or modified sequence opt2 from anti-influenza_Chain
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccgccaacgaccucugcuaccccggcaacuucaacgacuacgaggagcucaagcaccuccucucccgcaucaaccacuucgagaagauccagaucauccccaaguccuccugguccgaccacgaggccuccuccggcgucuccuccgccugccccuaccagggcaaguccuccuucuuccgcaacgucgucuggcucaucaagaagaacuccuccuaccccaccaucaagcgcuccuacaacaacaccaaccaggaggaccuccucguccucuggggcauccaccaccccaacgacgccgccgagcagacccgccucuaccagaaccccaccaccuacaucuccgucggcaccuccacccucaaccagcgccucguccccaagaucgccacccgcuccaaggucaacggccaguccggccgcauggaguucuucuggaccauccucaagcccaacgacgccaucaacuucgaguccaacggcaacuucaucgcccccgaguacgccuacaagaucgucaagaagggcgacuccgccaucaugaaguccgagcucgaguacggcaacugcaacaccaagugccagacccccaugggcgccaucaacuccuccaugcccuuccacaacauccacccccucaccaucggcgagugccccaaguacgucaaguccaaccgccucguccucgccaccggccuccgcaacuccccccagcgcgagcgccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucuccggcgucaagcucgaguccaucggcaucuaccagauccucuccaucuacuccaccgucgccuccucccucgcccucgccaucauggucgccggccucucccucuggaugugcuccaacggcucccuccagugccgc

SEQ ID NO: 20691 - RNA, 1695 nt, Artificial Sequence
  derived and/or modified sequence opt2 from anti-influenza_Chain
auguccgaccgccgccagaaccgcaagacccccgacgagcagcgcaaggccaacgcccucaucaucaacgagaacaucgaggccuacaucgccaucugcaaggaggucggccucaacggcgacgagaugcucauccucgagaacggcaucgccaucgagaaggccauccgcaucugcugcgacggcaaguaccaggagaagcgcgagaagaaggcccgcgaggcccagcgcgccgacuccaacuucaacgccgacuccaucggcauccgccucgucaagcgcgccggcuccggcaccaacaucaccuaccacgccgucgucgagcucaccucccgcucccgcaucguccagauccucaagucccacuggggcaacgagcucaaccgcgccaagaucgccggcaagcgccucggcuucuccgcccucuucgccuccaaccucgaggccaucaucuaccagcgcggccgcaacgccgcccgccgcaacggcuccgccgagcucuucacccucacccagggcgccggcaucgagacccgcuacaaguggaucauggagaagcacaucggcaucggcguccucaucgccgacgccaagggccucaucaacggcaagcgcgagggcaagcgcggcgucgacgccaacgucaagcuccgcgccggcaccaccggcuccccccucgagcgcgccaugcagggcaucgagaagaaggccuuccccggcccccuccgcgcccucgcccgccgcgucgucaaggccaacuacaacgacgcccgcgaggcccucaacgucaucgccgaggccucccuccuccucaagccccagaucaccaacaagaugaccaugcccuggugcauguggcucgccgcccgccucacccucaaggacgaguucgccaacuucugcgccuacgccggccgccgcgccuucgaggucuucaacaucgccauggagaagaucggcaucugcuccuuccagggcaccaucaugaacgacgacgagaucgaguccaucgaggacaaggcccagguccucaugauggccugcuucggccucgccuacgaggacuucucccucgucuccgccauggucucccacccccucaagcuccgcaaccgcaugaagaucggcaacuuccgcgucggcgagaaggucuccaccguccucuccccccuccuccgcuucacccgcugggccgaguucgcccagcgcuucgcccuccaggccaacaccucccgcgagggcgcccagaucuccaacuccgccgucuucgccgucgagcgcaagaucaccaccgacguccagcgcgucgaggagcuccucaacaagguccaggcccacgaggacgagccccuccagacccucuacaagaagguccgcgagcagaucuccaucaucggccgcaacaaguccgagaucaaggaguuccucggcuccuccauguacgaccucaacgaccaggagaagcagaaccccaucaacuuccgcuccggcgcccaccccuucuucuucgaguucgaccccgacuacaaccccauccgcgucaagcgccccaagaagcccaucgccaagcgcaacuccaacaucucccgccucgaggaggagggcauggacgagaacuccgagaucggccaggccaagaagaugaagccccucgaccagcucaccuccaccuccuccaacauccccggcaagaac

SEQ ID NO: 20692 - RNA, 1695 nt, Artificial Sequence
  derived and/or modified sequence opt2 from anti-influenza_Chain
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagaaggcccucuaccacaccgagaacgccuacgucuccgucgucuccucccacuacucccgcaaguucacccccgagaucgccaagcgccccaagguccgcgaccaggagggccgcaucaacuaccacuggacccuccucgagcccggcgacaccaucaucuucgaggccaacggcaaccucaucgccccccgcuacgccuucacccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcauc

SEQ ID NO: 20693 - RNA, 1695 nt, Artificial Sequence
  derived and/or modified sequence opt2 from anti-influenza_Chain
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagaagacccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcauc

SEQ ID NO: 20694 - RNA, 1695 nt, Artificial Sequence
  derived and/or modified sequence opt2 from anti-influenza_Chain
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccgacaucggcgaccagaagacccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcauc

SEQ ID NO: 20695 - RNA, 1695 nt, Artificial Sequence
  derived and/or modified sequence opt2 from anti-influenza_Chain
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagaaggcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcauc

SEQ ID NO: 20696 - RNA, 1695 nt, Artificial Sequence
  derived and/or modified sequence opt2 from anti-influenza_Chain
augaaggccaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgucaacaacaaggagaaggagguccucguccucuggggcguccaccacccccccaacaucggcaaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcauc

SEQ ID NO: 20697 - RNA, 1695 nt, Artificial Sequence
  derived and/or modified sequence opt2 from anti-influenza_Chain
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucucccgcgaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccaccaccggcgucuccgccuccugcucccacaacggcgaguccuccuucuacaagaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaaggagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcauc

SEQ ID NO: 20698 - RNA, 1677 nt, Artificial Sequence
  derived and/or modified sequence opt2 from anti-influenza_Chain
gacaagaucugcaucggcuaccaguccaccaacuccaccgagaccgucgacacccucaccaagaccaacguccccgucacccaggccaaggagcuccuccacaccgagcacaacggcaugcucugcgccaccaaccucggccacccccucauccucgacaccugcaccaucgagggccucaucuacggcaaccccuccugcgaccuccuccucggcggccgcgagugguccuacaucgucgagcgccccuccgccgucaacggcaugugcuaccccggcaacgucgagaaccucgaggagcuccgccuccucuucuccuccgccuccuccuaccagcgcguccagaucuuccccgacaccaucuggaacgucaccuacuccggcaccuccuccgccugcuccaacuccuucuaccgcuccaugcgcuggcucacccagaaggacaacaccuaccccguccaggacgcccaguacaccaacaaccgcggcaaguccauccucuucauguggggcaucaaccacccccccaccgacaccguccagaccaaccucuacacccgcaccgacaccaccaccuccgucaccaccgaggacaucaaccgcgccuucaagcccgucaucggcccccgcccccucgucaacggccuccagggccgcaucgacuacuacugguccguccucaagcccggccagacccuccgcguccgcuccaacggcaaccucaucgcccccugguacggccacauccucuccggcgagucccacggccgcauccucaaguccgaccucaacuccggcaacugcgucguccagugccagaccgagcgcggcggccucaacaccacccuccccuuccacaacgucuccaaguacgccuucggcaacugccccaaguacgucggcgucaagucccucaagcucgccgucggcaugcgcaacguccccgcccgcuccucccgcggccucuucggcgccaucgccggcuucaucgagggcggcuggcccggccucgucgccggcugguacggcuuccagcacuccaacgaccagggcgucggcauggccgccgaccgcgacuccacccagaaggccaucgacaagaucaccuccaaggucaacaacaucgucgacaagaugaacaagcaguacgagaucaucgaccacgaguucuccgagaucgagacccgccucaacaugaucaacaacaagaucgacgaccagauccaggacaucugggccuacaacgccgagcuccucguccuccucgagaaccagaagacccucgacgagcacgacgccaacgucaacaaccucuacaacaaggucaagcgcgcccucggcuccaacgccauggaggacggcaagggcugcuucgagcucuaccacaagugcgacgaccgcugcauggagaccauccgcaacggcaccuacaaccgcggcaaguacaaggaggagucccgccucgagcgccagaagaucgagggcgucaagcucgaguccgagggcaccuacaaguccggccgccucgucccccgcggcucccccggcuccggcuacauccccgaggccccccgcgacggccaggccuacguccgcaaggacggcgaguggguccuccucuccaccuuccucggcaagcccauccccaacccccuccucggccucgacuccaccggc

SEQ ID NO: 20699 - RNA, 1677 nt, Artificial Sequence; identical to SEQ ID NO: 20698
  derived and/or modified sequence opt2 from anti-influenza_Chain

SEQ ID NO: 20700 - RNA, 1695 nt, Artificial Sequence; identical to SEQ ID NO: 20691
  derived and/or modified sequence opt2 from anti-influenza_Chain

SEQ ID NO: 20701 - RNA, 1695 nt, Artificial Sequence; identical to SEQ ID NO: 20688
  derived and/or modified sequence opt2 from anti-influenza_Chain

SEQ ID NO: 20702 - RNA, 1695 nt, Artificial Sequence; identical to SEQ ID NO: 20689
  derived and/or modified sequence opt2 from anti-influenza_Chain

SEQ ID NO: 20703 - RNA, 1695 nt, Artificial Sequence; identical to SEQ ID NO: 20690
  derived and/or modified sequence opt2 from anti-influenza_Chain

SEQ ID NO: 20704 - RNA, 1695 nt, Artificial Sequence; identical to SEQ ID NO: 20692
  derived and/or modified sequence opt2 from anti-influenza_Chain

SEQ ID NO: 20705 - RNA, 1695 nt, Artificial Sequence; identical to SEQ ID NO: 20693
  derived and/or modified sequence opt2 from anti-influenza_Chain

SEQ ID NO: 20706 - RNA, 1695 nt, Artificial Sequence; identical to SEQ ID NO: 20694
  derived and/or modified sequence opt2 from anti-influenza_Chain

SEQ ID NO: 20707 - RNA, 1695 nt, Artificial Sequence; identical to SEQ ID NO: 20695
  derived and/or modified sequence opt2 from anti-influenza_Chain

SEQ ID NO: 20708 - RNA, 1695 nt, Artificial Sequence; identical to SEQ ID NO: 20696
  derived and/or modified sequence opt2 from anti-influenza_Chain

SEQ ID NO: 20709 - RNA, 1695 nt, Artificial Sequence; identical to SEQ ID NO: 20697
  derived and/or modified sequence opt2 from anti-influenza_Chain

SEQ ID NO: 20710 - RNA, 1698 nt, Artificial Sequence
  derived and/or modified sequence opt2 from anti-influenza_Chain
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccuccaucggcucccgcccccgcauccgcgacguccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcauc

SEQ ID NO: 20711 - RNA, 1698 nt, Artificial Sequence
  derived and/or modified sequence opt2 from anti-influenza_Chain
augaagaccaucaucgcccucuccuacauccucugccucgucuccgcccagaaguuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgaggaguucgacaagcucuacaucuggggcguccaccaccccggcaccgacaacgaccagaucuuccucuacgcccaggccuccggccgcaucaccgucuccaccaagcgcucccagcagaccgucauccccaacauccgcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcauc

SEQ ID NO: 20712 - RNA, 1698 nt, Artificial Sequence
  derived and/or modified sequence opt2 from anti-influenza_Chain
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaagaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaaggagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgccuccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcauc

SEQ ID NO: 20713 - RNA, 1698 nt, Artificial Sequence
  derived and/or modified sequence opt2 from anti-influenza_Chain
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaagugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcauc

SEQ ID NO: 20714 - RNA, 1698 nt, Artificial Sequence
  derived and/or modified sequence opt2 from anti-influenza_Chain
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcauc

SEQ ID NO: 20715 - RNA, 1698 nt, Artificial Sequence
  derived and/or modified sequence opt2 from anti-influenza_Chain
augaagaccaucaucgcccucuccuacauccucugccucgucuucucccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccgucaccgacuccgaccagaucucccucuacgcccaggccuccggccgcaucaccgucuccaccaagcgcucccagcagaccgucauccccaacaucggcuaccgcccccgcguccgcgacaucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucgaguccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcauc

SEQ ID NO: 20716 - RNA, 1698 nt, Artificial Sequence
  derived and/or modified sequence opt2 from anti-influenza_Chain
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacgacgaguccuucaacuggaccggcgucacccagaacggcaccuccuccuccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccgucaccgacaacgaccagaucuuccucuacgcccaggccuccggccgcaucaccgucuccaccaagcgcucccagcagaccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcauc

SEQ ID NO: 20717 - RNA, 1698 nt, Artificial Sequence
  derived and/or modified sequence opt2 from anti-influenza_Chain
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccaccaacgaccucugcuaccccggcuccuucaacgacuacgaggagcucaagcaccuccucucccgcaucaaccacuucgagaagauccagaucauccccaaguccuccugguccgaccacgaggccuccuccggcgucuccuccgccugccccuaccucggcucccccuccuucuuccgcaacgucgucuggcucaucaagaagaacuccaccuaccccaccaucaagaaguccuacaacaacaccaaccaggaggaccuccucguccucuggggcauccaccaccccaacgacgccgccgagcagacccgccucuaccagaaccccaccaccuacaucuccaucggcaccuccacccucaaccagcgccucguccccaagaucgccacccgcuccaaggucaacggccaguccggccgcauggaguucuucugggccauccucaagcccaacgacgccaucaacuucgaguccaacggcaacuucaucgcccccgaguacgccuacaagaucgucaagaagggcgacuccgccaucaugaaguccgagcucgaguacggcaacugcaacaccaagugccagacccccaugggcgccaucaacuccuccaugcccuuccacaacauccacccccucaccaucggcgagugccccaaguacgucaaguccaaccgccucguccucgccaccggccuccgcaacuccccccagcgcgagucccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccauccgcaacggcaccuacaacccccaguacuccgaggaggcccgccucaagcgcgaggagaucuccggcgucaagcucgaguccaucggcaccuaccagauccucuccaucuacuccaccgucgccuccucccucgcccucgccaucaugaucgccggccucucccucuggaugugcuccaacggcucccuccagugccgcaucugcauc

SEQ ID NO: 20718 - RNA, 1698 nt, Artificial Sequence
  derived and/or modified sequence opt2 from anti-influenza_Chain
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcauc

SEQ ID NO: 20719 - RNA, 1698 nt, Artificial Sequence
  derived and/or modified sequence opt2 from anti-influenza_Chain
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccacccccccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcauc

SEQ ID NO: 20720 - RNA, 1698 nt, Artificial Sequence; identical to SEQ ID NO: 20717
  derived and/or modified sequence opt2 from anti-influenza_Chain

SEQ ID NO: 20721 - RNA, 1698 nt, Artificial Sequence; identical to SEQ ID NO: 20710
  derived and/or modified sequence opt2 from anti-influenza_Chain

SEQ ID NO: 20722 - RNA, 1698 nt, Artificial Sequence; identical to SEQ ID NO: 20718
  derived and/or modified sequence opt2 from anti-influenza_Chain

SEQ ID NO: 20723 - RNA, 1698 nt, Artificial Sequence; identical to SEQ ID NO: 20719
  derived and/or modified sequence opt2 from anti-influenza_Chain

SEQ ID NO: 20724 - RNA, 1698 nt, Artificial Sequence; identical to SEQ ID NO: 20711
  derived and/or modified sequence opt2 from anti-influenza_Chain

SEQ ID NO: 20725 - RNA, 1698 nt, Artificial Sequence; identical to SEQ ID NO: 20712
  derived and/or modified sequence opt2 from anti-influenza_Chain

SEQ ID NO: 20726 - RNA, 1698 nt, Artificial Sequence; identical to SEQ ID NO: 20713
  derived and/or modified sequence opt2 from anti-influenza_Chain

SEQ ID NO: 20727 - RNA, 1698 nt, Artificial Sequence; identical to SEQ ID NO: 20714
  derived and/or modified sequence opt2 from anti-influenza_Chain

SEQ ID NO: 20728 - RNA, 1698 nt, Artificial Sequence; identical to SEQ ID NO: 20715
  derived and/or modified sequence opt2 from anti-influenza_Chain

SEQ ID NO: 20729 - RNA, 1698 nt, Artificial Sequence; identical to SEQ ID NO: 20716
  derived and/or modified sequence opt2 from anti-influenza_Chain

SEQ ID NO: 20730 - RNA, 1683 nt, Artificial Sequence
  derived and/or modified sequence opt2 from anti-influenza_Chain
auggagaagaucguccuccucuucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccgucaacgaccucugcuaccccggcgacuucaacgacuacgaggagcucaagcaccuccucucccgcaucaaccacuucgagaagauccagaucauccccaaguccuccugguccucccacgaggccucccucggcgucuccuccgccugccccuaccagggcaaguccuccuucuuccgcaacgucgucuggcucaucaagaagaacuccaccuaccccaccaucaagcgcuccuacaacaacaccaaccaggaggaccuccucguccucuggggcauccaccaccccaacgacgccgccgagcagaccaagcucuaccagaaccccaccaccuacaucuccgucggcaccuccacccucaaccagcgccucgucccccgcaucgccacccgcuccaaggucaacggccaguccggccgcauggaguucuucuggaccauccucaagcccaacgacgccaucaacuucgaguccaacggcaacuucaucgcccccgaguacgccuacaagaucgucaagaagggcgacuccaccaucaugaaguccgagcucgaguacggcaacugcaacaccaagugccagacccccaugggcgccaucaacuccuccaugcccuuccacaacauccacccccucaccaucggcgagugccccaaguacgucaaguccaaccgccucguccucgccaccggccuccgcaacuccccccagcgcgagcgccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucuccggcgucaagcucgaguccaucggcaucuaccagauccagcacuccggcggccgcuccucccucgagggcccccgcuucgagcagaagcucaucuccgaggaggaccucaacaugcacaccggc

SEQ ID NO: 20731 - RNA, 1683 nt, Artificial Sequence
  derived and/or modified sequence opt2 from anti-influenza_Chain
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccgccaacgaccucugcuaccccggcaacuucaacgacuacgaggagcucaagcaccuccucucccgcaucaaccacuucgagaagauccagaucauccccaaguccuccugguccgaccacgaggccuccuccggcgucuccuccgccugccccuaccagggcaaguccuccuucuuccgcaacgucgucuggcucaucaagaagaacuccuccuaccccaccaucaagcgcuccuacaacaacaccaaccaggaggaccuccucguccucuggggcauccaccaccccaacgacgccgccgagcagacccgccucuaccagaaccccaccaccuacaucuccgucggcaccuccacccucaaccagcgccucguccccaagaucgccacccgcuccaaggucaacggccaguccggccgcauggaguucuucuggaccauccucaagcccaacgacgccaucaacuucgaguccaacggcaacuucaucgcccccgaguacgccuacaagaucgucaagaagggcgacuccgccaucaugaaguccgagcucgaguacggcaacugcaacaccaagugccagacccccaugggcgccaucaacuccuccaugcccuuccacaacauccacccccucaccaucggcgagugccccaaguacgucaaguccaaccgccucguccucgccaccggccuccgcaacuccccccagcgcgagcgccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucuccggcgucaagcucgaguccaucggcaucuaccagauccagcacuccggcggccgcuccucccucgagggcccccgcuucgagcagaagcucaucuccgaggaggaccucaacaugcacaccggc

SEQ ID NO: 20732 - RNA, 1701 nt, Artificial Sequence
  derived and/or modified sequence opt2 from anti-influenza_Chain
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccgccaacgaccucugcuaccccggcaacuucaacgacuacgaggagcucaagcaccuccucucccgcaucaaccacuucgagaagauccagaucaucuccaaguccuccugguccgaccacgaggccuccuccggcgucuccuccgccugccccuaccagggcacccccuccuucuuccgcaacgucgucuggcucaucaagaagaacaacaccuaccccaccaucaagcgcuccuacaacaacaccaaccaggaggaccuccucauccucuggggcauccaccacuccaacaacgccgccgagcagaccaagcucuaccagaaccccaccaccuacaucuccgucggcaccuccacccucaaccuccgccucguccccaagaucgccacccgcuccaaggucaacggccaguccggccgcauggacuucuucuggaccauccucaagcccaacgacgccaucaacuucgaguccaacggcaacuucaucgcccccgaguacgccuacaagaucgucaagaagggcgacuccgccaucaugaaguccgaggucgaguacggcaacugcaacaccaagugccagacccccaucggcgccaucaacuccuccaugcccuuccacaacauccacccccucaccaucggcgagugccccaaguacgucaaguccaacaagcucguccucgccaccggccuccgcaacuccccccuccgcgagcgccgccgcaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucucccucuggaugugcuccaacggcucccuccagugccgcaucugcauc

SEQ ID NO: 20733 - RNA, 1701 nt, Artificial Sequence
  derived and/or modified sequence opt2 from anti-influenza_Chain
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccgccaacgaccucugcuaccccggcaacuucaacgacuacgaggagcucaagcaccuccucucccgcaucaaccacuucgagaagauccagaucauccccaaguccuccugguccgaccacgaggccuccuccggcgucuccuccgccugccccuaccagggcacccccuccuucuuccgcaacgucgucuggcucaucaagaagaacaacaccuaccccaccaucaagcgcuccuacaacaacaccaaccaggaggaccuccucauccucuggggcauccaccacuccaacgacgccgccgagcagaccaagcucuaccagaaccccaccaccuacaucuccgucggcaccuccacccucaaccagcgccucguccccaagaucgccacccgcuccaaggucaacggccaguccggccgcauggacuucuucuggaccauccucaagcccaacgacgccaucaacuucgaguccaacggcaacuucaucgcccccgaguacgccuacaagaucgucaagaagggcgacuccgccaucgucaaguccgaggucgaguacggcaacugcaacaccaagugccagacccccaucggcgccaucaacuccuccaugcccuuccacaacauccacccccucaccaucggcgagugccccaaguacgucaaguccaacaagcucguccucgccaccggccuccgcaacuccccccuccgcgagcgccgccgcaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucucccucuggaugugcuccaacggcucccuccagugccgcaucugcauc

SEQ ID NO: 20734 - RNA, 1683 nt, Artificial Sequence
  derived and/or modified sequence opt2 from anti-influenza_Chain
gacaagaucugccucggccaccacgccgucuccaacggcaccaaggucaacacccucaccgagcgcggcgucgaggucgucaacgccaccgagaccgucgagcgcaccaacgucccccgcaucugcuccaagggcaagcgcaccgucgaccucggccagugcggccuccucggcaccaucaccggccccccccagugcgaccaguuccucgaguucuccgccgaccucaucaucgagcgccgcgagggcuccgacgucugcuaccccggcaaguucgucaacgaggaggcccuccgccagauccuccgcgaguccggcggcaucgacaaggagaccaugggcuucaccuacuccggcauccgcaccaacggcaccaccuccgccugccgccgcuccggcuccuccuucuacgccgagaugaaguggcuccucuccaacaccgacaacgccgccuucccccagaugaccaaguccuacaagaacacccgcaaggaccccgcccucaucaucuggggcauccaccacuccggcuccaccaccgagcagaccaagcucuacggcuccggcaacaagcucaucaccgucggcuccuccaacuaccagcaguccuucguccccucccccggcgcccgcccccaggucaacggccaguccggccgcaucgacuuccacuggcucauccucaaccccaacgacaccgucaccuucuccuucaacggcgccuucaucgcccccgaccgcgccuccuuccuccgcggcaaguccaugggcauccaguccgagguccaggucgacgccaacugcgagggcgacugcuaccacuccggcggcaccaucaucuccaaccuccccuuccagaacaucaacucccgcgccgucggcaagugcccccgcuacgucaagcaggagucccuccuccucgccaccggcaugaagaacguccccgagauccccaagcgccgccgccgcggccucuucggcgccaucgccggcuucaucgagaacggcugggagggccucaucgacggcugguacggcuuccgccaccagaacgcccagggcgagggcaccgccgccgacuacaaguccacccaguccgccaucgaccagaucaccggcaagcucaaccgccucaucgagaagaccaaccagcaguucgagcucaucgacaacgaguucaccgaggucgagcgccagaucggcaacgucaucaacuggacccgcgacuccaugaccgaggucugguccuacaacgccgagcuccucgucgccauggagaaccagcacaccaucgaccucgccgacuccgagaugaacaagcucuacgagcgcgucaagcgccagcuccgcgagaacgccgaggaggacggcaccggcugcuucgagaucuuccacaagugcgacgacgacugcauggccuccauccgcaacaacaccuacgaccacuccaaguaccgcgaggaggccauccagaaccgcauccagaucgaccccgucaagcucuccuccggcuacaaggacuccggccgccucgucccccgcggcucccccggcuccggcuacauccccgaggccccccgcgacggccaggccuacguccgcaaggacggcgaguggguccuccucuccaccuuccucggcaagcccauccccaacccccuccucggccucgacuccaccggc

SEQ ID NO: 20735 - RNA, 1701 nt, Artificial Sequence
  derived and/or modified sequence opt2 from anti-influenza_Chain
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccgccaacgaccucugcuaccccggcaacuucaacgacuacgaggagcucaagcaccuccucucccgcaucaaccacuucgagaagauccagaucauccccaaguccuccugguccgaccacgaggccuccuccggcgucuccuccgccugccccuaccagggcacccccuccuucuuccgcaacgucgucuggcucaucaagaagaacaacaccuaccccaccaucaagcgcuccuacaacaacaccaaccaggaggaccuccucauccucuggggcauccaccacuccaacgacgccgccgagcagaccaagcucuaccagaaccccaccaccuacaucuccgucggcaccuccacccucaaccagcgccucguccccaagaucgccacccgcuccaaggucaacggccagaacggccgcauggacuucuucuggaccauccucaagcccaacgacgccaucaacuucgaguccaacggcaacuucaucgcccccgaguacgccuacaagaucgucaagaagggcgacuccgccaucgucaaguccgaggucgaguacggcaacugcaacaccaagugccagacccccaucggcgccaucaacuccuccaugcccuuccacaacauccacccccucaccaucggcgagugccccaaguacgucaaguccaacaagcucguccucgccaccggccuccgcaacuccccccuccgcgagcgccgccgcaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucucccucuggaugugcuccaacggcucccuccagugccgcaucugcauc

SEQ ID NO: 20736 - RNA, 1683 nt, Artificial Sequence; identical to SEQ ID NO: 20734
  derived and/or modified sequence opt2 from anti-influenza_Chain

SEQ ID NO: 20737 - RNA, 1683 nt, Artificial Sequence; identical to SEQ ID NO: 20730
  derived and/or modified sequence opt2 from anti-influenza_Chain

SEQ ID NO: 20738 - RNA, 1683 nt, Artificial Sequence; identical to SEQ ID NO: 20731
  derived and/or modified sequence opt2 from anti-influenza_Chain

SEQ ID NO: 20739 - RNA, 1701 nt, Artificial Sequence; identical to SEQ ID NO: 20735
  derived and/or modified sequence opt2 from anti-influenza_Chain

SEQ ID NO: 20740 - RNA, 1701 nt, Artificial Sequence; identical to SEQ ID NO: 20732
  derived and/or modified sequence opt2 from anti-influenza_Chain

SEQ ID NO: 20741 - RNA, 1701 nt, Artificial Sequence; identical to SEQ ID NO: 20733
  derived and/or modified sequence opt2 from anti-influenza_Chain

SEQ ID NO: 20742 - RNA, 1704 nt, Artificial Sequence
  derived and/or modified sequence opt2 from anti-influenza_Chain
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguuccucaacguccccgagugguccuacaucgucgagaagaucaaccccgccaacgaccucugcuaccccggcgacuucaacgacuacgaggagcucaagcaccuccucucccgcaucaaccacuucgagaagauccagaucauccccaaguccuccugguccgacuacgaggccuccuccggcgucuccuccgccugccccuaccagggccgcuccuccuucuuccgcaacgucgucuggcucaucaagaagaacaacgccuaccccaccaucaagcgcuccuacaacaacaccaaccaggaggaccuccucguccucuggggcauccaccaccccaacgacgccgccgagcagauccgccucuaccagaaccccaccaccuacaucuccaucggcaccuccacccucaaccagcgccucguccccaagaucgccacccgcuccaaggucaacggccaguccggccgcauggaguucuucuggaccauccucaaguccaacgacgccaucaacuucgaguccaacggcaacuucaucgcccccgaguacgccuacaagaucgucaagaagggcgacuccaccaucaugaaguccgagcucgaguacggcaacugcaacaccaagugccagacccccaucggcgccaucaacuccuccaugcccuuccacaacauccacccccucaccaucggcgagugccccaaguacgucaaguccaaccgccucguccucgccaccggccuccgcaacuccccccagggcgagcgccgccgccgcaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucaacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccaccgcugcgacaacgagugcauggaguccguccgcaacggcaccuacgacuacccccaguacuccgaggaggcccgccucaagcgcgaggagaucuccggcgucaagcucgaguccaugggcaucuaccagauccucuccaucuacuccaccgucgccuccucccucgcccucgccaucauggucgccggccucuuccucuggaugugcuccaacggcucccuccagugccgcaucugcauc

SEQ ID NO: 20743 - RNA, 1704 nt, Artificial Sequence
  derived and/or modified sequence opt2 from anti-influenza_Chain
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccaccaacgaccucugcuaccccggcuccuucaacgacuacgaggagcucaagcaccuccucucccgcaucaaccacuucgagaagauccagaucauccccaaguccuccugguccgaccacgaggccuccuccggcgucuccuccgccugccccuaccucggcucccccuccuucuuccgcaacgucgucuggcucaucaagaagaacuccaccuaccccaccaucaagaaguccuacaacaacaccaaccaggaggaccuccucguccucuggggcauccaccaccccaacgacgccgccgagcagacccgccucuaccagaaccccaccaccuacaucuccaucggcaccuccacccucaaccagcgccucguccccaagaucgccacccgcuccaaggucaacggccaguccggccgcauggaguucuucuggaccauccucaagcccaacgacgccaucaacuucgaguccaacggcaacuucaucgcccccgaguacgccuacaagaucgucaagaagggcgacuccgccaucaugaaguccgagcucgaguacggcaacugcaacaccaagugccagacccccaugggcgccaucaacuccuccaugcccuuccacaacauccacccccucaccaucggcgagugccccaaguacgucaaguccaaccgccucguccucgccaccggccuccgcaacuccccccagcgcgagucccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccauccgcaacggcaccuacaacuacccccaguacuccgaggaggcccgccucaagcgcgaggagaucuccggcgucaagcucgaguccaucggcaccuaccagauccucuccaucuacuccaccgucgccuccucccucgcccucgccaucaugauggccggccucucccucuggaugugcuccaacggcucccuccagugccgcaucugcauc

SEQ ID NO: 20744 - RNA, 1704 nt, Artificial Sequence
  derived and/or modified sequence opt2 from anti-influenza_Chain
auggagaagaucguccuccucuucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccgucaacgaccucugcuaccccggcgacuucaacgacuacgaggagcucaagcaccuccucucccgcaucaaccacuucgagaagauccagaucauccccaaguccuccugguccucccacgaggccucccucggcgucuccuccgccugccccuaccagggcaaguccuccuucuuccgcaacgucgucuggcucaucaagaagaacuccaccuaccccaccaucaagcgcuccuacaacaacaccaaccaggaggaccuccucguccucuggggcauccaccaccccaacgacgccgccgagcagaccaagcucuaccagaaccccaccaccuacaucuccgucggcaccuccacccucaaccagcgccucgucccccgcaucgccacccgcuccaaggucaacggccaguccggccgcauggaguucuucuggaccauccucaagcccaacgacgccaucaacuucgaguccaacggcaacuucaucgcccccgaguacgccuacaagaucgucaagaagggcgacuccaccaucaugaaguccgagcucgaguacggcaacugcaacaccaagugccagacccccaugggcgccaucaacuccuccaugcccuuccacaacauccacccccucaccaucggcgagugccccaaguacgucaaguccaaccgccucguccucgccaccggccuccgcaacuccccccagcgcgagcgccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucuccggcgucaagcucgaguccaucggcaucuaccagauccucuccaucuacuccaccgucgccuccucccucgcccucgccaucauggucgccggccucucccucuggaugugcuccaacggcucccuccagugccgcaucugcauc

SEQ ID NO: 20745 - RNA, 1704 nt, Artificial Sequence; identical to SEQ ID NO: 20742
  derived and/or modified sequence opt2 from anti-influenza_Chain

SEQ ID NO: 20746 - RNA, 1704 nt, Artificial Sequence; identical to SEQ ID NO: 20743
  derived and/or modified sequence opt2 from anti-influenza_Chain

SEQ ID NO: 20747 - RNA, 1704 nt, Artificial Sequence; identical to SEQ ID NO: 20744
  derived and/or modified sequence opt2 from anti-influenza_Chain

SEQ ID NO: 20748 - RNA, 1707 nt, Artificial Sequence
  derived and/or modified sequence opt2 from anti-influenza_Chain
uccaagucccgcggcuacaagaugaacacccagauccucgucuucgcccucgucgccuccauccccaccaacgccgacaagaucugccucggccaccacgccgucuccaacggcaccaaggucaacacccucaccgagcgcggcgucgaggucgucaacgccaccgagaccgucgagcgcaccaacgucccccgcaucugcuccaagggcaagcgcaccgucgaccucggccagugcggccuccucggcaccaucaccggccccccccagugcgaccaguuccucgaguucuccgccgaccucaucaucgagcgccgcgagggcuccgacgucugcuaccccggcaaguucgucaacgaggaggcccuccgccagauccuccgcgaguccggcggcaucgacaaggagaccaugggcuucaccuacuccggcauccgcaccaacggcaccaccuccgccugccgccgcuccggcuccuccuucuacgccgagaugaaguggcuccucuccaacaccgacaacgccgccuucccccagaugaccaaguccuacaagaacacccgcaaggaccccgcccucaucaucuggggcauccaccacuccggcuccaccaccgagcagaccaagcucuacggcuccggcaacaagcucaucaccgucggcuccuccaacuaccagcaguccuucguccccucccccggcgcccgcccccaggucaacggccaguccggccgcaucgacuuccacuggcucauccucaaccccaacgacaccgucaccuucuccuucaacggcgccuucaucgcccccgaccgcgccuccuuccuccgcggcaaguccaugggcauccaguccgagguccaggucgacgccaacugcgagggcgacugcuaccacuccggcggcaccaucaucuccaaccuccccuuccagaacaucaacucccgcgccgucggcaagugcccccgcuacgucaagcaggagucccuccuccucgccaccggcaugaagaacguccccgagauccccaagcgccgccgccgcggccucuucggcgccaucgccggcuucaucgagaacggcugggagggccucaucgacggcugguacggcuuccgccaccagaacgcccagggcgagggcaccgccgccgacuacaaguccacccaguccgccaucgaccagaucaccggcaagcucaaccgccucaucgagaagaccaaccagcaguucgagcucaucgacaacgaguucaccgaggucgagcgccagaucggcaacgucaucaacuggacccgcgacuccaugaccgaggucugguccuacaacgccgagcuccucgucgccauggagaaccagcacaccaucgaccucgccgacuccgagaugaacaagcucuacgagcgcgucaagcgccagcuccgcgagaacgccgaggaggacggcaccggcugcuucgagaucuuccacaagugcgacgacgacugcauggccuccauccgcaacaacaccuacgaccacuccaaguaccgcgaggaggccauccagaaccgcauccagaucgaccccgucaagcucuccuccggcuacaaggacgucauccucugguucuccuucggcgccuccugcuucauccuccucgccaucgccaugggccucgucuucaucugcgucaagaacggcaacaugcgcugcaccaucugcauc

SEQ ID NO: 20749 - RNA, 1707 nt, Artificial Sequence; identical to SEQ ID NO: 20748
  derived and/or modified sequence opt2 from anti-influenza_Chain

SEQ ID NO: 20750 - RNA, 1692 nt, Artificial Sequence
  derived and/or modified sequence opt2 from anti-influenza_Chain
gaccagaucugcaucggcuaccacgccaacaacuccaccgagaaggucgacaccaaccucgagcgcaacgucaccgucacccacgccaaggacauccucgagaagacccacaacggcaagcucugcaagcucaacggcauccccccccucgagcucggcgacugcuccaucgccggcuggcuccucggcaaccccgagugcgaccgccuccucuccguccccgagugguccuacaucauggagaaggagaacccccgcgacggccucugcuaccccggcuccuucaacgacuacgaggagcucaagcaccuccucuccuccgucaagcacuucgagaaggucaagauccuccccaaggaccgcuggacccagcacaccaccaccggcggcucccgcgccugcgccgucuccggcaaccccuccuucuuccgcaacauggucuggcucaccaaggagggcuccgacuaccccgucgccaagggcuccuacaacaacaccuccggcgagcagaugcucaucaucuggggcguccaccaccccaucgacgagaccgagcagcgcacccucuaccagaacgucggcaccuacgucuccgucggcaccuccacccucaacaagcgcuccacccccgagaucgccacccgccccaaggucaacggccagggcggccgcauggaguucuccuggacccuccucgacaugugggacaccaucaacuucgaguccaccggcaaccucaucgcccccgaguacggcuucaagaucuccaagcgcggcuccuccggcaucaugaagaccgagggcacccucgagaacugcgagaccaagugccagaccccccucggcgccaucaacaccacccuccccuuccacaacguccacccccucaccaucggcgagugccccaaguacgucaaguccgagaagcucguccucgccaccggccuccgcaacgucccccagaucgagucccgcggccucuucggcgccaucgccggcuucaucgagggcggcuggcagggcauggucgacggcugguacggcuaccaccacuccaacgaccagggcuccggcuacgccgccgacaaggaguccacccagaaggccuucgacggcaucaccaacaaggucaacuccgucaucgagaagaugaacacccaguucgaggccgucggcaaggaguucggcaaccucgagcgccgccucgagaaccucaacaagcgcauggaggacggcuuccucgacgucuggaccuacaacgccgagcuccucguccucauggagaacgagcgcacccucgacuuccacgacuccaacgucaagaaccucuacgacaagguccgcaugcagcuccgcgacaacgucaaggagcucggcaacggcugcuucgaguucuaccacaagugcgacgacgagugcaugaacuccgucaagaacggcaccuacgacuaccccaaguacgaggaggaguccaagcucaaccgcaacgagaucaagggcgucaagcucuccuccaugggcgucuaccaguccggccgccucgucccccgcggcucccccggcuccggcuacauccccgaggccccccgcgacggccaggccuacguccgcaaggacggcgaguggguccuccucuccaccuuccucggcaagcccauccccaacccccuccucggccucgacuccaccggc

SEQ ID NO: 20751 - RNA, 1692 nt, Artificial Sequence
  derived and/or modified sequence opt2 from anti-influenza_Chain
cagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacgacgaguccuucaacuggaccggcgucacccagaacggcaccuccuccuccugcaagcgccgcuccaacaacuccuucuucucccgccucaacuggcucacccagcucaaguucaaguaccccgcccucaacgucaccaugcccaacaacgagaaguucgacaagcucuacaucuggggcguccaccaccccgucaccgacaacgaccagaucuuccucuacgcccaggccuccggccgcaucaccgucuccaccaagcgcucccagcagaccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuccggccgccucgucccccgcggcucccccggcuccggcuacauccccgaggccccccgcgacggccaggccuacguccgcaaggacggcgaguggguccuccucuccaccuuccucggcaagcccauccccaacccccuccucggccucgacuccaccggc

SEQ ID NO: 20752 - RNA, 1692 nt, Artificial Sequence; identical to SEQ ID NO: 20750
  derived and/or modified sequence opt2 from anti-influenza_Chain

SEQ ID NO: 20753 - RNA, 1692 nt, Artificial Sequence; identical to SEQ ID NO: 20751
  derived and/or modified sequence opt2 from anti-influenza_Chain

SEQ ID NO: 20754 - RNA, 1695 nt, Artificial Sequence
  derived and/or modified sequence opt2 from anti-influenza_Chain
gacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucucccgcgaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccaccaccggcgucuccgccuccugcucccacaacggcgaguccuccuucuacaagaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaaggagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccaguccggccgccucgucccccgcggcucccccggcuccggcuacauccccgaggccccccgcgacggccaggccuacguccgcaaggacggcgaguggguccuccucuccaccuuccucggcaagcccauccccaacccccuccucggccucgacuccaccggc

SEQ ID NO: 20755 - RNA, 1695 nt, Artificial Sequence
  derived and/or modified sequence opt2 from anti-influenza_Chain
cagaacuacaccggcaaccccgucaucugccucggccaccacgccgucuccaacggcaccauggucaagacccucaccgacgaccagaucgaggucgucaccgcccaggagcucgucgagucccagcaccuccccgagcucugccccuccccccuccgccucgucgacggccagaccugcgacaucgucaacggcgcccucggcucccccggcugcgaccaccucaacggcgccgagugggacgucuucaucgagcgccccaccgccgucgacaccugcuaccccuucgacguccccgacuaccagucccuccgcuccauccucgccaacaacggcaaguucgaguucaucgccgaggaguuccaguggaacaccgucaagcagaacggcaaguccggcgccugcaagcgcgccaacgucaacgacuucuucaaccgccucaacuggcucaccaaguccgacggcaacgccuacccccuccagaaccucaccaaggucaacaacggcgacuacgcccgccucuacaucuggggcguccaccaccccuccaccgacaccgagcagaccaaccucuacaagaacaaccccggccgcgucaccgucuccacccagaccucccagaccuccgucguccccaacaucggcucccgccccuggguccgcggccucuccucccgcaucuccuucuacuggaccaucgucgagcccggcgaccucaucgucuucaacaccaucggcaaccucaucgccccccgcggccacuacaagcucaacucccagaagaaguccaccauccucaacaccgccguccccaucggcuccugcgucuccaagugccacaccgacaagggcuccaucuccaccaccaagcccuuccagaacaucucccgcaucuccaucggcgacugccccaaguacgucaagcagggcucccucaagcucgccaccggcaugcgcuccauccucgagaaggccacccgcggccucuucggcgccaucgccggcuucaucgagaacggcuggcagggccucaucgacggcugguacggcuuccgccaccagaacgccgagggcaccggcaccgccgccgaccucaaguccacccaggccgccaucgaccagaucaacggcaagcucaaccgccucaucggcaagcccaacgagaaguaccaccagaucgagaaggaguucgagcaggucgagggccgcauccaggaccucgagaaguacgucgaggacaccaagaucgaccucugguccuacaacgccgagcuccucgucgcccucgagaaccagcacaccaucgacgucaccgacuccgagaugaacaagcucuucgagcgcguccgccaccagcuccgcgagaacgccgaggacaagggcaacggcugcuucgagaucuuccaccagugcgacaacuccugcaucgaguccauccgcaacggcaccuacgaccacgacaucuaccgcgacgaggccaucaacaaccgcuuccagauccagggcgucaagcucauccagggcuacaaggacuccggccgccucgucccccgcggcucccccggcuccggcuacauccccgaggccccccgcgacggccaggccuacguccgcaaggacggcgaguggguccuccucuccaccuuccucggcaagcccauccccaacccccuccucggccucgacuccaccggc

SEQ ID NO: 20756 - RNA, 1695 nt, Artificial Sequence
  derived and/or modified sequence opt2 from anti-influenza_Chain
gaccagaucugcaucggcuaccacgccaacaacuccaccgagcaggucgacaccaucauggagaagaacgucaccgucacccacgcccaggacauccucgagaagacccacaacggcaagcucugcaaccucgacggcgucaagccccucauccucaaggacugcuccgucgccggcuggcuccucggcaaccccaugugcgacgaguuccucaacgucuccgagugguccuacaucgucgagaaggccucccccgccaacggccucugcuaccccggcgacuucaacgacuacgaggagcucaagcaccuccucucccgcaucaaccaccucaagaagaucaagaucauccccaaguccuacugguccaaccacgaggccuccuccggcgucuccgccgccugcuccuaccucggcgagcccuccuucuuccgcaacgucgucuggcucaucaagaagaacaacaccuacccccccaucaaggucaacuacaccaacaccaaccaggaggaccuccucguccucuggggcauccaccaccccaacgacgagaaggagcagauccgcaucuaccagaaccccaacaccuccaucuccgucggcaccuccacccucaaccagcgccucguccccaagaucgccacccgccccaaggucaacggccaguccggccgcauggaguucuucuggaccauccucaagcccaacgacuccaucaacuucgacuccaacggcaacuucaucgcccccgaguacgccuacaagaucgccaagaagggcgacuccgucaucaugaaguccgagcucgaguacggcaacugcaacaccaagugccagacccccaugggcgccaucaacuccuccaugcccuuccacaacauccacccccucaccaucggcgagugccccaaguacgucaaguccaaccgccucguccucgccaccggccuccgcaacgccccccagaccgagacccgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcaucaccaacaaggucaacuccaucaucgacaagaugaacacccaguucgagaucgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgagaagguccgccuccagcuccgcgacaacgccaaggagcucggcaacggcugcuucgaguucuaccacaagugcgacaacgagugcauggaguccguccgcaacggcaccuacgacuacccccaguacuccgaggaggcccgccucucccgcgaggagaucuccggcgucaagauggaguccauggucaccuaccaguccggccgccucgucccccgcggcucccccggcuccggcuacauccccgaggccccccgcgacggccaggccuacguccgcaaggacggcgaguggguccuccucuccaccuuccucggcaagcccauccccaacccccuccucggccucgacuccaccggc

SEQ ID NO: 20757 - RNA, 1695 nt, Artificial Sequence; identical to SEQ ID NO: 20754
  derived and/or modified sequence opt2 from anti-influenza_Chain

SEQ ID NO: 20758 - RNA, 1695 nt, Artificial Sequence; identical to SEQ ID NO: 20755
  derived and/or modified sequence opt2 from anti-influenza_Chain

SEQ ID NO: 20759 - RNA, 1695 nt, Artificial Sequence; identical to SEQ ID NO: 20756
  derived and/or modified sequence opt2 from anti-influenza_Chain

SEQ ID NO: 20760 - RNA, 1698 nt, Artificial Sequence
  derived and/or modified sequence opt2 from anti-influenza_Chain
gacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagacccccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacaccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccaguccggccgccucgucccccgcggcucccccggcuccggcuacauccccgaggccccccgcgacggccaggccuacguccgcaaggacggcgaguggguccuccucuccaccuuccucggcaagcccauccccaacccccuccucggccucgacuccaccggc

SEQ ID NO: 20761 - RNA, 1698 nt, Artificial Sequence
  derived and/or modified sequence opt2 from anti-influenza_Chain
gaccgcaucugcaucggcuaccaguccaacaacuccaccgacaccgucaacacccucaucgagcagaagguccccgucacccagaccauggagcucgucgagaccgagaagcaccccgccuacugcaacaccgaccucggcgccccccucgagcuccgcgacugcaagaucgaggccgucaucuacggcaaccccaagugcgacauccaccucaaggaccagggcugguccuacaucgucgagcgccccuccgcccccgagggcaugugcuaccccggcuccgucgagaaccucgaggagcuccgcuucgucuucuccuccgccgccuccuacaagcgcauccgccucuucgacuacucccgcuggaacgucaccuccuccggcaccuccaaggccugcaacgccuccaccggcggccaguccuucuaccgcuccaucaacuggcucaccaagaagaagcccgacaccuacgacuucaacgagggcaccuacgucaacaacgaggacggcgacaucaucuuccucuggggcauccaccacccccccgacaccaaggagcagaccacccucuacaagaacgccaacacccucuccuccgucaccaccaacaccaucaaccgcuccuuccagcccaacaucggcccccgcccccucguccgcggccagcagggccgcauggacuacuacuggggcauccucaagcgcggcgagacccucaagauccgcaccaacggcaaccucaucgcccccgaguucggcuaccuccucaagggcgagucccacggccgcaccauccagaacgaggacauccccaucggcaacugcuacaccaagugccagaccuacgccggcgccaucaacuccuccaagcccuuccagaacgccucccgccacuacaugggcgagugccccaaguacgucaagaaggccucccuccgccucgccgucggccuccgcaacacccccuccgucgagccccgcggccucuucggcgccaucgccggcuucaucgagggcggcugguccggcaugaucgacggcugguacggcuuccaccacuccaacuccgagggcaccggcauggccgccgaccagaaguccacccaggaggccaucgacaagaucaccaacaaggucaacaacaucgucgacaagaugaaccgcgaguucgaggucgucaaccacgaguucuccgaggucgagaagcgcaucaacaugaucaacgacaagaucgacgaccagaucgaggaccucugggccuacaacgccgagcuccucguccuccucgagaaccagaagacccucgacgagcacgacuccaacgucaagaaccucuucgacgaggucaagcgccgccucuccgccaacgccaucgacgccggcaacggcugcuucgacauccuccacaagugcgacaacgagugcauggagaccaucaagaacggcaccuacgaccacaaggaguacgaggaggaggccaagcucgagcgcuccaagaucaacggcgucaagcucgaggagaacaccaccuacaaguccggccgccucgucccccgcggcucccccggcuccggcuacauccccgaggccccccgcgacggccaggccuacguccgcaaggacggcgaguggguccuccucuccaccuuccucggcaagcccauccccaacccccuccucggccucgacuccaccggc

SEQ ID NO: 20762 - RNA, 1698 nt, Artificial Sequence; identical to SEQ ID NO: 20760
  derived and/or modified sequence opt2 from anti-influenza_Chain

SEQ ID NO: 20763 - RNA, 1698 nt, Artificial Sequence; identical to SEQ ID NO: 20761
  derived and/or modified sequence opt2 from anti-influenza_Chain

SEQ ID NO: 20764 - RNA, 1701 nt, Artificial Sequence
  derived and/or modified sequence opt2 from anti-influenza_Chain
gacaagaucugcaucggcuaccacgccaacaacuccaccacccaggucgacaccauccucgagaagaacgucaccgucacccacuccgucgagcuccucgagaaccagaaggaggagcgcuucugcaagauccucaacaaggccccccucgaccuccgcggcugcaccaucgagggcuggauccucggcaacccccagugcgaccuccuccucggcgaccaguccugguccuacaucgucgagcgccccaccgcccagaacggcaucugcuaccccggcgcccucaacgaggucgaggagcucaaggcccucaucggcuccggcgagcgcgucgagcgcuucgagauguuccccaaguccaccuggaccggcgucgacaccuccuccggcgucaccaaggccugccccuacaacuccggcuccuccuucuaccgcaaccuccucuggaucaucaagaccaaguccgccgccuaccccgucaucaagggcaccuacaacaacaccggcucccagcccauccucuacuucuggggcguccaccacccccccgacaccaacgagcagaacacccucuacggcuccggcgaccgcuacguccgcaugggcaccgaguccaugaacuucgccaagucccccgagaucgccgcccgccccgccgucaacggccagcgcggccgcaucgacuacuacugguccguccucaagcccggcgagacccucaacgucgaguccaacggcaaccucaucgcccccugguacgccuacaaguucgucuccaccaacaacaagggcgccaucuucaaguccaaccuccccaucgagaacugcgacgccaccugccagaccaucgccggcguccuccgcaccaacaagaccuuccagaacgucuccccccucuggaucggcgagugccccaaguacgucaaguccgagucccuccgccucgccaccggccuccgcaacgucccccagaucgagacccgcggccucuucggcgccaucgccggcuucaucgagggcggcuggaccggcaugaucgacggcugguacggcuaccaccacgagaacucccagggcuccggcuacgccgccgacaaggaguccacccagaaggccaucgacggcaucaccaacaaggucaacuccaucaucgacaagaugaacacccaguucgaggccgucgaccacgaguucuccaaccucgagcgccgcaucgacaaccucaacaagcgcauggaggacggcuuccucgacgucuggaccuacaacgccgagcuccucguccuccucgagaacgagcgcacccucgaccuccacgacgccaacgucaagaaccucuacgagaaggucaagucccagcuccgcgacaacgccaacgaccucggcaacggcugcuucgaguucuggcacaagugcgacaacgagugcaucgaguccgucaagaacggcaccuacgacuaccccaaguaccaggacgaguccaagcucaaccgccaggagaucgaguccgucaagcucgacaaccucggcgucuaccaguccggccgccucgucccccgcggcucccccggcuccggcuacauccccgaggccccccgcgacggccaggccuacguccgcaaggacggcgaguggguccuccucuccaccuuccucggcaagcccauccccaacccccuccucggccucgacuccaccggc

SEQ ID NO: 20765 - RNA, 1701 nt, Artificial Sequence; identical to SEQ ID NO: 20764
  derived and/or modified sequence opt2 from anti-influenza_Chain

SEQ ID NO: 20766 - RNA, 1704 nt, Artificial Sequence
  derived and/or modified sequence opt2 from anti-influenza_Chain
gaccacaucugcaucggcuaccacgccaacaacuccaccgagcaggucgacaccaucauggagaagaacgucaccgucacccacgcccaggacauccucgagaagacccacaacggcaagcucugcgaccucaacggcgucaagccccucauccucaaggacugcuccgucgccggcuggcuccucggcaaccccaugugcgacgaguucaucaacguccccgagugguccuacaucgucgagaaggccaaccccgccaacgaccucugcuaccccggcaacuucaacgacuacgaggagcucaagcaccuccucucccgcaucaaccacuucgagaagauccagaucauccccaaggacuccugguccgaccacgaggccucccucggcgucuccuccgccugccccuaccagggcaacuccuccuucuuccgcaacgucgucuggcucaucaagaagggcaacgccuaccccaccaucaagaaguccuacaacaacaccaaccaggaggaccuccucguccucuggggcauccaccaccccaacgacgaggccgagcagacccgccucuaccagaaccccaccaccuacaucuccaucggcaccuccacccucaaccagcgccucguccccaagaucgccacccgcuccaaggucaacggccaguccggccgcaucgacuucuucuggaccauccucaagcccaacgacgccaucaacuucgaguccaacggcaacuucaucgcccccgaguacgccuacaagaucgucaagaagggcgacuccaccaucaugaaguccgaggucgaguacggcaacugcaacacccgcugccagacccccaugggcgccaucaacuccuccaugcccuuccacaacauccacccccucaccaucggcgagugccccaaguacgucaaguccaacaagcucguccucgccaccggccuccgcaacuccccccagcgcgagcgccgccgcaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucuccggcgucaagcucgaguccaucggcaccuaccaguccggccgccucgucccccgcggcucccccggcuccggcuacauccccgaggccccccgcgacggccaggccuacguccgcaaggacggcgaguggguccuccucuccaccuuccucggcaagcccauccccaacccccuccucggccucgacuccaccggc

SEQ ID NO: 20767 - RNA, 1704 nt, Artificial Sequence
  derived and/or modified sequence opt2 from anti-influenza_Chain
gaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccgccaacgaccucugcuaccccggcaacuucaacgacuacgaggagcucaagcaccuccucucccgcaucaaccacuucgagaagauccagaucauccccaaguccuccugguccgaccacgaggccuccuccggcgucuccuccgccugccccuaccagggcacccccuccuucuuccgcaacgucgucuggcucaucaagaagaacaacaccuaccccaccaucaagcgcuccuacaacaacaccaaccaggaggaccuccucauccucuggggcauccaccacuccaacgacgccgccgagcagaccaagcucuaccagaaccccaccaccuacaucuccgucggcaccuccacccucaaccagcgccucguccccaagaucgccacccgcuccaaggucaacggccaguccggccgcauggacuucuucuggaccauccucaagcccaacgacgccaucaacuucgaguccaacggcaacuucaucgcccccgaguacgccuacaagaucgucaagaagggcgacuccgccaucgucaaguccgaggucgaguacggcaacugcaacaccaagugccagacccccaucggcgccaucaacuccuccaugcccuuccacaacauccacccccucaccaucggcgagugccccaaguacgucaaguccaacaagcucguccucgccaccggccuccgcaacuccccccuccgcgagcgccgccgcaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucuccggcgucaagcucgaguccaucggcaccuaccaguccggccgccucgucccccgcggcucccccggcuccggcuacauccccgaggccccccgcgacggccaggccuacguccgcaaggacggcgaguggguccuccucuccaccuuccucggcaagcccauccccaacccccuccucggccucgacuccaccggc

SEQ ID NO: 20768 - RNA, 1704 nt, Artificial Sequence; identical to SEQ ID NO: 20766
  derived and/or modified sequence opt2 from anti-influenza_Chain

SEQ ID NO: 20769 - RNA, 1704 nt, Artificial Sequence; identical to SEQ ID NO: 20767
  derived and/or modified sequence opt2 from anti-influenza_Chain

SEQ ID NO: 20770 - RNA, 1707 nt, Artificial Sequence
  derived and/or modified sequence opt2 from anti-influenza_Chain
gaccagaucugcaucggcuaccacgccaacaacuccaccgagcaggucgacaccaucauggagaagaacgucaccgucacccacgcccaggacauccucgagaagaagcacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccgucaacgaccucugcuaccccggcgacuucaacgacuacgaggagcucaagcaccuccucucccgcaucaaccacuucgagaagauccagaucauccccaaguccuccugguccucccacgaggccucccucggcgucuccuccgccugccccuaccagggcaaguccuccuucuuccgcaacgucgucuggcucaucaagaagaacuccaccuaccccaccaucaagcgcuccuacaacaacaccaaccaggaggaccuccucguccucuggggcauccaccaccccaacgacgccgccgagcagaccaagcucuaccagaaccccaccaccuacaucuccgucggcaccuccacccucaaccagcgccucgucccccgcaucgccacccgcuccaaggucaacggccaguccggccgcauggaguucuucuggaccauccucaagcccaacgacgccaucaacuucgaguccaacggcaacuucaucgcccccgaguacgccuacaagaucgucaagaagggcgacuccaccaucaugaaguccgagcucgaguacggcaacugcaacaccaagugccagacccccaugggcgccaucaacuccuccaugcccuuccacaacauccacccccucaccaucggcgagugccccaaguacgucaaguccaaccgccucguccucgccaccggccuccgcaacuccccccagcgcgagcgccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucuccggcgucaagcucgaguccaucggcaucuaccaguccggccgccucgucccccgcggcucccccggcuccggcuacauccccgaggccccccgcgacggccaggccuacguccgcaaggacggcgaguggguccuccucuccaccuuccucggcaagcccauccccaacccccuccucggccucgacuccaccggc

SEQ ID NO: 20771 - RNA, 1707 nt, Artificial Sequence
  derived and/or modified sequence opt2 from anti-influenza_Chain
gaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccaccaacgaccucugcuaccccggcuccuucaacgacuacgaggagcucaagcaccuccucucccgcaucaaccacuucgagaagauccagaucauccccaaguccuccugguccgaccacgaggccuccuccggcgucuccuccgccugccccuaccucggcucccccuccuucuuccgcaacgucgucuggcucaucaagaagaacuccaccuaccccaccaucaagaaguccuacaacaacaccaaccaggaggaccuccucguccucuggggcauccaccaccccaacgacgccgccgagcagacccgccucuaccagaaccccaccaccuacaucuccaucggcaccuccacccucaaccagcgccucguccccaagaucgccacccgcuccaaggucaacggccaguccggccgcauggaguucuucuggaccauccucaagcccaacgacgccaucaacuucgaguccaacggcaacuucaucgcccccgaguacgccuacaagaucgucaagaagggcgacuccgccaucaugaaguccgagcucgaguacggcaacugcaacaccaagugccagacccccaugggcgccaucaacuccuccaugcccuuccacaacauccacccccucaccaucggcgagugccccaaguacgucaaguccaaccgccucguccucgccaccggccuccgcaacuccccccagcgcgagucccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccauccgcaacggcaccuacaacuacccccaguacuccgaggaggcccgccucaagcgcgaggagaucuccggcgucaagcucgaguccaucggcaccuaccaguccggccgccucgucccccgcggcucccccggcuccggcuacauccccgaggccccccgcgacggccaggccuacguccgcaaggacggcgaguggguccuccucuccaccuuccucggcaagcccauccccaacccccuccucggccucgacuccaccggc

SEQ ID NO: 20772 - RNA, 1707 nt, Artificial Sequence
  derived and/or modified sequence opt2 from anti-influenza_Chain
gaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguuccucaacgucuccgagugguccuacaucgucgagaagaucaaccccgccaacgaccucugcuaccccggcaacuucaacaacuacgaggagcucaagcaccuccucucccgcaucaaccgcuucgagaagauccagaucauccccaaguccuccuggcccgaccacgaggccucccucggcgucuccuccgccugccccuaccagggcggccccuccuucuaccgcaacgucgucuggcucaucaagaagaacaacaccuaccccaccaucaagaaguccuaccacaacaccaaccaggaggaccuccucguccucuggggcauccaccaccccaacgacgaggccgagcagacccgcaucuacaagaaccccaccaccuacaucuccgucggcaccuccacccucaaccagcgccucguccccaagaucgccacccgcuccaaggucaacggccaguccggccgcgucgaguucuucuggaccauccucaaguccaacgacaccaucaacuucgaguccaacggcaacuucaucgcccccgagaacgccuacaagaucgucaagaagggcgacuccaccaucaugaaguccgagcucgaguacggcaacugcaacaccaagugccagacccccaucggcgccaucaacuccuccaugcccuuccacaacauccacccccucaccaucggcgagugccccaaguacgucaaguccaaccgccucguccucgccaccggccuccgcaacuccccccagggcgagcgccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccaccgcugcgacaacgagugcauggaguccguccgcaacggcaccuacgacuacccccaguacuccgaggaggcccgccucaagcgcgaggagaucuccggcgucaagcucgaguccaucggcaccuaccaguccggccgccucgucccccgcggcucccccggcuccggcuacauccccgaggccccccgcgacggccaggccuacguccgcaaggacggcgaguggguccuccucuccaccuuccucggcaagcccauccccaacccccuccucggccucgacuccaccggc

SEQ ID NO: 20773 - RNA, 1707 nt, Artificial Sequence; identical to SEQ ID NO: 20770
  derived and/or modified sequence opt2 from anti-influenza_Chain

SEQ ID NO: 20774 - RNA, 1707 nt, Artificial Sequence; identical to SEQ ID NO: 20771
  derived and/or modified sequence opt2 from anti-influenza_Chain

SEQ ID NO: 20775 - RNA, 1707 nt, Artificial Sequence; identical to SEQ ID NO: 20772
  derived and/or modified sequence opt2 from anti-influenza_Chain

SEQ ID NO: 20776 - RNA, 1728 nt, Artificial Sequence
  derived and/or modified sequence opt2 from anti-influenza_Chain
aucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccgccaacgaccucugcuaccccggcaacuucaacgacuacgaggagcucaagcaccuccucucccgcaucaaccacuucgagaagauccagaucauccccaaguccuccugguccgaccacgaggccuccuccggcgucuccuccgccugccccuaccagggcacccccuccuucuuccgcaacgucgucuggcucaucaagaagaacaacaccuaccccaccaucaagcgcuccuacaacaacaccaaccaggaggaccuccucauccucuggggcauccaccacuccaacgacgccgccgagcagaccaagcucuaccagaaccccaccaccuacaucuccgucggcaccuccacccucaaccagcgccucguccccaagaucgccacccgcuccaaggucaacggccagaacggccgcauggacuucuucuggaccauccucaagcccaacgacgccaucaacuucgaguccaacggcaacuucaucgcccccgaguacgccuacaagaucgucaagaagggcgacuccgccaucgucaaguccgaggucgaguacggcaacugcaacaccaagugccagacccccaucggcgccaucaacuccuccaugcccuuccacaacauccacccccucaccaucggcgagugccccaaguacgucaaguccaacaagcucguccucgccaccggccuccgcaacuccccccucggcuacauccccgaggccccccgcgacggccaggccuacguccgcaaggacggcgaguggguccuccucuccaccuuccuccgcuccgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 20777 - RNA, 1728 nt, Artificial Sequence
  derived and/or modified sequence opt2 from anti-influenza_Chain
auggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaacauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggcaaguccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuuccacucc

SEQ ID NO: 20778 - RNA, 1728 nt, Artificial Sequence; identical to SEQ ID NO: 20777
  derived and/or modified sequence opt2 from anti-influenza_Chain

SEQ ID NO: 20779 - RNA, 1728 nt, Artificial Sequence; identical to SEQ ID NO: 20776
  derived and/or modified sequence opt2 from anti-influenza_Chain

SEQ ID NO: 20780 - RNA, 1731 nt, Artificial Sequence
  derived and/or modified sequence opt2 from anti-influenza_Chain
gccaaggccggcguccaguccgucaagauggagaagaucguccuccucuucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccgucaacgaccucugcuaccccggcgacuucaacgacuacgaggagcucaagcaccuccucucccgcaucaaccacuucgagaagauccagaucauccccaaguccuccugguccucccacgaggccucccucggcgucuccuccgccugccccuaccagggcaaguccuccuucuuccgcaacgucgucuggcucaucaagaagaacuccaccuaccccaccaucaagcgcuccuacaacaacaccaaccaggaggaccuccucguccucuggggcauccaccaccccaacgacgccgccgagcagaccaagcucuaccagaaccccaccaccuacaucuccgucggcaccuccacccucaaccagcgccucgucccccgcaucgccacccgcuccaaggucaacggccaguccggccgcauggaguucuucuggaccauccucaagcccaacgacgccaucaacuucgaguccaacggcaacuucaucgcccccgaguacgccuacaagaucgucaagaagggcgacuccaccaucaugaaguccgagcucgaguacggcaacugcaacaccaagugccagacccccaugggcgccaucaacuccuccaugcccuuccacaacauccacccccucaccaucggcgagugccccaaguacgucaaguccaaccgccucguccucgccaccggccuccgcaacuccccccagcgcgagcgccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucuccggcgucaagcucgaguccaucggcaucuaccagauccucuccaucuacuccaccgucgccuccucccucgcccucgcccucauggucgccggccucucccucuggaugugcuccaacggcucccuccagugccgcaucugcauc

SEQ ID NO: 20781 - RNA, 1731 nt, Artificial Sequence; identical to SEQ ID NO: 20780
  derived and/or modified sequence opt2 from anti-influenza_Chain

SEQ ID NO: 20782 - RNA, 1737 nt, Artificial Sequence
  derived and/or modified sequence opt2 from anti-influenza_Chain
auggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcacccagacccgcggcaagcucugccccaacugccucaacugcaccgaccucgacgucgcccucggccgccccaagugcaugggcaccauccccuccgccaaggccuccauccuccacgaggucaagcccgucaccuccggcugcuuccccaucaugcacgaccgcaccaagauccgccagcuccccaaccuccuccgcggcuacgagaacauccgccucuccgcccgcaacgucaucaacgccgagaccgcccccggcggccccuacaucgucggcaccuccggcuccugccccaacgucaccaacggcaagggcuucuucgccaccauggccugggccguccccaagaacaagaacaagaccgccaccaacccccucaccgucgagguccccuacaucugcaccaagggcgaggaccagaucaccgucuggggcuuccacuccgacaacgaggcccagauggucacccucuacggcgacuccaagccccagaaguucaccuccuccgccaacggcgucaccacccacuacgucucccagaucggcggcuuccccaaccagaccgaggacgagggccuccagcaguccggccgcaucgucgucgacuacaugguccagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacauggucucccgcgacaacgucuuccuccuccaccucuccauccgcaag

SEQ ID NO: 20783 - RNA, 1737 nt, Artificial Sequence; identical to SEQ ID NO: 20782
  derived and/or modified sequence opt2 from anti-influenza_Chain

SEQ ID NO: 20784 - RNA, 1731 nt, Artificial Sequence
  derived and/or modified sequence opt2 from anti-influenza_Chain
auggagaccaucucccucaucaccauccuccucgucgucaccgccuccaacgccgacaagaucugcaucggccaccaguccaccaacuccaccgagaccgucgacacccucaccgagaccaacguccccgucacccacgccaaggagcuccuccacaccgagcacaacggcaugcucugcgccaccucccucggccacccccucauccucgacaccugcaccaucgagggccucgucuacggcaaccccuccugcgaccuccuccucggcggccgcgagugguccuacaucgucgagcgcuccuccgccgucaacggcaccugcuaccccggcaacgucgagaaccucgaggagcuccgcacccucuucuccuccgccuccuccuaccagcgcauccagaucuuccccgacaccaccuggaacgucaccuacaccggcaccucccgcgccugcuccggcuccuucuaccgcuccaugcgcuggcucacccagaaguccggcuucuaccccguccaggacgcccaguacaccaacaaccgcggcaaguccauccucuucgucuggggcauccaccacccccccaccuacaccgagcagaccaaccucuacauccgcaacgacaccaccaccuccgucaccaccgaggaccucaaccgcaccuucaagcccgucaucggcccccgcccccucgucaacggccuccagggccgcaucgacuacuacugguccguccucaagcccggccagacccuccgcguccgcuccaacggcaaccucaucgcccccugguacggccacguccucuccggcggcucccacggccgcauccucaagaccgaccucaagggcggcaacugcgucguccagugccagaccgagaagggcggccucaacuccacccuccccuuccacaacaucuccaaguacgccuucggcaccugccccaaguacguccgcgucaacucccucaagcucgccgucggccuccgcaacguccccgcccgcuccucccgcggccucuucggcgccaucgccggcuucaucgagggcggcuggcccggccucgucgccggcugguacggcuuccagcacuccaacgaccagggcgucggcauggccgccgaccgcgacuccacccagaaggccaucgacaagaucaccuccaaggucaacaacaucgucgacaagaugaacaagcaguacgagaucaucgaccacgaguucuccgaggucgagacccgccucaacaugaucaacaacaagaucgacgaccagauccaggacgucugggccuacaacgccgagcuccucguccuccucgagaaccagaagacccucgacgagcacgacgccaacgucaacaaccucuacaacaaggucaagcgcgcccucggcuccaacgccauggaggacggcaagggcugcuucgagcucuaccacaagugcgacgaccagugcauggagaccauccgcaacggcaccuacaaccgccgcaaguaccgcgaggagucccgccucgagcgccagaagaucgagggcgucaagcucgaguccgagggcaccuacaaguccggccgccucgucccccgcggcucccccggcuccggcuacauccccgaggccccccgcgacggccaggccuacguccgcaaggacggcgaguggguccuccucuccaccuuccucggcaagcccauccccaacccccuccucggccucgacuccaccggc

SEQ ID NO: 20785 - RNA, 1731 nt, Artificial Sequence; identical to SEQ ID NO: 20784
  derived and/or modified sequence opt2 from anti-influenza_Chain

SEQ ID NO: 20786 - RNA, 1752 nt, Artificial Sequence
  derived and/or modified sequence opt2 from anti-influenza_Chain
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaagucccacuucgccaaccucaagggcacccagacccgcggcaagcucugccccaacugcuucaacugcaccgaccucgacgucgcccucggccgccccaagugcaugggcaacacccccuccgccaaggucuccauccuccacgaggucaagcccgccaccuccggcugcuuccccaucaugcacgaccgcaccaagauccgccagcuccccaaccuccuccgcggcuacgagaacauccgccucuccaccuccaacgucaucaacaccgagaccgcccccggcggccccuacaaggucggcaccuccggcuccugccccaacgucgccaacggcaacggcuucuucaacaccauggccugggucauccccaaggacaacaacaagaccgccaucaaccccgucaccgucgagguccccuacaucugcuccgagggcgaggaccagaucaccgucuggggcuuccacuccgacgacaagacccagauggagcgccucuacggcgacuccaacccccagaaguucaccuccuccgccaacggcgucaccacccacuacgucucccagaucggcggcuuccccaaccagaccgaggacgagggccucaagcaguccggccgcaucgucgucgacuacaugguccagaagcccggcaagaccggcaccaucgucuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacuaccucuccgagcucgaggucaagaaccuccagcgccucuccggcgccaugaacgagcuccacgacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucaacgccggcgacuucucccuccccaccuucgacucccucaacaucaccgccgccucccucaacgacgacggccucgacaaccacaccauccuccucuacuacuccaccgccgccuccucccucgccgucacccucaugaucgccaucuucaucgucuacauggucucccgcgacaacgucuccugcuccaucugccuc

SEQ ID NO: 20787 - RNA, 1752 nt, Artificial Sequence
  derived and/or modified sequence opt2 from anti-influenza_Chain
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcaccaagacccgcggcaagcucugccccgacugccucaacugcaccgaccucgacgucgcccucggccgccccaugugcgucggcaccacccccuccgccaaggccuccauccuccacgagguccgccccgucaccuccggcugcuuccccaucaugcacgaccgcaccaagauccgccagcucgccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacgacaagacccagaugaagaaccucuacggcgacuccaacccccagaaguucaccuccuccgccaacggcgucaccacccacuacgucucccagaucggcggcuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgacaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccuc

SEQ ID NO: 20788 - RNA, 1752 nt, Artificial Sequence
  derived and/or modified sequence opt2 from anti-influenza_Chain
augaaggccaucaucguccuccucauggucgucaccuccaacgccgaccgcaucugcaccggcaucaccuccuccaacuccccccacgucgucaagaccgccacccagggcgaggucaacgucaccggcgucaucccccucaccaccacccccaccaaguccuacuucgccaaccucaagggcacccgcacccgcggcaagcucugccccgacugccucaacugcaccgaccucgacgucgcccucggccgccccaugugcgucggcaccacccccuccgccaaggccuccauccuccacgaggucaagcccgucaccuccggcugcuuccccaucaugcacgaccgcaccaagauccgccagcuccccaaccuccuccgcggcuacgagaacauccgccucuccacccagaacgucaucgacgccgagaaggcccccggcggccccuaccgccucggcaccuccggcuccugccccaacgccaccuccaaguccggcuucuucgccaccauggccugggccguccccaaggacaacaacaagaacgccaccaacccccucaccgucgagguccccuacaucugcaccgagggcgaggaccagaucaccgucuggggcuuccacuccgacgacaagacccagaugaagaaccucuacggcgacuccaacccccagaaguucaccuccuccgccaacggcgucaccacccacuacgucucccagaucggcuccuuccccgaccagaccgaggacggcggccucccccaguccggccgcaucgucgucgacuacaugaugcagaagcccggcaagaccggcaccaucgucuaccagcgcggcguccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucaacgccggcgaguucucccuccccaccuucgacucccucaacaucaccgccgccucccucaacgacgacggccucgacaaccacaccauccuccucuacuacuccaccgccgccuccucccucgccgucacccucaugcucgccaucuucaucgucuacauggucucccgcgacaacgucuccugcuccaucugccuc

SEQ ID NO: 20789 - RNA, 1752 nt, Artificial Sequence; identical to SEQ ID NO: 20786
  derived and/or modified sequence opt2 from anti-influenza_Chain

SEQ ID NO: 20790 - RNA, 1752 nt, Artificial Sequence; identical to SEQ ID NO: 20787
  derived and/or modified sequence opt2 from anti-influenza_Chain

SEQ ID NO: 20791 - RNA, 1752 nt, Artificial Sequence; identical to SEQ ID NO: 20788
  derived and/or modified sequence opt2 from anti-influenza_Chain

SEQ ID NO: 20792 - RNA, 1758 nt, Artificial Sequence
  derived and/or modified sequence opt2 from anti-influenza_Chain
augaaggccaucaucguccuccucauggucgucaccuccaacgccgaccgcaucaucugcaccggcaucaccuccuccaacuccccccacgucgucaagaccgccacccagggcgaggucaacgucaccggcgucaucccccucaccaccacccccaccaagucccacuucgccaaccucaagggcaccgagacccgcggcaagcucugccccaagugccucaacugcaccgaccucgacgucgcccucggccgccccaagugcaccggcaacauccccuccgcccgcgucuccauccuccacgagguccgccccgucaccuccggcugcuuccccaucaugcacgaccgcaccaagauccgccagcuccccaaccuccuccgcggcuacgagcacauccgccucuccacccacaacgucaucaacgccgagaacgcccccggcggccccuacaagaucggcaccuccggcuccugccccaacgucaccaacggcaacggcuucuucgccaccauggccugggccguccccaagaacgacaacaacaagaccgccaccaacucccucaccaucgagguccccuacaucugcaccgagggcgaggaccagaucaccgucuggggcuuccacuccgacaacgagacccagauggccaagcucuacggcgacuccaagccccagaaguucaccuccuccgccaacggcgucaccacccacuacgucucccagaucggcggcuuccccaaccagaccgaggacggcggccucccccaguccggccgcaucgucgucgacuacaugguccagaaguccggcaagaccggcaccaucaccuaccagcgcggcauccuccucccccagaaggucuggugcgccuccggccgcuccaaggucaucaagggcucccucccccucaucggcgaggccgacugccuccacgagaaguacggcggccucaacaaguccaagcccuacuacaccggcgagcacgccaaggccaucggcaacugccccaucugggucaagaccccccucaagcucgccaacggcaccaaguaccgcccccccgccaagcuccucaaggagcgcggcuucuucggcgccaucgccggcuuccucgagggcggcugggagggcaugaucgccggcuggcacggcuacaccucccacggcgcccacggcgucgccgucgccgccgaccucaaguccacccaggaggccaucaacaagaucaccaagaaccucaacucccucuccgagcucgaggucaagaaccuccagcgccucuccggcgccauggacgagcuccacaacgagauccucgagcucgacgagaaggucgacgaccuccgcgccgacaccaucuccucccagaucgagcucgccguccuccucuccaacgagggcaucaucaacuccgaggacgagcaccuccucgcccucgagcgcaagcucaagaagaugcucggccccuccgccgucgagaucggcaacggcugcuucgagaccaagcacaagugcaaccagaccugccucgaccgcaucgccgccggcaccuucgacgccggcgaguucucccuccccaccuucgacucccucaacaucaccgccgccucccucaacgacgacggccucgacaaccacaccauccuccucuacuacuccaccgccgccuccucccucgccgucacccucaugaucgccaucuucgucgucuacauggucucccgcgacaacgucuccugcuccaucugccuc

SEQ ID NO: 20793 - RNA, 1758 nt, Artificial Sequence; identical to SEQ ID NO: 20792
  derived and/or modified sequence opt2 from anti-influenza_Chain

SEQ ID NO: 20794 - RNA, 1749 nt, Artificial Sequence
  derived and/or modified sequence opt2 from anti-influenza_Chain
auggaggcccgccuccucguccuccucugcgccuucgccgccaccaacgccgacaccaucugcaucggcuaccacgccaacaacuccaccgacaccgucgacaccguccucgagaagaacgucaccgucacccacuccgucaaccuccucgaggacucccacaacggcaagcucugcaagcucaagggcaucgccccccuccagcucggcaagugcaacaucgccggcuggcuccucggcaaccccgagugcgaccuccuccucaccgccuccuccugguccuacaucgucgagaccuccaacuccgagaacggcaccugcuaccccggcgacuucaucgacuacgaggagcuccgcgagcagcucuccuccgucuccuccuucgagaaguucgagaucuuccccaagaccuccuccuggcccaaccacgagaccaccaagggcgucaccgccgccugcuccuacgccggcgccuccuccuucuaccgcaaccuccucuggcucaccaagaagggcuccuccuaccccaagcucuccaaguccuacgucaacaacaagggcaaggagguccucguccucuggggcguccaccacccccccaccggcaccgaccagcagucccucuaccagaacgccgacgccuacgucuccgucggcuccuccaaguacaaccgccgcuucacccccgagaucgccgcccgccccaagguccgcgaccaggccggccgcaugaacuacuacuggacccuccucgagcccggcgacaccaucaccuucgaggccaccggcaaccucaucgcccccugguacgccuucgcccucaaccgcggcuccggcuccggcaucaucaccuccgacgcccccguccacgacugcaacaccaagugccagaccccccacggcgccaucaacuccucccuccccuuccagaacauccaccccgucaccaucggcgagugccccaaguacguccgcuccaccaagcuccgcauggccaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucgacggcaucaccaacaaggucaacuccgucaucgagaagaugaacacccaguucaccgccgucggcaaggaguucaacaaccucgagcgccgcaucgagaaccucaacaagaaggucgacgacggcuuccucgacaucuggaccuacaacgccgagcuccucguccuccucgagaacgagcgcacccucgacuuccacgacuccaacguccgcaaccucuacgagaaggucaagucccagcucaagaacaacgccaaggagaucggcaacggcugcuucgaguucuaccacaagugcgacgacgccugcauggaguccguccgcaacggcaccuacgacuaccccaaguacuccgaggaguccaagcucaaccgcgaggagaucgacggcgucaagcucgaguccaugggcgucuaccaguccggccgccucgucccccgcggcucccccggcuccggcuacauccccgaggccccccgcgacggccaggccuacguccgcaaggacggcgaguggguccuccucuccaccuuccucggcaagcccauccccaacccccuccucggccucgacuccaccggc

SEQ ID NO: 20795 - RNA, 1749 nt, Artificial Sequence; identical to SEQ ID NO: 20794
  derived and/or modified sequence opt2 from anti-influenza_Chain

SEQ ID NO: 20796 - RNA, 1755 nt, Artificial Sequence
  derived and/or modified sequence opt2 from anti-influenza_Chain
auggagcgcaccguccuccuccucgccaccgucucccucgucaaguccgaccagaucugcaucggcuaccacgccaacaacuccaccgagcaggucgacaccaucauggagaagaacgucaccgucacccacgcccaggacauccucgagcgcacccacaacggcaagcucugcgaccucaacggcgucaagccccucauccuccgcgacugcuccgucgccggcuggcuccucggcaaccccaugugcgacgaguucaucaacguccccgagugguccuacaucgucgagaaggccucccccgccaacgaccucugcuaccccggcaacuucaacgacuacgaggagcucaagcaccuccucucccgcaucaaccacuucgagaagauccagaucauccccaaguccuccugguccaaccacgacgccuccuccggcgucuccuccgccugccccuaccucggccgcuccuccuucuuccgcaacgucgucuggcucaucaagaagaacuccgccuaccccaccaucaagcgcuccuacaacaacaccaaccaggaggaccuccucguccucuggggcguccaccaccccaacgacgccgccgagcagaccaagcucuaccagaaccccaccaccuacaucuccgucggcaccuccacccucaaccagcgccucguccccgagaucgccacccgccccaaggucaacggccaguccggccgcauggaguucuucuggaccauccucaagcccaacgacgccaucaacuucgaguccaacggcaacuucaucgcccccgaguacgccuacaagaucgucaagaagggcgacuccaccaucaugaaguccgagcucgaguacggcaacugcaacaccaagugccagacccccaugggcgccaucaacuccuccaugcccuuccacaacauccacccccucaccaucggcgagugccccaaguacgucaaguccaaccgccucguccucgccaccggccuccgcaacaccccccagcgcgagcgccgccgcaagaagcgcggccucuucggcgccaucgccggcuucaucgagggcggcuggcagggcauggucgacggcugguacggcuaccaccacuccaacgagcagggcuccugcuacuccgccgacaaggaguccacccagaaggccaucgacggcgucaccaacaaggucaacuccaucaucaacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccgucaagaacggcaccuacgacuacccccaguacuccgaggaggcccgccucaaccgcgaggagaucuccggcgucaagcucgaguccaugggcaccuaccaguccggccgccucgucccccgcggcucccccggcuccggcuacauccccgaggccccccgcgacggccaggccuacguccgcaaggacggcgaguggguccuccucuccaccuuccucggcaagcccauccccaacccccuccucggccucgacuccaccggc

SEQ ID NO: 20797 - RNA, 1755 nt, Artificial Sequence; identical to SEQ ID NO: 20796
  derived and/or modified sequence opt2 from anti-influenza_Chain

SEQ ID NO: 20798 - RNA, 1947 nt, Artificial Sequence
  derived and/or modified sequence opt2 from anti-influenza_Chain
augggcgacaagaucaacuucaucuucggcauccacaaccaccagccccucggcaacuucggcugggucuucgaggaggccuacgagaagugcuacuggcccuuccucgagacccucgaggaguaccccaacaugaaggucgccauccacaccuccggcccccucaucgaguggcuccaggacaaccgccccgaguacaucgaccuccuccgcucccucgucaagcgcggccaggucgagaucgucgucgccggcuucuacgagcccguccucgccuccauccccaaggaggaccgcaucgagcagauccgccucaugaaggagugggccaaguccaucggcuucgacgcccgcggcgucuggcucaccgagcgcgucuggcagcccgagcucgucaagacccucaaggaguccggcaucgacuacgucaucgucgacgacuaccacuucauguccgccggccucuccaaggaggagcucuacuggcccuacuacaccgaggacggcggcgaggucaucgccgucuuccccaucgacgagaagcuccgcuaccucauccccuuccgccccgucgacaagguccucgaguaccuccacucccucaucgacggcgacgaguccaaggucgccgucuuccacgacgacggcgagaaguucggcaucuggcccggcaccuacgagugggucuacgagaagggcuggcuccgcgaguucuucgaccgcaucuccuccgacgagaagaucaaccucaugcucuacaccgaguaccucgagaaguacaagccccgcggccucgucuaccuccccaucgccuccuacuucgagauguccgaguggucccuccccgccaagcaggcccgccucuucgucgaguucgucaacgagcucaaggucaagggcaucuucgagaaguaccgcgucuucguccgcggcggcaucuggaagaacuucuucuacaaguaccccgaguccaacuacaugcacaagcgcaugcucauggucuccaagcucguccgcaacaaccccgaggcccgcaaguaccuccuccgcgcccagugcaacgacgccuacuggcacggccucuucggcggcgucuaccucccccaccuccgccgcgccaucuggaacaaccucaucaaggccaacuccuacgucucccucggcaaggucauccgcgacaucgacuacgacggcuucgaggagguccucaucgagaacgacaacuucuacgccgucuucaagcccuccuacggcggcucccucgucgaguucuccuccaagaaccgccucgucaacuacgucgacguccucgcccgccgcugggagcacuaccacggcuacgucgagucccaguucgacggcgucgccuccauccacgagcucgagaagaagauccccgacgagauccgcaaggaggucgccuacgacaaguaccgccgcuucaugcuccaggaccacgucgucccccucggcaccacccucgaggacuucauguucucccgccagcaggagaucggcgaguucccccgcguccccuacuccuacgagcuccucgacggcggcauccgccucaagcgcgagcaccucggcaucgaggucgagaagaccgucaagcucgucaacgacggcuucgaggucgaguacaucgucaacaacaagaccggcaaccccguccucuucgccgucgagcucaacgucgccguccaguccaucauggagucccccggcguccuccgcggcaaggagaucgucgucgacgacaaguacgccgucggcaaguucgcccucaaguucgaggacgagauggaggucuggaaguaccccgucaagacccucucccaguccgaguccggcugggaccucauccagcagggcgucuccuacaucguccccauccgccucgaggacaagauccgcuucaagcucaaguucgaggaggccuccggc

SEQ ID NO: 20799 - RNA, 1947 nt, Artificial Sequence
  derived and/or modified sequence opt2 from anti-influenza_Chain
augucccgcaugacccucaaguccuccaugaagaagcgcguccucucccuccucaucgccgucgucuuccucucccucaccggcgucuuccccuccggccucaucgagaccaaggucuccgccgccaagaucaccgagaacuaccaguucgacucccgcauccgccucaacuccaucggcuucauccccaaccacuccaagaaggccaccaucgccgccaacugcuccaccuucuacgucgucaaggaggacggcaccaucgucuacaccggcaccgccaccuccauguucgacaacgacaccaaggagaccgucuacaucgccgacuucuccuccgucaacgaggagggcaccuacuaccucgccguccccggcgucggcaaguccgucaacuucaagaucgccaugaacgucuacgaggacgccuucaagaccgccaugcucggcauguaccuccuccgcugcggcaccuccgucuccgccaccuacaacggcauccacuacucccacggccccugccacaccaacgacgccuaccucgacuacaucaacggccagcacaccaagaaggacuccaccaagggcuggcacgacgccggcgacuacaacaaguacgucgucaacgccggcaucaccgucggcuccauguuccucgccugggagcacuucaaggaccagcucgagcccgucgcccucgagauccccgagaagaacaacuccauccccgacuuccucgacgagcucaaguacgagaucgacuggauccucaccaugcaguaccccgacggcuccggccgcgucgcccacaaggucuccacccgcaacuucggcggcuucaucaugcccgagaacgagcacgacgagcgcuucuucguccccugguccuccgccgccaccgccgacuucgucgccaugaccgccauggccgcccgcaucuuccgccccuacgacccccaguacgccgagaagugcaucaacgccgccaaggucuccuacgaguuccucaagaacaaccccgccaacgucuucgccaaccaguccggcuucuccaccggcgaguacgccaccgucuccgacgccgacgaccgccucugggccgccgccgagaugugggagacccucggcgacgaggaguaccuccgcgacuucgagaaccgcgccgcccaguucuccaagaagaucgaggccgacuucgacugggacaacgucgccaaccucggcauguucaccuaccuccucuccgagcgccccggcaagaaccccgcccucguccaguccaucaaggacucccuccucuccaccgccgacuccaucguccgcaccucccagaaccacggcuacggccgcacccucggcaccaccuacuacuggggcugcaacggcaccgucguccgccagaccaugauccuccaggucgccaacaagaucucccccaacaacgacuacgucaacgccgcccucgacgccaucucccacgucuucggccgcaacuacuacaaccgcuccuacgucaccggccucggcaucaacccccccaugaacccccacgaccgccgcuccggcgccgacggcaucugggagcccuggcccggcuaccucgucggcggcggcuggcccggccccaaggacugggucgacauccaggacuccuaccagaccaacgagaucgccaucaacuggaacgccgcccucaucuacgcccucgccggcuucgucaacuacaacuccccccagaacgagguccucuacggcgacgucaacgacgacggcaaggucaacuccaccgaccucacccuccucaagcgcuacguccucaaggccgucuccacccuccccuccuccaaggccgagaagaacgccgacgucaaccgcgacggccgcgucaacuccuccgacgucaccauccucucccgcuaccucauccgcgucaucgagaagcuccccauc

SEQ ID NO: 20800 - RNA, 1947 nt, Artificial Sequence; identical to SEQ ID NO: 20798
  derived and/or modified sequence opt2 from anti-influenza_Chain

SEQ ID NO: 20801 - RNA, 1947 nt, Artificial Sequence; identical to SEQ ID NO: 20799
  derived and/or modified sequence opt2 from anti-influenza_Chain

SEQ ID NO: 20802 - RNA, 2046 nt, Artificial Sequence
  derived and/or modified sequence opt2 from anti-influenza_Chain
augaagcccucccacuucaccgagaagcgcuucaugaagaagguccucggccucuuccucgucgucgucaugcucgccuccgucggcguccuccccaccuccaagguccaggccgccggcaccaccgucaccuccauggaguacuucucccccgccgacggccccgucaucuccaaguccggcgucggcaaggccuccuacggcuucgucaugcccaaguucaacggcggcuccgccaccuggaacgacgucuacuccgacgucggcgucaacgucaaggucggcaacaacugggucgacaucgaccaggccggcggcuacaucuacaaccagaacuggggccacugguccgacggcggcuucaacggcuacugguucacccucuccgccaccaccgagauccagcucuacuccaaggccaacggcgucaagcucgaguaccagcucgucuuccagaacaucaacaagaccaccaucaccgccaugaaccccacccagggcccccagaucaccgccuccuucaccggcggcgccggcuucaccuaccccaccuucaacaacgacuccgccgucaccuacgaggccgucgccgacgaccucaaggucuacgucaagcccgucaacuccuccuccuggaucgacaucgacaacaacgccgccuccggcuggaucuacgaccacaacuucggccaguucaccgacggcggcggcggcuacugguucaacgucaccgaguccaucaacgucaagcucgaguccaagaccuccuccgccaaccucgucuacaccaucaccuucaacgagcccacccgcaacuccuacgucaucacccccuacgagggcaccaccuucaccgccgacgccaacggcuccaucggcaucccccuccccaagaucgacggcggcgcccccaucgccaaggagcucggcaacuucgucuaccagaucaacaucaacggccagugggucgaccucuccaacuccucccaguccaaguucgccuacuccgccaacggcuacaacaacauguccgacgccaaccaguggggcuacugggccgacuacaucuacggccucugguuccagcccauccaggagaacaugcagauccgcaucggcuacccccucaacggccaggccggcggcaacaucggcaacaacuucgucaacuacaccuucaucggcaaccccaacgccccccgccccgacgucuccgaccaggaggacaucuccaucggcacccccaccgaccccgccaucgccggcaugaaccucaucuggcaggacgaguucaacggcaccacccucgacaccuccaaguggaacuacgagaccggcuacuaccucaacaacgaccccgccaccuggggcuggggcaacgccgagcuccagcacuacaccaacuccacccagaacgucuacguccaggacggcaagcucaacaucaaggccaugaacgacuccaaguccuucccccaggaccccaaccgcuacgcccaguacuccuccggcaagaucaacaccaaggacaagcucucccucaaguacggccgcgucgacuuccgcgccaagcuccccaccggcgacggcgucuggcccgcccucuggaugcuccccaaggacuccgucuacggcaccugggccgccuccggcgagaucgacgucauggaggcccgcggccgccuccccggcuccgucuccggcaccauccacuucggcggccaguggcccgucaaccaguccuccggcggcgacuaccacuuccccgagggccagaccuucgccaacgacuaccacgucuacuccgucgucugggaggaggacaacaucaagugguacgucgacggcaaguucuucuacaaggucaccaaccagcagugguacuccaccgccgcccccaacaaccccaacgcccccuucgacgagcccuucuaccucaucaugaaccucgccgucggcggcaacuucgacggcggccgcacccccaacgccuccgacauccccgccaccaugcaggucgacuacguccgcgucuacaaggagcag

SEQ ID NO: 20803 - RNA, 2046 nt, Artificial Sequence; identical to SEQ ID NO: 20802
  derived and/or modified sequence opt2 from anti-influenza_Chain

SEQ ID NO: 20804 - RNA, 2058 nt, Artificial Sequence
  derived and/or modified sequence opt2 from anti-influenza_Chain
augaccaaguccaucuacuucucccucggcauccacaaccaccagcccgucggcaacuucgacuucgucaucgagcgcgccuacgagauguccuacaagccccucaucaacuucuucuucaagcaccccgacuuccccaucaacguccacuucuccggcuuccuccuccucuggcucgagaagaaccaccccgaguacuucgagaagcucaagaucauggccgagcgcggccagaucgaguucgucuccggcggcuucuacgagcccauccuccccaucauccccgacaaggacaagguccagcagaucaagaagcucaacaaguacaucuacgacaaguucggccagacccccaagggcauguggcucgccgagcgcgucugggagccccaccucgucaaguacaucgccgaggccggcaucgaguacgucgucgucgacgacgcccacuucuucuccgucggccucaaggaggaggaccucuucggcuacuaccucauggaggagcagggcuacaagcucgccgucuuccccaucuccaugaagcuccgcuaccucauccccuucgccgaccccgaggagaccaucaccuaccucgacaaguucgccuccgaggacaaguccaagaucgcccuccucuucgacgacggcgagaaguucggccucuggcccgacaccuaccgcaccgucuacgaggagggcuggcucgagaccuucgucuccaagaucaaggagaacuuccuccucgucacccccgucaaccucuacaccuacaugcagcgcgucaagcccaagggccgcaucuaccuccccaccgccuccuaccgcgagaugauggaguggguccucuuccccgaggcccagaaggagcucgaggagcucgucgagaagcucaagaccgagaaccucugggacaaguucucccccuacgucaagggcggcuucuggcgcaacuuccucgccaaguacgacgaguccaaccacaugcagaagaagaugcucuacgucuggaagaagguccaggacucccccaacgaggaggucaaggagaaggccauggaggaggucuuccagggccaggccaacgacgccuacuggcacggcaucuucggcggccucuaccucccccaccuccgcaccgccaucuacgagcaccucaucaaggccgagaacuaccucgagaacuccgagauccgcuucaacaucuucgacuucgacugcgacggcaacgacgagaucaucgucgagucccccuucuucaaccucuaccucucccccaaccacggcggcuccguccucgagugggacuucaagaccaaggccuucaaccucaccaacguccucacccgccgcaaggaggccuaccacuccaagcucuccuacgucaccuccgaggcccagggcaaguccauccacgagcgcuggaccgccaaggaggagggccucgagaacauccucuucuacgacaaccaccgccgcgucuccuucaccgagaagaucuucgaguccgagcccguccucgaggaccucuggaaggacuccucccgccucgaggucgacuccuucuacgagaacuacgacuacgagaucaacaaggacgagaacaagauccgcguccucuucuccggcgucuuccgcggcuucgagcucugcaaguccuacauccucuacaaggacaaguccuucgucgacgucgucuacgagaucaagaacgucuccgagacccccaucucccucaacuucggcugggagaucaaccucaacuuccucgcccccaaccaccccgacuacuacuuccucaucggcgaccagaaguacccccucuccuccuucggcaucgagaaggucaacaacuggaagaucuucuccggcaucggcaucgagcucgagugcguccucgacgucgaggccucccucuaccgcuaccccaucgagaccgucucccucuccgaggagggcuucgagcgcgucuaccagggcuccgcccucauccacuucuacaaggucgaccuccccgucggcuccaccuggcgcaccaccauccgcuucugggucaag

SEQ ID NO: 20805 - RNA, 2058 nt, Artificial Sequence; identical to SEQ ID NO: 20804
  derived and/or modified sequence opt2 from anti-influenza_Chain

SEQ ID NO: 20806 - RNA, 2115 nt, Artificial Sequence
  derived and/or modified sequence opt2 from anti-influenza_Chain
augcccaccaaccucuucuucaacgcccaccacucccccgucggcgccuucgccuccuucacccucggcuuccccggcaaguccggcggccucgaccucgagcucgcccgccccccccgccagaacguccucaucggcgucgagucccuccacgaguccggccucuaccacguccuccccuuccucgagaccgccgaggaggacgaguccaagcgcuacgacaucgagaaccccgaccccaacccccagaagcccaacauccucauccccuucgccaaggaggagauccagcgcgaguuccacgucgccaccgacaccuggaaggccggcgaccucaccuucaccaucuacucccccgucaaggccguccccaaccccgagaccgccgacgaggaggagcucaagcucgcccucguccccgccgucaucgucgagaugaccaucgacaacaccaacggcacccgcgcccgccgcgccuucuucggcuucgagggcaccgaccccuacaccuccaugcgccgcaucgacgacaccugcccccagcuccgcggcgucggccagggccgcauccucuccaucgucuccaaggacgagggcguccgcuccgcccuccacuucuccauggaggacauccucaccgcccagcucgaggagaacuggaccuucggccucggcaaggucggcgcccucaucgucgacguccccgccggcgagaagaagaccuaccaguucgccgucugcuucuaccgcggcggcuacgucaccgccggcauggacgccuccuacuucuacacccgcuucuuccagaacaucgaggaggucggccucuacgcccucgagcaggccgagguccucaaggagcaguccuuccgcuccaacaagcucaucgagaaggaguggcucuccgacgaccagaccuucaugauggcccacgccauccgcuccuacuacggcaacacccagcuccucgagcacgagggcaagcccaucugggucgucaacgagggcgaguaccgcaugaugaacaccuucgaccucaccgucgaccagcucuucuucgagcucaagcucaaccccuggaccgucaagaacguccucgaccucuacgucgagcgcuacuccuacgaggaccgcguccgcuuccccggcgaggagaccgaguaccccuccggcaucuccuucacccacgacaugggcgucgccaacaccuucucccgcccccacuacuccuccuacgagcucuacggcaucuccggcugcuucucccacaugacccacgagcagcucgucaacuggguccucugcgccgccgucuacaucgagcagaccaaggacugggccuggcgcgacaagcgccucgccauccucgagcagugccucgaguccaugguccgccgcgaccaccccgaccccgagcagcgcaacggcgucaugggccucgacuccacccgcaccaugggcggcgccgagaucaccaccuacgacucccucgacgucucccucggccaggcccgcaacaaccucuaccucgccggcaagugcugggccgccuacgucgcccucgagaagcucuuccgcgacgucggcaaggaggagcucgccgcccucgccggcgagcaggccgagaagugcgccgccaccaucgucucccacgucaccgacgacggcuacauccccgccaucaugggcgagggcaacgacuccaagaucauccccgccaucgagggccucgucuuccccuacuucaccaacugccacgaggcccucgacgagaacggccgcuucggcgccuacauccaggcccuccgcaaccaccuccaguacguccuccgcgagggcaucugccucuuccccgacggcggcuggaagaucuccuccaccuccaacaacuccuggcucuccaagaucuaccucugccaguucaucgcccgccacauccucggcugggagugggacgagcagggcaagcgcgccgacgccgcccacgucgccuggcucacccaccccacccucuccaucugguccugguccgaccagaucaucgccggcgagaucaccggcuccaaguacuacccccgcggcgucaccuccauccucuggcucgaggagggcgag

SEQ ID NO: 20807 - RNA, 2115 nt, Artificial Sequence; identical to SEQ ID NO: 20806
  derived and/or modified sequence opt2 from anti-influenza_Chain

SEQ ID NO: 20808 - RNA, 2148 nt, Artificial Sequence
  derived and/or modified sequence opt2 from anti-influenza_Chain
auggaggacuucguccgccagugcuucaaccccaugaucgucgagcucgccgagaaggccaugaaggaguacggcgaggaccucaagaucgagaccaacaaguucgccgccaucugcacccaccucgaggucugcuucauguacuccgacuuccacuucaucaacgagcagggcgaguccaucaucgucgagcccgaggaccccaacgcccuccucaagcaccgcuucgagaucaucgagggccgcgaccgcaccauggccuggaccgucgucaacuccaucugcaacaccaccggcgccgagaagcccaaguuccuccccgaccucuacgacuacaaggagaaccgcuucaucgagaucggcgucacccgccgcgagguccacaucuacuaccucgagaaggccaacaagaucaaguccgagaagacccacauccacaucuucuccuucaccggcgaggagauggccaccaaggccgacuacacccucgacgaggagucccgcgcccgcaucaagacccgccucuucaccauccgccaggagauggccucccgcggccucugggacuccuuccgccaguccgagcgcggcgaggagaccaucgaggagcgcuucgagaucaccggcaccaugcgccgccucgccgaccagucccucccccccaacuucuccugccucgagaacuuccgcgccuacgucgacggcuucgagcccaacggcuacaucgagggcaagcucucccagauguccaaggaggucaacgcccgcaucgagcccuuccuccgcaccaccccccgccccauccgccuccccgacggcccccccugcuuccagcgcuccaaguuccuccucauggacucccucaagcucuccaucgaggaccccucccacgagggcgagggcaucccccucuacgacgccaucaagugcaugcgcaccuucuucggcuggaaggagcccuccgucgucaagccccacggcaagggcaucaaccccaacuaccuccucuccuggaagcagguccucgccgagcuccaggacaucgaguccgaggagaagaucccccgcaccaagaacaugaagaagaccucccagcucaagugggcccucggcgagaacauggcccccgagaaggucgacuucgacgacugcaaggacaucuccgaccucaagcaguacgacuccgacgagcccgagcuccgcucccucuccuccuggauccagaacgaguucaacaaggccugcgagcucaccgacuccaucuggaucgagcucgacgagaucggcgaggacgucgcccccaucgagcacaucgccuccaugcgccgcaacuacuucaccgccgaggucucccacugccgcgccaccgaguacaucaugaagggcgucuacaucaacaccgcccuccucaacgccuccugcgccgccauggacgacuuccagcucauccccaugaucuccaagugccgcaccaaggagggccgccgcaagaccaaccucuacggcuucaucaucaagggccgcucccaccuccgcaacgacaccgacgucgucaacuucgucuccauggaguucucccucaccgacccccgccucgagccccacaagugggagaaguacugcguccucgagaucggcgacaugcuccuccgcuccgccaucggccaggucucccgccccauguuccucuacguccgcaccaacggcaccuccaagaucaagaugaaguggggcauggagaugcgccgcugccuccuccagucccuccagcagaucgaguccaugaucgaggccgaguccuccgucaaggagaaggacaugaccaaggaguucuucgagaaccgcuccgagaccuggcccaucggcgagucccccaagggcgucgaggagggcuccaucggcaaggucugccgcacccuccucgccaaguccgucuucaacucccucuacgccuccccccagcucgagggcuucuccgccgagucccgcaagcuccuccucaucguccaggcccuccgcgacaaccucgagcccggcaccuucgaccucggcggccucuacgaggccaucgaggagugccucaucaacgaccccuggguccuccucaacgccuccugguucaacuccuuccucacccacgcccuccgc

SEQ ID NO: 20809 - RNA, 2148 nt, Artificial Sequence; identical to SEQ ID NO: 20808
  derived and/or modified sequence opt2 from anti-influenza_Chain

SEQ ID NO: 20810 - RNA, 2256 nt, Artificial Sequence
  derived and/or modified sequence opt2 from anti-influenza_Chain
augaacaucaaccccuacuuccucuucaucgacguccccauccaggccgccaucuccaccaccuuccccuacaccggcgucccccccuacucccacggcaccggcaccggcuacaccaucgacaccgucauccgcacccacgaguacuccaacaagggcaagcaguacaucuccgacgucaccggcugcgucauggucgaccccaccaacggcccccuccccgaggacaacgagcccuccgccuacgcccagcucgacugcguccucgaggcccucgaccgcauggacgaggagcaccccggccucuuccaggccggcucccagaacgccauggaggcccucauggucaccaccgucgacaagcucacccagggccgccagaccuucgacuggaccgucugccgcaaccagcccgccgccaccgcccucaacaccaccaucaccuccuuccgccucaacgaccucaacggcgccgacaagggcggccucguccccuucugccaggacaucaucgacucccucgacaagcccgagaugaucuucuucaccgucaagaacaucaagaagaagcuccccgccaagaaccgcaagggcuuccucaucaagcgcauccccaugaaggucaaggaccgcaucacccgcgucgaguacaucaagcgcgcccucucccucaacaccaugaccaaggacgccgagcgcggcaagcucaagcgccgcgccaucgccaccgccggcauccagauccgcggcuucguccucgucgucgagaaccucgccaagaacaucugcgagaaccucgagcaguccggccuccccgucggcggcaacgagaagaaggccaagcucuccaacgccgucgccaagaugcucuccaacugcccccccggcggcaucuccaugaccgucaccggcgacaacaccaaguggaacgagugccucaacccccgcaucuuccucgccaugaccgagcgcaucacccgcgacucccccaucugguuccgcgacuucugcuccaucgcccccguccucuucuccaacaagaucgcccgccucggcaagggcuucaugaucaccuccaagaccaagcgccucaaggcccagauccccugccccgaccucuucaacaucccccucgagcgcuacaacgaggagacccgcgccaagcucaagaagcucaagcccuucuucaacgaggagggcaccgccucccucucccccggcaugaugaugggcauguucaacaugcucuccaccguccucggcgucgccgcccucggcaucaagaacaucggcaacaaggaguaccucugggacggccuccaguccuccgacgacuucgcccucuucgucaacgccaaggacgaggagaccugcauggagggcaucaacgacuucuaccgcaccugcaagcuccucggcaucaacauguccaagaagaaguccuacugcaacgagaccggcauguucgaguucaccuccauguucuaccgcgacggcuucgucuccaacuucgccauggagcuccccuccuucggcgucgccggcgucaacgaguccgccgacauggccaucggcaugaccaucaucaagaacaacaugaucaacaacggcaugggccccgccaccgcccagaccgccauccagcucuucaucgccgacuaccgcuacaccuacaagugccaccgcggcgacuccaaggucgagggcaagcgcaugaagaucaucaaggagcucugggagaacaccaagggccgcgacggccuccucgucgccgacggcggccccaaccucuacaaccuccgcaaccuccacauccccgagaucauccucaaguacaacaucauggaccccgaguacaagggccgccuccuccacccccagaaccccuucgucggccaccucuccaucgagggcaucaaggaggccgacaucacccccgcccacggccccaucaagaagauggacuacgacgccgucuccggcacccacuccuggcgcaccaagcgcaaccgcuccauccucaacaccgaccagcgcaacaugauccucgaggagcagugcuacgccaagugcugcaaccucuucgaggccugcuucaacuccgccuccuaccgcaagcccgucggccagcacuccaugcucgaggccauggcccaccgccuccgcauggacgcccgccucgacuacgaguccggccgcauguccaaggaggacuucgagaaggccauggcccaccucggcgagaucggcuacaug

SEQ ID NO: 20811 - RNA, 2256 nt, Artificial Sequence; identical to SEQ ID NO: 20810
  derived and/or modified sequence opt2 from anti-influenza_Chain

SEQ ID NO: 20812 - RNA, 2265 nt, Artificial Sequence
  derived and/or modified sequence opt2 from anti-influenza_Chain
auggccgucgacaucaagaagaucaucaagcagaugacccucgaggagaaggccggccucugcuccggccucgacuucuggcacaccaagcccgucgagcgccucggcauccccuccaucaugaugaccgacggcccccacggccuccgcaagcagcgcgaggacgccgagaucgccgacaucaacaacuccguccccgccaccugcuuccccuccgccgccggccucgccugcuccugggaccgcgagcucgucgagcgcgucggcgccgcccucggcgaggagugccaggccgagaacgucuccauccuccucggccccggcgccaacaucaagcgcuccccccucugcggccgcaacuucgaguacuucuccgaggaccccuaccucuccuccgagcucgccgccucccacaucaagggcguccagucccagggcgucggcgccugccucaagcacuucgccgccaacaaccaggagcaccgccgcaugaccgucgacaccaucgucgacgagcgcacccuccgcgagaucuacuucgccuccuucgagaacgccgucaagaaggcccgccccugggucgucaugugcgccuacaacaagcucaacggcgaguacugcuccgagaaccgcuaccuccucaccgagguccucaagaacgaguggaugcacgacggcuucgucgucuccgacuggggcgccgucaacgaccgcgucuccggccucgacgccggccucgaccucgagaugcccaccucccacggcaucaccgacaagaagaucgucgaggccgucaaguccggcaagcucuccgagaacauccucaaccgcgccgucgagcgcauccucaaggucaucuucauggcccucgagaacaagaaggagaacgcccaguacgacaaggacgcccaccaccgccucgcccgccaggccgccgccgaguccaugguccuccucaagaacgaggacgacguccucccccucaagaaguccggcaccaucgcccucaucggcgccuucgucaagaagccccgcuaccagggcuccggcuccucccacaucacccccacccgccucgacgacaucuacgaggagaucaagaaggccggcggcgacaaggucaaccucgucuacuccgagggcuaccgccucgagaacgacggcaucgacgaggagcucaucaacgaggccaagaaggccgccuccuccuccgacgucgccgucgucuucgccggccuccccgacgaguacgaguccgagggcuucgaccgcacccacauguccauccccgagaaccagaaccgccucaucgaggccgucgccgagguccaguccaacaucgucgucguccuccucaacggcucccccgucgagaugcccuggaucgacaaggucaaguccguccucgaggccuaccucggcggccaggcccucggcggcgcccucgccgacguccucuucggcgaggucaaccccuccggcaagcucgccgagaccuuccccgucaagcucucccacaaccccuccuaccucaacuuccccggcgaggacgaccgcgucgaguacaaggagggccucuucgucggcuaccgcuacuacgacaccaagggcaucgagccccucuuccccuucggccacggccucuccuacaccaaguucgaguacuccgacaucuccgucgacaagaaggacgucuccgacaacuccaucaucaacgucuccgucaaggucaagaacgucggcaagauggccggcaaggagaucguccagcucuacgucaaggacgucaaguccuccguccgccgccccgagaaggagcucaagggcuucgagaaggucuuccucaaccccggcgaggagaagaccgucaccuucacccucgacaagcgcgccuucgccuacuacaacacccagaucaaggacuggcacgucgaguccggcgaguuccucauccucaucggccgcuccucccgcgacaucguccucaaggaguccguccgcgucaacuccaccgucaagauccgcaagcgcuucaccgucaacuccgccgucgaggacgucauguccgacuccuccgccgccgccguccucggccccguccucaaggagaucaccgacgcccuccagaucgacauggacaacgcccacgacaugauggccgccaacaucaagaacaugccccuccgcucccucgucggcuacucccagggccgccucuccgaggagaugcucgaggagcucgucgacaagaucaacaacgucgag

SEQ ID NO: 20813 - RNA, 2265 nt, Artificial Sequence; identical to SEQ ID NO: 20812
  derived and/or modified sequence opt2 from anti-influenza_Chain

SEQ ID NO: 20814 - RNA, 2277 nt, Artificial Sequence
  derived and/or modified sequence opt2 from anti-influenza_Chain
auggagcgcaucaaggagcuccgcaaccucaugucccagucccgcacccgcgagauccucaccaagaccaccgucgaccacauggccaucaucaagaaguacaccuccggccgccaggagaagaaccccgcccuccgcaugaaguggaugauggccaugaaguaccccaucaccgccgacaagcgcaucaccgagaugauccccgagcgcaacgagcagggccagacccucugguccaagaugaacgacgccggcuccgaccgcgucauggucuccccccucgccgucaccugguggaaccgcaacggccccaugaccaacaccguccacuaccccaagaucuacaagaccuacuucgagcgcgucgagcgccucaagcacggcaccuucggccccguccacuuccgcaaccaggucaagauccgccgccgcgucgacaucaaccccggccacgccgaccucuccgccaaggaggcccaggacgucaucauggaggucgucuuccccaacgaggucggcgcccgcauccucaccuccgagucccagcucaccaucaccaaggagaagaaggaggagcuccaggacugcaagaucuccccccucauggucgccuacaugcucgagcgcgagcucguccgcaagacccgcuuccuccccgucgccggcggcaccuccuccgucuacaucgagguccuccaccucacccagggcaccugcugggagcagauguacacccccggcggcgaggucaagaacgacgacgucgaccagucccucaucaucgccgcccgcaacaucguccgccgcgccgccgucuccgccgacccccucgccucccuccucgagaugugccacuccacccagaucggcggcauccgcauggucgacauccucaagcagaaccccaccgaggagcaggccgucggcaucugcaaggccgccaugggccuccgcaucuccuccuccuucuccuucggcggcuucaccuucaagcgcaccuccggcuccuccgucaagcgcgaggaggagguccucaccggcaaccuccagacccucaagauccgcguccacgagggcuacgaggaguucaccauggucggccgccgcgccaccgccauccuccgcaaggccacccgccgccucauccagcucaucgucuccggccgcgacgagcaguccaucgccgaggccaucaucgucgccauggucuucucccaggaggacugcaugaucaaggccguccgcggcgaccucaacuucgucaaccgcgccaaccagcgccucaaccccaugcaccagcuccuccgccacuuccagaaggacgccaagguccucuuccagaacuggggcgucgagcccaucgacaacgucaugggcaugaucggcauccuccccgacaugacccccuccaucgagauguccaugcgcggcguccgcaucuccaagaugggcgucgacgaguacuccuccaccgagcgcgucgucgucuccaucgaccgcuuccuccgcguccgcgaccagcgcggcaacguccuccucucccccgaggaggucuccgagacccagggcaccgagaagcucaccaucaccuacuccuccuccaugaugugggagaucaacggccccgaguccguccucgucaacaccuaccaguggaucauccgcaacugggagaccgucaagauccaguggucccagaaccccaccaugcucuacaacaagauggaguucgagcccuuccagucccucguccccaaggccauccgcggccaguacuccggcuucguccgcacccucuuccagcagaugcgcgacguccucggcaccuucgacaccgcccagaucaucaagcuccuccccuucgccgccgccccccccaagcagucccgcaugcaguucuccuccuucaccgucaacguccgcggcuccggcaugcgcauccucguccgcggcaacucccccgucuucaacuacaacaaggccaccaagcgccucaccguccucggcaaggacgccggcacccucaccgaggaccccgacgagggcaccgccggcgucgaguccgccguccuccgcggcuuccucauccucggcaaggaggaccgccgcuacggccccgcccucuccaucaacgagcucuccaaccucgccaagggcgagaaggccaacguccucaucggccagggcgacgucguccucgucaugaagcgcaagcgcgacuccuccauccucaccgacucccagaccgccaccaagcgcauccgcauggccaucaac

SEQ ID NO: 20815 - RNA, 2277 nt, Artificial Sequence; identical to SEQ ID NO: 20814
  derived and/or modified sequence opt2 from anti-influenza_Chain

SEQ ID NO: 20816 - RNA, 2472 nt, Artificial Sequence
  derived and/or modified sequence opt2 from anti-influenza_Chain
augaugcuccgcaagaagaccaagcagcucaucuccuccauccucauccucguccuccuccucucccucuuccccgccgcccucgccgccgagggcaacacccgcgaggacaacuucaagcaccuccucggcaacgacaacgucaagcgccccuccgaggccggcgcccuccagcuccaggaggucgacggccagaugacccucgucgaccagcacggcgagaagauccagcuccgcggcauguccacccacggccuccagugguuccccgagauccucaacgacaacgccuacaaggcccucuccaacgacugggacuccaacaugauccgccucgccauguacgucggcgagaacggcuacgccaccaaccccgagcucaucaagcagcgcgucaucgacggcaucgagcucgccaucgagaacgacauguacgucaucgucgacuggcacguccacgcccccggcgacccccgcgaccccgucuacgccggcgccaaggacuucuuccgcgagaucgccgcccucuaccccaacaacccccacaucaucuacgagcucgccaacgagcccuccuccaacaacaacggcggcgccggcauccccaacaacgaggagggcuggaaggccgucaaggaguacgccgaccccaucgucgagaugcuccgcaaguccggcaacgccgacgacaacaucaucaucgucggcucccccaacuggucccagcgccccgaccucgccgccgacaaccccaucgacgaccaccacaccauguacaccguccacuucuacaccggcucccacgccgccuccaccgaguccuaccccuccgagacccccaacuccgagcgcggcaacgucauguccaacacccgcuacgcccucgagaacggcgucgccgucuucgccaccgaguggggcaccucccaggccuccggcgacggcggccccuacuucgacgaggccgacgucuggaucgaguuccucaacgagaacaacaucuccugggccaacuggucccucaccaacaagaacgaggucuccggcgccuucacccccuucgagcucggcaaguccaacgccaccaaccucgaccccggccccgaccacgucugggcccccgaggagcucucccucuccggcgaguacguccgcgcccgcaucaagggcgucaacuacgagcccaucgaccgcaccaaguacaccaagguccucugggacuucaacgacggcaccaagcagggcuucggcgucaacuccgacucccccaacaaggagcucaucgccgucgacaacgagaacaacacccucaaggucuccggccucgacgucuccaacgacgucuccgacggcaacuucugggccaacgcccgccucuccgccaacggcuggggcaaguccgucgacauccucggcgccgagaagcucaccauggacgucaucgucgacgagcccaccaccgucgccaucgccgccaucccccaguccuccaaguccggcugggccaaccccgagcgcgccguccgcgucaacgccgaggacuucguccagcagaccgacggcaaguacaaggccggccucaccaucaccggcgaggacgcccccaaccucaagaacaucgccuuccacgaggaggacaacaacaugaacaacaucauccucuucgucggcaccgacgccgccgacgucaucuaccucgacaacaucaaggucaucggcaccgaggucgagauccccgucguccacgaccccaagggcgaggccguccuccccuccgucuucgaggacggcacccgccagggcugggacugggccggcgaguccggcgucaagaccgcccucaccaucgaggaggccaacggcuccaacgcccucuccugggaguucggcuaccccgaggucaagcccuccgacaacugggccaccgccccccgccucgacuucuggaaguccgaccucguccgcggcgagaacgacuacgucgccuucgacuucuaccucgaccccguccgcgccaccgagggcgccaugaacaucaaccucgucuuccagccccccaccaacggcuacuggguccaggcccccaagaccuacaccaucaacuucgacgagcucgaggaggccaaccaggucaacggccucuaccacuacgaggucaagaucaacguccgcgacaucaccaacauccaggacgacacccuccuccgcaacaugaugaucaucuucgccgacgucgaguccgacuucgccggccgcgucuucgucgacaacguccgcuucgagggcgccgccaccaccgagcccgucgagcccgagcccgucgaccccggcgaggagaccccccccgucgacgagaaggaggccaagaaggagcagaaggaggccgagaaggaggagaaggaggccgucaaggaggagaagaaggaggccaaggaggagaagaaggccgucaagaacgaggccaagaagaag

SEQ ID NO: 20817 - RNA, 2472 nt, Artificial Sequence; identical to SEQ ID NO: 20816
  derived and/or modified sequence opt2 from anti-influenza_Chain

SEQ ID NO: 20818 - RNA, 3063 nt, Artificial Sequence
  derived and/or modified sequence opt2 from anti-influenza_Chain
auggccggcccccaccgcucccgcgccgccggccccccccccuucgccgucgacgagcacgucgcccucgagauggucgccuuccgcggcgaggucuucgccggccacggccuccucgccgaccagcgccucaucgcccacaccggccgccccgcccucaacgcccagcgcaucacccagcagaagcagcgcgaccagugccgcggccagcgccaccgccaccaccagggcggccgcaaccuccgcaaggcccaccgcaccuuccacgagcaccaguccacccaggaccaggcccacgacgccccccacggccagcaggccaagaccggccacgagggccucggccacgagcacgcccaggcccagcaccagcagggccaguccaacgucgucgaccgccaggacggcgagcccgucgaggcccagcaccagaaggacggcgcccagcgcgccggcaacgcccccgccggccgcgucgagcucgagcagcagcccgucgaggcccagcaccagcagcaggagggcgacguccgcaucggcaagcgccgccagaacgccuucgccccccccgcccucgaccacguccacggcggccccggccgccuccagcgccacggccucgccgucgagcgccacguccccgccguccagcagcaccagcagcgcguccagcgcggccgccagcagaucgaccacguccucggccacggccuccccggccgccagcgccucgccuuccgcgacggcccccgccgccccgucggcgucgccucccccguccucggccagcgccccugccccggccaccgcaucguccagaaccucuuccgccacggcaucgaccccugccgcgucggccgcugccgccgcucccccuccgagcuccacggcaugggcugcgccgacguccgcgcccgcggccacggccgccacaugcgcggccagcgcgacgagcaccccggccgcggccgccccugcgcccgccgccgccacgucgacgacgaccgcgaccgcaccccccaggagaagcucuacgacgucgcccgcggccucgacgagcccgcccgccgcguccacuucgacgacgaggccgaccgcuccgucuuccgcggccucgcccagcccgcccccgacgagcccgagggccgccgccgcgaccgccucguccuccagcgccaguccgucaaccaccgccgcggccgccucucccgccaccgccagcagcaccagccccagcagcagcgcccccacggcaaccaggccuuccucggcaaguacgagaagcgccgccgcaagcccaccgccugccucaagucccuccgccgcuuccccgacaaggacgcccccguccucuacuucgucaaccagcucgagaagaccaagcgccgcaugacccuccuccucgucuggcucaucuucaccggcgucgccggcgagauccgccucgaggccgaggacggcgagcuccucggcgucgccgucgacuccacccucaccggcuacuccggccgcggcuacgucaccggcuucgacgcccccgaggacuccguccgcuucuccuucgaggccccccgcggcgucuaccgcgucgucuucggcgucuccuucuccucccgcuucgccuccuacgcccuccgcgucgacgacuggcaccagaccggcucccucaucaagcgcggcggcggcuucuucgaggccuccaucggcgagaucuggcucgacgagggcgcccacaccauggccuuccagcucaugaacggcgcccucgacuacguccgccucgagcccgucuccuacggcccccccgcccgcccccccgcccagcucuccgacucccaggccaccgccuccgcccaggcccucuucgccuuccuccucuccgaguacggccgccacauccucgccggccagcagcagaaccccuaccgccgcgacuucgacgccaucaacuacguccgcaacgucaccggcaaggagcccgcccucgucuccuucgaccucaucgacuacucccccacccgcgaggcccacggcgucguccacuaccagacccccgaggacuggaucgccugggccggccgcgacggcaucgucucccucauguggcacuggaacgcccccaccgaccucaucgaggaccccucccaggacugcuacuggugguacggcuucuacacccgcugcaccaccuucgacgucgccgccgcccucgccgacaccuccuccgagcgcuaccgccuccuccuccgcgacaucgacgucaucgccgcccagcuccagaaguuccagcaggccgacauccccguccucuggcgcccccuccacgaggccgccggcggcugguucugguggggcgccaagggccccgagcccuucaagcagcucuggcgccuccucuacgagcgccucguccaccaccacggccuccacaaccucaucugggucuacacccacgagcccggcgccgccgagugguaccccggcgacgccuacgucgacaucgucggccgcgacgucuacgccgacgaccccgacgcccucaugcgcuccgacuggaacgagcuccagacccucuucggcggccgcaagcucgucgcccucaccgagaccggcacccuccccgacgucgaggucaucaccgacuacggcaucuggugguccugguucuccaucuggaccgaccccuuccuccgcgacgucgaccccgaccgccucacccgcgucuaccacuccgagcgcguccucacccgcgacgagcuccccgacuggcgcuccuacguccuccacgccaccaccguccagcccgccggcgaccucgcccucgccgucuaccccaaccccggcgccggccgccuccacgucgaggucggccuccccgucgccgcccccgucgucgucgaggucuucaaccuccucggccagcgcgucuuccaguaccaggccggcaugcagcccgccggccucuggcgccgcgccuucgagcucgcccucgcccccggcgucuaccucguccagguccgcgccggcaaccucgucgcccgccgccgcugggucuccguccgc

SEQ ID NO: 20819 - RNA, 3063 nt, Artificial Sequence; identical to SEQ ID NO: 20818
  derived and/or modified sequence opt2 from anti-influenza_Chain

SEQ ID NO: 20820 - RNA, 3165 nt, Artificial Sequence
  derived and/or modified sequence opt2 from anti-influenza_Chain
augcgcaagaagcgccgcggcuuccucaacgccuccaccgccguccucgucggcauccucgccggcuuccucggcgucguccucgccgccaccggcgcccucggcuucgccguccgcgagucccuccuccucaagcaguuccucuuccucuccuucgagggcaacaccgacggcgccucccccuucggcaaggacgucgucgucaccgccucccaggacgucgccgccgacggcgaguacucccucaaggucgagaaccgcaccuccgucugggacggcgucgagaucgaccucaccggcaaggucaacaccggcaccgacuaccuccucuccuuccacgucuaccagaccuccgacuccccccagcucuucuccguccucgcccgcaccgaggacgagaagggcgagcgcuacaagauccucgccgacaaggucgucguccccaacuacuggaaggagauccucguccccuucucccccaccuucgagggcacccccgccaaguucucccucaucaucaccucccccaagaagaccgacuucgucuucuacgucgacaacguccagguccucacccccaaggaggccggccccaaggucgucuacgagaccuccuucgagaagggcaucggcgacuggcagccccgcggcuccgacgucaagaucuccaucucccccaaggucgcccacuccggcaagaagucccucuucgucuccaaccgccagaagggcuggcacggcgcccagaucucccucaagggcauccucaagaccggcaagaccuacgccuucgaggccugggucuaccaggaguccggccaggaccagaccaucaucaugaccaugcagcgcaaguacuccuccgacuccuccaccaaguacgaguggaucaaggccgccaccguccccuccggccaguggguccagcucuccggcaccuacaccauccccgccggcgucaccgucgaggaccucacccucuacuucgagucccagaaccccacccucgaguucuacgucgacgacgucaaggucgucgacaccaccuccgccgagaucaagcucgagaugaaccccgaggaggagauccccgcccucaaggacguccucaaggacuacuuccgcgucggcgucgcccuccccuccaaggucuucaucaaccagaaggacaucgcccucaucuccaagcacuccaacuccuccaccgccgagaacgagaugaagcccgacucccuccucgccggcaucgagaacggcaagcucaaguuccgcuucgagaccgccgacaaguacaucgaguucgcccagcagaacggcauggucguccgcggccacacccucgucuggcacaaccagacccccgagugguucuucaaggacgagaacggcaaccuccucuccaaggaggagaugaccgagcgccuccgcgaguacauccacaccgucgucggccacuucaagggcaaggucuacgccugggacgucgucaacgaggccgucgaccccaaccagcccgacggccuccgccgcuccaccugguaccagaucaugggccccgacuacaucgagcucgccuucaaguucgcccgcgaggccgaccccaacgccaagcucuucuacaacgacuacaacaccuucgagcccaagaagcgcgacaucaucuacaaccucgucaagucccucaaggagaagggccucaucgacggcaucggcaugcagugccacaucucccucgccaccgacauccgccagaucgaggaggccaucaagaaguucuccaccauccccggcaucgagauccacaucaccgagcucgacaucuccgucuaccgcgacuccaccuccaacuacuccgaggccccccgcaccgcccucaucgagcaggcccacaagauggcccagcucuucaagaucuucaagaaguacuccaacgucaucaccaacgucaccuucuggggccucaaggacgacuacuccuggcgcgccacccgccgcaacgacuggccccucaucuucgacaaggacuaccaggccaagcucgccuacugggccaucgucgcccccgagguccuccccccccuccccaaggaguccaagaucuccgagggcgaggccgucgucgucggcaugauggacgacuccuacaugauguccaagcccaucgagaucuacgacgaggagggcaacgucaaggccaccauccgcgccaucuggaaggacuccaccaucuacgucuacggcgagguccaggacgccaccaagaagcccgccgaggacggcgucgccaucuucaucaaccccaacaacgagcgcacccccuaccuccagcccgacgacaccuacgucguccucuggaccaacuggaaguccgaggucaaccgcgaggacgucgaggucaagaaguucgucggccccggcuuccgccgcuacuccuucgagauguccaucaccauccccggcgucgaguucaagaaggacuccuacaucggcuucgacgucgccgucaucgacgacggcaagugguacuccugguccgacaccaccaacucccagaagaccaacaccaugaacuacggcacccucaagcucgagggcgucauggucgccaccgccaaguacggcacccccgucaucgacggcgagaucgacgacaucuggaacaccaccgaggagaucgagaccaaguccgucgccaugggcucccucgagaagaacgccaccgccaagguccgcguccucugggacgaggagaaccucuacguccucgccaucgucaaggaccccguccucaacaaggacaacuccaaccccugggagcaggacuccgucgagaucuucaucgacgagaacaaccacaagaccggcuacuacgaggacgacgacgcccaguuccgcgucaacuacaugaacgagcaguccuucggcaccggcgccuccgccgcccgcuucaagaccgccgucaagcucaucgagggcggcuacaucgucgaggccgccaucaaguggaagaccaucaagcccucccccaacaccgucaucggcuucaacguccaggucaacgacgccaacgagaagggccagcgcgucggcaucaucuccugguccgaccccaccaacaacuccuggcgcgaccccuccaaguucggcaaccuccgccucaucaag

SEQ ID NO: 20821 - RNA, 3165 nt, Artificial Sequence; identical to SEQ ID NO: 20820
  derived and/or modified sequence opt2 from anti-influenza_Chain

SEQ ID NO: 20822 - RNA, 3177 nt, Artificial Sequence
  derived and/or modified sequence opt2 from anti-influenza_Chain
augcagguccgcaagcgccgcggccuccucgacgucuccaccgccguccucgucggcauccucgccggcuuccucggcgucguccucgccgccuccggcguccucuccuucggcaaggaggccuccuccaagggcgacuccucccucgagaccguccucgcccucuccuucgagggcaccaccgagggcgucguccccuucggcaaggacgucguccucaccgccucccaggacgucgccgccgacggcgaguacucccucaaggucgagaaccgcaccucccccugggacggcgucgagaucgaccucaccggcaaggucaaguccggcgccgacuaccuccucuccuuccaggucuaccaguccuccgacgccccccagcucuucaacgucgucgcccgcaccgaggacgagaagggcgagcgcuacgacgucauccucgacaaggucgucgucuccgaccacuggaaggagauccucguccccuucucccccaccuucgagggcacccccgccaaguacucccucaucaucgucgccuccaagaacaccaacuucaacuucuaccucgacaagguccagguccucgcccccaaggaguccggccccaaggucaucuacgagaccuccuucgagaacggcgucggcgacuggcagccccgcggcgacgucaacaucgaggccuccuccgaggucgcccacuccggcaaguccucccucuucaucuccaaccgccagaagggcuggcagggcgcccagaucaaccucaagggcauccucaagaccggcaagaccuacgccuucgaggccugggucuaccagaacuccggccaggaccagaccaucaucaugaccaugcagcgcaaguacuccuccgacgccuccacccaguacgaguggaucaaguccgccaccguccccuccggccaguggguccagcucuccggcaccuacaccauccccgccggcgucaccgucgaggaccucacccucuacuucgagucccagaaccccacccucgaguucuacgucgacgacgucaagaucgucgacaccaccuccgccgagaucaagaucgagauggagcccgagaaggagauccccgcccucaaggagguccucaaggacuacuucaaggucggcgucgcccuccccuccaaggucuuccucaaccccaaggacaucgagcucaucaccaagcacuucaacuccaucaccgccgagaacgagaugaagcccgagucccuccucgccggcaucgagaacggcaagcucaaguuccgcuucgagaccgccgacaaguacauccaguucgucgaggagaacggcauggucauccgcggccacacccucgucuggcacaaccagacccccgacugguucuucaaggacgagaacggcaaccuccucuccaaggaggccaugaccgagcgccucaaggaguacauccacaccgucgucggccacuucaagggcaaggucuacgccugggacgucgucaacgaggccgucgaccccaaccagcccgacggccuccgccgcuccaccugguaccagaucaugggccccgacuacaucgagcucgccuucaaguucgcccgcgaggccgaccccgacgccaagcucuucuacaacgacuacaacaccuucgagccccgcaagcgcgacaucaucuacaaccucgucaaggaccucaaggagaagggccucaucgacggcaucggcaugcagugccacaucucccucgccaccgacaucaagcagaucgaggaggccaucaagaaguucuccaccauccccggcaucgagauccacaucaccgagcucgacauguccgucuaccgcgacuccuccuccaacuaccccgaggccccccgcaccgcccucaucgagcaggcccacaagaugaugcagcucuucgagaucuucaagaaguacuccaacgucaucaccaacgucaccuucuggggccucaaggacgacuacuccuggcgcgccacccgccgcaacgacuggccccucaucuucgacaaggaccaccaggccaagcucgccuacugggccaucgucgcccccgagguccuccccccccuccccaaggagucccgcaucuccgagggcgaggccgucgucgucggcaugauggacgacuccuaccucauguccaagcccaucgagauccucgacgaggagggcaacgucaaggccaccauccgcgccgucuggaaggacuccaccaucuacaucuacggcgagguccaggacaagaccaagaagcccgccgaggacggcgucgccaucuucaucaaccccaacaacgagcgcacccccuaccuccagcccgacgacaccuacgccguccucuggaccaacuggaagaccgaggucaaccgcgaggacguccaggucaagaaguucgucggccccggcuuccgccgcuacuccuucgagauguccaucaccauccccggcgucgaguucaagaaggacuccuacaucggcuucgacgccgccgucaucgacgacggcaagugguacuccugguccgacaccaccaacucccagaagaccaacaccaugaacuacggcacccucaagcucgagggcaucauggucgccaccgccaaguacggcacccccgucaucgacggcgagaucgacgagaucuggaacaccaccgaggagaucgagaccaaggccgucgccaugggcucccucgacaagaacgccaccgccaagguccgcguccucugggacgagaacuaccucuacguccucgccaucgucaaggaccccguccucaacaaggacaacuccaaccccugggagcaggacuccgucgagaucuucaucgacgagaacaaccacaagaccggcuacuacgaggacgacgacgcccaguuccgcgucaacuacaugaacgagcagaccuucggcaccggcggcucccccgcccgcuucaagaccgccgucaagcucaucgagggcggcuacaucgucgaggccgccaucaaguggaagaccaucaagcccacccccaacaccgucaucggcuucaacauccaggucaacgacgccaacgagaagggccagcgcgucggcaucaucuccugguccgaccccaccaacaacuccuggcgcgaccccuccaaguucggcaaccuccgccucaucaag

SEQ ID NO: 20823 - RNA, 3177 nt, Artificial Sequence; identical to SEQ ID NO: 20822
  derived and/or modified sequence opt2 from anti-influenza_Chain

SEQ ID NO: 20824 - RNA, 318 nt, Artificial Sequence
  derived and/or modified sequence opt2 from anti-OX40_LightChain
gagaucgucgucacccagucccccgccacccucucccucucccccggcgagcgcgccacccucuccugccgcgccucccaguccgucuccuccuaccucgccugguaccagcagaagcccggccaggccccccgccuccucaucuacgacgccuccaaccgcgccaccggcauccccgcccgcuucuccggcuccggcuccggcaccgacuucacccucaccaucuccucccucgagcccgaggacuucgccgucuacuacugccagcagcgcuccaacuggcccaccuucggccagggcaccaaggucgagaucaag

SEQ ID NO: 20825 - RNA, 321 nt, Artificial Sequence
  derived and/or modified sequence opt2 from anti-OX40_LightChain
gacauccagaugacccagucccccuccucccucuccgccuccgucggcgaccgcgucaccaucaccugccgcgccucccagggcaucuccuccuggcucgccugguaccagcagaagcccgagaaggcccccaagucccucaucuacgccgccuccucccuccaguccggcguccccucccgcuucuccggcuccggcuccggcaccgacuucacccucaccaucuccucccuccagcccgaggacuucgccaccuacuacugccagcaguacaacuccuacccccccaccuucggcggcggcaccaaggucgagaucaag

SEQ ID NO: 20826 - RNA, 321 nt, Artificial Sequence
  derived and/or modified sequence opt2 from anti-OX40_LightChain
gacauccagaugacccagucccccuccucccucuccgccuccgucggcgaccgcgucaccaucaccugccgcgccucccaggacaucuccaacuaccucaacugguaccagcagaagcccggcaaggcccccaagcuccucaucuacuacaccucccgccuccgcuccggcguccccucccgcuucuccggcuccggcuccggcaccgacuucacccucaccaucuccucccuccagcccgaggacuucgccaccuacuacugccagcagggccacacccucccccccaccuucggccagggcaccaaggucgagaucaag

SEQ ID NO: 20827 - RNA, 321 nt, Artificial Sequence
  derived and/or modified sequence opt2 from anti-OX40_LightChain
gacauccagaugacccagucccccuccucccucuccgccuccgucggcgaccgcgucaccaucaccugccgcgccucccaggacaucuccaacuaccucaacugguaccagcagaagcccggcaagaccgucaagcuccucaucuacuacaccucccgccuccgcuccggcguccccucccgcuucuccggcuccggcuccggcaccgacuucacccucaccaucuccucccuccagcccgaggacuucgccaccuacuacugccagcagggccacacccucccccccaccuucggccagggcaccaaggucgagaucaag

SEQ ID NO: 20828 - RNA, 321 nt, Artificial Sequence
  derived and/or modified sequence opt2 from anti-OX40_LightChain
gacauccagaugacccagucccccuccucccucuccgccuccgucggcgaccgcgucaccaucaccugccgcgccucccaggacaucuccaacuaccucaacugguaccagcagaagcccggcaagaccgucaagcuccucaucuacuacaccucccgccuccgcuccggcguccccucccgcuucuccggcuccggcuccggcaaggacuacacccucaccaucuccucccuccagcccgaggacuucgccaccuacuucugccagcagggccacacccucccccccaccuucggccagggcaccaaggucgagaucaag

SEQ ID NO: 20829 - RNA, 321 nt, Artificial Sequence
  derived and/or modified sequence opt2 from anti-OX40_LightChain
gacauccagaugacccagucccccuccucccucuccgccuccgucggcgaccgcgucaccaucaccugccgcgccucccaggacaucuccaacuaccucaacugguaccagcagaagcccggcaaggcccccaagcuccucaucuacuacaccucccgccuccgcuccggcguccccucccgcuucuccggcuccggcuccggcaccgacuucacccucaccaucuccucccuccagcccgaggacuucgccaccuacuacugccagcagggccacacccuccccgccaccuucggccagggcaccaaggucgagaucaag

SEQ ID NO: 20830 - RNA, 321 nt, Artificial Sequence
  derived and/or modified sequence opt2 from anti-OX40_LightChain
gacauccagaugacccagucccccuccucccucuccgccuccgucggcgaccgcgucaccaucaccugccgcgccucccaggacaucuccaacuaccucaacugguaccagcagaagcccggcaaggcccccaagcuccucaucuacuacaccucccgccuccgcuccggcguccccucccgcuucuccggcuccggcuccggcaccgacuucacccucaccaucuccucccuccagcccgaggacuucgccaccuacuacugccagcagggccacaccgccccccccaccuucggccagggcaccaaggucgagaucaag

SEQ ID NO: 20831 - RNA, 321 nt, Artificial Sequence
  derived and/or modified sequence opt2 from anti-OX40_LightChain
gacauccagaugacccagucccccuccucccucuccgccuccgucggcgaccgcgucaccaucaccugccgcgccucccaggacaucuccaacuaccucaacugguaccagcagaagcccggcaaggcccccaagcuccucaucuacuacaccucccgccuccgcuccggcguccccucccgcuucuccggcuccggcuccggcaccgacuucacccucaccaucuccucccuccagcccgaggacuucgccaccuacuacugccagcagggcgccacccucccccccaccuucggccagggcaccaaggucgagaucaag

SEQ ID NO: 20832 - RNA, 321 nt, Artificial Sequence
  derived and/or modified sequence opt2 from anti-OX40_LightChain
gacauccagaugacccagucccccuccucccucuccgccuccgucggcgaccgcgucaccaucaccugccgcgccucccaggacaucuccaacuaccucaacugguaccagcagaagcccggcaaggcccccaagcuccucaucuacuacaccucccgccuccgcuccggcguccccucccgcuucuccggcuccggcuccggcaccgacuucacccucaccaucuccucccuccagcccgaggacuucgccaccuacuacugccagcagggccacgcccucccccccaccuucggccagggcaccaaggucgagaucaag

SEQ ID NO: 20833 - RNA, 321 nt, Artificial Sequence
  derived and/or modified sequence opt2 from anti-OX40_LightChain
gacauccagaugacccagucccccuccucccucuccgccuccgucggcgaccgcgucaccaucaccugccgcgccucccaggacaucuccaacuaccucaacugguaccagcagaagcccggcaaggcccccaagcuccucaucuacuacaccucccgccuccgcuccggcguccccucccgcuucuccggcuccggcuccggcaccgacuucacccucaccaucuccucccuccagcccgaggacuucgccaccuacuacugccagcaggcccacacccucccccccaccuucggccagggcaccaaggucgagaucaag

SEQ ID NO: 20834 - RNA, 321 nt, Artificial Sequence
  derived and/or modified sequence opt2 from anti-OX40_LightChain
gacauccagaugacccagucccccuccucccucuccgccuccgucggcgaccgcgucaccaucaccugccgcgccucccaggacaucuccaacuaccucaacugguaccagcagaagcccggcaaggcccccaagcuccucaucuacuacaccucccgccuccgcuccggcguccccucccgcuucuccggcuccggcuccggcaccgacuucacccucaccaucuccucccuccagcccgaggacuucgccaccuacuacugccagcagggccacacccucgcccccaccuucggccagggcaccaaggucgagaucaag

SEQ ID NO: 20835 - RNA, 321 nt, Artificial Sequence
  derived and/or modified sequence opt2 from anti-OX40_LightChain
gacauccagaugacccagucccccuccucccucuccgccuccgucggcgaccgcgucaccaucaccugccgcgccucccaggacaucuccaacuaccucaacugguaccagcagaagcccggcaaggcccccaagcuccucaucuacuacaccucccgccuccgcuccggcguccccucccgcuucuccggcuccggcuccggcaccgacuucacccucaccaucuccucccuccagcccgaggacuucgccaccuacuacugccaggccggccacacccucccccccaccuucggccagggcaccaaggucgagaucaag

SEQ ID NO: 20836 - RNA, 321 nt, Artificial Sequence
  derived and/or modified sequence opt2 from anti-OX40_LightChain
gacauccagaugacccagucccccuccucccucuccgccuccgucggcgaccgcgucaccaucaccugccgcgccucccaggacaucuccaacuaccucaacugguaccagcagaagcccggcaaggcccccaagcuccucaucuacuacaccuccaagcuccacuccggcguccccucccgcuucuccggcuccggcuccggcaccgacuacacccucaccaucuccucccuccagcccgaggacuucgccaccuacuacugccagcagggcuccgcccuccccuggaccuucggccagggcaccaaggucgagaucaag

SEQ ID NO: 20837 - RNA, 321 nt, Artificial Sequence
  derived and/or modified sequence opt2 from anti-OX40_LightChain
gacauccagaugacccagucccccuccucccucuccgccuccgucggcgaccgcgucaccaucaccugccgcgccucccaggacaucuccaacuaccucaacugguaccagcagaagcccggcaaggccgucaagcuccucaucuacuacaccuccaagcuccacuccggcguccccucccgcuucuccggcuccggcucccgcaccgacuacacccucaccaucuccucccuccagcccgaggacuucgccaccuacuacugccagcagggcuccgcccuccccuggaccuucggccagggcaccaaggucgagaucaag

SEQ ID NO: 20838 - RNA, 351 nt, Artificial Sequence
  derived and/or modified sequence opt2 from anti-OX40_HeavyChain
gagguccagcucguccaguccggcgccgaggucaagaagcccggcgccuccgucaaggucuccugcaaggccuccggcuacaccuucaccgacuccuacauguccuggguccgccaggcccccggccagggccucgaguggaucggcgacauguaccccgacaacggcgacuccuccuacaaccagaaguuccgcgagcgcgucaccaucacccgcgacaccuccaccuccaccgccuaccucgagcucuccucccuccgcuccgaggacaccgccgucuacuacugcguccucgccccccgcugguacuucuccgucuggggccagggcacccucgucaccgucuccucc

SEQ ID NO: 20839 - RNA, 351 nt, Artificial Sequence
  derived and/or modified sequence opt2 from anti-OX40_HeavyChain
gagguccagcucguccaguccggcgccgaggucaagaagcccggcgccuccgucaaggucuccugcaaggccuccggcuacaccuucaccgacuccuacauguccuggguccgccaggcccccggccagggccucgaguggaucggcgacauguaccccgacaacggcgacuccuccuacaaccagaaguuccgcgagcgcgucaccaucaccgucgacaccuccaccuccaccgccuaccucgagcucuccucccuccgcuccgaggacaccgccgucuacuacugcguccucgccccccgcugguacuucuccgucuggggccagggcacccucgucaccgucuccucc

SEQ ID NO: 20840 - RNA, 351 nt, Artificial Sequence
  derived and/or modified sequence opt2 from anti-OX40_HeavyChain
gagguccagcucguccaguccggcgccgaggucaagaagcccggcgccuccgucaaggucuccugcaaggccuccggcuacaccuucaccgacuccuacauguccuggguccgccaggcccccggccagggccucgaguggaucggcgacauguaccccgacaacggcgacuccuccuacaaccagaaguuccgcgagcgcgucacccucaccgucgacaccuccaccuccaccgccuaccucgagcucuccucccuccgcuccgaggacaccgccgucuacuacugcguccucgccccccgcugguacuucuccgucuggggccagggcacccucgucaccgucuccucc

SEQ ID NO: 20841 - RNA, 351 nt, Artificial Sequence
  derived and/or modified sequence opt2 from anti-OX40_HeavyChain
gagguccagcucguccaguccggcgccgaggucaagaagcccggcgccuccgucaaggucuccugcaaggccuccggcuacaccuucaccgacgccuacauguccuggguccgccaggcccccggccagggccucgaguggaucggcgacauguaccccgacaacggcgacuccuccuacaaccagaaguuccgcgagcgcgucaccaucacccgcgacaccuccaccuccaccgccuaccucgagcucuccucccuccgcuccgaggacaccgccgucuacuacugcguccucgccccccgcugguacuucuccgucuggggccagggcacccucgucaccgucuccucc

SEQ ID NO: 20842 - RNA, 351 nt, Artificial Sequence
  derived and/or modified sequence opt2 from anti-OX40_HeavyChain
gagguccagcucguccaguccggcgccgaggucaagaagcccggcgccuccgucaaggucuccugcaaggccuccggcuacaccuucaccgaguccuacauguccuggguccgccaggcccccggccagggccucgaguggaucggcgacauguaccccgacaacggcgacuccuccuacaaccagaaguuccgcgagcgcgucaccaucacccgcgacaccuccaccuccaccgccuaccucgagcucuccucccuccgcuccgaggacaccgccgucuacuacugcguccucgccccccgcugguacuucuccgucuggggccagggcacccucgucaccgucuccucc

SEQ ID NO: 20843 - RNA, 351 nt, Artificial Sequence
  derived and/or modified sequence opt2 from anti-OX40_HeavyChain
gagguccagcucguccaguccggcgccgaggucaagaagcccggcgccuccgucaaggucuccugcaaggccuccggcuacaccuucaccgacuccuacauguccuggguccgccaggcccccggccagggccucgaguggaucggcgacauguaccccgacaacgccgacuccuccuacaaccagaaguuccgcgagcgcgucaccaucacccgcgacaccuccaccuccaccgccuaccucgagcucuccucccuccgcuccgaggacaccgccgucuacuacugcguccucgccccccgcugguacuucuccgucuggggccagggcacccucgucaccgucuccucc

SEQ ID NO: 20844 - RNA, 351 nt, Artificial Sequence
  derived and/or modified sequence opt2 from anti-OX40_HeavyChain
gagguccagcucguccaguccggcgccgaggucaagaagcccggcgccuccgucaaggucuccugcaaggccuccggcuacaccuucaccgacuccuacauguccuggguccgccaggcccccggccagggccucgaguggaucggcgacauguaccccgacaacgccgacgccuccuacaaccagaaguuccgcgagcgcgucaccaucacccgcgacaccuccaccuccaccgccuaccucgagcucuccucccuccgcuccgaggacaccgccgucuacuacugcguccucgccccccgcugguacuucuccgucuggggccagggcacccucgucaccgucuccucc

SEQ ID NO: 20845 - RNA, 351 nt, Artificial Sequence
  derived and/or modified sequence opt2 from anti-OX40_HeavyChain
gagguccagcucguccaguccggcgccgaggucaagaagcccggcgccuccgucaaggucuccugcaaggccuccggcuacaccuucaccgacuccuacauguccuggguccgccaggcccccggccagggccucgaguggaucggcgacauguaccccgacaacggcgacgccuccuacaaccagaaguuccgcgagcgcgucaccaucacccgcgacaccuccaccuccaccgccuaccucgagcucuccucccuccgcuccgaggacaccgccgucuacuacugcguccucgccccccgcugguacuucuccgucuggggccagggcacccucgucaccgucuccucc

SEQ ID NO: 20846 - RNA, 351 nt, Artificial Sequence
  derived and/or modified sequence opt2 from anti-OX40_HeavyChain
gagguccagcucguccaguccggcgccgaggucaagaagcccggcgccuccgucaaggucuccugcaaggccuccggcuacaccuucaccgacuccuacauguccuggguccgccaggcccccggccagggccucgaguggaucggcgacauguaccccgacuccggcgacuccuccuacaaccagaaguuccgcgagcgcgucaccaucacccgcgacaccuccaccuccaccgccuaccucgagcucuccucccuccgcuccgaggacaccgccgucuacuacugcguccucgccccccgcugguacuucuccgucuggggccagggcacccucgucaccgucuccucc

SEQ ID NO: 20847 - RNA, 351 nt, Artificial Sequence
  derived and/or modified sequence opt2 from anti-OX40_HeavyChain
gagguccagcucguccaguccggcgccgaggucaagaagcccggcgccuccgucaaggucuccugcaaggccuccggcuacaccuucaccgacuccuacauguccuggguccgccaggcccccggccagggccucgaguggaucggcgacauguaccccgacaacggcuccuccuccuacaaccagaaguuccgcgagcgcgucaccaucacccgcgacaccuccaccuccaccgccuaccucgagcucuccucccuccgcuccgaggacaccgccgucuacuacugcguccucgccccccgcugguacuucuccgucuggggccagggcacccucgucaccgucuccucc

SEQ ID NO: 20848 - RNA, 351 nt, Artificial Sequence
  derived and/or modified sequence opt2 from anti-OX40_HeavyChain
gagguccagcucguccaguccggcgccgaggucaagaagcccggcgccuccgucaaggucuccugcaaggccuccggcuacaccuucaccgacgccuacauguccuggguccgccaggcccccggccagggccucgaguggaucggcgacauguaccccgacaacgccgacgccuccuacaaccagaaguuccgcgagcgcgucaccaucacccgcgacaccuccaccuccaccgccuaccucgagcucuccucccuccgcuccgaggacaccgccgucuacuacugcguccucgccccccgcugguacuucuccgucuggggccagggcacccucgucaccgucuccucc

SEQ ID NO: 20849 - RNA, 351 nt, Artificial Sequence
  derived and/or modified sequence opt2 from anti-OX40_HeavyChain
gagguccagcucguccaguccggcgccgaggucaagaagcccggcgccuccgucaaggucuccugcaaggccuccggcuacaccuucaccgacuccuacauguccuggguccgccaggcccccggccagggccucgaguggaucggcgacauguaccccgacaacggcgacuccuccuacaaccagaaguuccgcgagcgcgucaccaucacccgcgacaccuccaccuccaccgccuaccucgagcucuccucccuccgcuccgaggacaccgccgucuacuacugcguccucgccccccgcugguacuucuccgccuggggccagggcacccucgucaccgucuccucc

SEQ ID NO: 20850 - RNA, 351 nt, Artificial Sequence
  derived and/or modified sequence opt2 from anti-OX40_HeavyChain
gagguccagcucguccaguccggcgccgaggucaagaagcccggcgccuccgucaaggucuccugcaaggccuccggcuacaccuucaccgacuccuacauguccuggguccgccaggcccccggccagggccucgaguggaucggcgacauguaccccgacaacggcgacuccuccuacaaccagaaguuccgcgagcgcgucaccaucacccgcgacaccuccaccuccaccgccuaccucgagcucuccucccuccgcuccgaggacaccgccgucuacuacugcguccucgccccccgcugguacuucgccgucuggggccagggcacccucgucaccgucuccucc

SEQ ID NO: 20851 - RNA, 351 nt, Artificial Sequence
  derived and/or modified sequence opt2 from anti-OX40_HeavyChain
gagguccagcucguccaguccggcgccgaggucaagaagcccggcgccuccgucaaggucuccugcaaggccuccggcuacaccuucaccgacuccuacauguccuggguccgccaggcccccggccagggccucgaguggaucggcgacauguaccccgacaacggcgacuccuccuacaaccagaaguuccgcgagcgcgucaccaucacccgcgacaccuccaccuccaccgccuaccucgagcucuccucccuccgcuccgaggacaccgccgucuacuacugcgcccucgccccccgcugguacuucuccgucuggggccagggcacccucgucaccgucuccucc

SEQ ID NO: 20852 - RNA, 351 nt, Artificial Sequence
  derived and/or modified sequence opt2 from anti-OX40_HeavyChain
gagguccagcucguccaguccggcgccgaggucaagaagcccggcgccuccgucaaggucuccugcaaggccuccggcuacaccuucaccgacuccuacauguccuggguccgccaggcccccggccagggccucgaguggaucggcgacauguaccccgacaacggcgacuccuccuacaaccagaaguuccgcgagcgcgucaccaucacccgcgacaccuccaccuccaccgccuaccucgagcucuccucccuccgcuccgaggacaccgccgucuacuacugcgucgccgccccccgcugguacuucuccgucuggggccagggcacccucgucaccgucuccucc

SEQ ID NO: 20853 - RNA, 354 nt, Artificial Sequence
  derived and/or modified sequence opt2 from anti-OX40_HeavyChain
gagguccagcucgucgaguccggcggcggccucguccagcccggcggcucccuccgccucuccugcgccgccuccggcuucaccuucuccuccuacuccaugaacuggguccgccaggcccccggcaagggccucgagugggucuccuacaucuccuccuccuccuccaccaucgacuacgccgacuccgucaagggccgcuucaccaucucccgcgacaacgccaagaacucccucuaccuccagaugaacucccuccgcgacgaggacaccgccgucuacuacugcgcccgcgaguccggcugguaccucuucgacuacuggggccagggcacccucgucaccgucuccucc

SEQ ID NO: 20854 - RNA, 363 nt, Artificial Sequence
  derived and/or modified sequence opt2 from anti-OX40_HeavyChain
cagguccagcuccaggaguccggccccggccucgucaagcccucccagacccucucccucaccugcgccgucuacggcggcuccuucuccuccggcuacuggaacuggauccgccagcaccccggcaagggccucgaguggaucggcuacaucuccuacaacggcaucaccuaccacaaccccucccucaagucccgcaucaccaucaaccccgacaccuccaagaaccaguucucccuccagcucaacuccgucacccccgaggacaccgccgucuacuacugcgcccgcuaccgcuacgacuacgacggcggccacgccauggacuacuggggccagggcacccucgucaccgucuccucc

SEQ ID NO: 20855 - RNA, 363 nt, Artificial Sequence
  derived and/or modified sequence opt2 from anti-OX40_HeavyChain
cagguccagcuccaggaguccggccccggccucgucaagcccucccagacccucucccucaccugcgccgucuacggcggcuccuucuccuccggcuacuggaacuggauccgcaagcaccccggcaagggccucgaguggaucggcuacaucuccuacaacggcaucaccuaccacaaccccucccucaagucccgcaucaccaucaaccgcgacaccuccaagaaccaguucucccuccagcucaacuccgucacccccgaggacaccgccgucuacuacugcgcccgcuaccgcuacgacuacgacggcggccacgccauggacuacuggggccagggcacccucgucaccgucuccucc

SEQ ID NO: 20856 - RNA, 363 nt, Artificial Sequence
  derived and/or modified sequence opt2 from anti-OX40_HeavyChain
cagguccagcuccaggaguccggccccggccucgucaagcccucccagacccucucccucaccugcgccgucuacggcgacuccuucuccuccggcuacuggaacuggauccgcaagcaccccggcaagggccucgaguacaugggcuacaucuccuacaacggcaucaccuaccacaaccccucccucaagucccgcaucaccaucaaccgcgacaccuccaagaaccaguacucccuccagcucaacuccgucacccccgaggacaccgccgucuacuucugcgcccgcuaccgcuacgacuacgacggcggccacgccauggacuacuggggccagggcacccucgucaccgucuccucc

SEQ ID NO: 20857 - RNA, 363 nt, Artificial Sequence
  derived and/or modified sequence opt2 from anti-OX40_HeavyChain
cagguccagcuccaggaguccggccccggccucgucaagcccucccagacccucucccucaccugcgccgucuacggcgacuccuucuccuccggcuacuggaacuggauccgcaagcaccccggcaagggccucgaguacaucggcuacaucuccuacaacggcaucaccuaccacaaccccucccucaagucccgcaucaccaucaaccgcgacaccuccaagaaccaguacucccuccagcucaacuccgucacccccgaggacaccgccgucuacuucugcgcccgcuaccgcuacgacuacgacggcggccacgccauggacuacuggggccagggcacccucgucaccgucuccucc

SEQ ID NO: 20858 - RNA, 363 nt, Artificial Sequence
  derived and/or modified sequence opt2 from anti-OX40_HeavyChain
cagguccagcuccaggaguccggccccggccucgucaagcccucccagacccucucccucaccugcgccgucuacggcgacuccuucuccuccggcuacuggaacuggauccgcaagcaccccggcaagggccucgaguacaucggcuacaucuccuacaacggcaucaccuaccacaaccccucccucaagucccgcaucaccaucaaccgcgacaccuccaagaaccaguucucccuccagcucaacuccgucacccccgaggacaccgccgucuacuucugcgcccgcuaccgcuacgacuacgacggcggccacgccauggacuacuggggccagggcacccucgucaccgucuccucc

SEQ ID NO: 20859 - RNA, 363 nt, Artificial Sequence
  derived and/or modified sequence opt2 from anti-OX40_HeavyChain
cagguccagcuccaggaguccggccccggccucgucaagcccucccagacccucucccucaccugcgccgucuacggcgacuccuucuccuccggcuacuggaacuggauccgcaagcaccccggcaagggccucgaguacaucggcuacaucuccuacaacggcaucaccuaccacaaccccucccucaagucccgcaucaccaucaaccgcgacaccuccaagaaccaguacucccuccagcucaacuccgucacccccgaggacaccgccgucuacuacugcgcccgcuaccgcuacgacuacgacggcggccacgccauggacuacuggggccagggcacccucgucaccgucuccucc

SEQ ID NO: 20860 - RNA, 363 nt, Artificial Sequence
  derived and/or modified sequence opt2 from anti-OX40_HeavyChain
cagguccagcuccaggaguccggccccggccucgucaagcccucccagacccucucccucaccugcgccgucuacggcgacuccuucuccuccggcuacuggaacuggauccgcaagcaccccggcaagggccucgaguacaucggcuacaucuccuacaacggcaucaccuaccacaaccccucccucaagucccgcaucaccaucaaccgcgacaccuccaagaaccaguucucccuccagcucaacuccgucacccccgaggacaccgccgucuacuacugcgcccgcuaccgcuacgacuacgacggcggccacgccauggacuacuggggccagggcacccucgucaccgucuccucc

SEQ ID NO: 20861 - RNA, 363 nt, Artificial Sequence
  derived and/or modified sequence opt2 from anti-OX40_HeavyChain
cagguccagcuccaggaguccggccccggccucgucaagcccucccagacccucucccucaccugcgccgucuacggcggcuccuucuccuccggcuacuggaacuggauccgcaagcaccccggcaagggccucgaguacaucggcuacaucuccuacaacggcaucaccuaccacaaccccucccucaagucccgcaucaccaucaaccccgacaccuccaagaaccaguacucccuccagcucaacuccgucacccccgaggacaccgccgucuacuucugcgcccgcuaccgcuacgacuacgacggcggccacgccauggacuacuggggccagggcacccucgucaccgucuccucc

SEQ ID NO: 20862 - RNA, 363 nt, Artificial Sequence
  derived and/or modified sequence opt2 from anti-OX40_HeavyChain
cagguccagcuccaggaguccggccccggccucgucaagcccucccagacccucucccucaccugcgccgucuacggcggcuccuucuccuccggcuacuggaacuggauccgcaagcaccccggcaagggccucgaguacaucggcuacaucuccuacaacggcaucaccuaccacaaccccucccucaagucccgcaucaccaucaaccgcgacaccuccaagaaccaguacucccuccagcucaacuccgucacccccgaggacaccgccgucuacuucugcgcccgcuaccgcuacgacuacgacggcggccacgccauggacuacuggggccagggcacccucgucaccgucuccucc

SEQ ID NO: 20863 - RNA, 363 nt, Artificial Sequence
  derived and/or modified sequence opt2 from anti-OX40_HeavyChain
cagguccagcuccaggaguccggccccggccucgucaagcccucccagacccucucccucaccugcgccgucuacggcggcuccuucuccuccggcuacuggaacuggauccgcaagcaccccggcaagggccucgaguacaucggcuacaucuccuacaacggcaucaccuaccacaaccccucccucaagucccgcaucaccaucaaccgcgacaccuccaagaaccaguacucccuccagcucaacuccgucacccccgaggacaccgccgucuacuacugcgcccgcuaccgcuacgacuacgacggcggccacgccauggacuacuggggccagggcacccucgucaccgucuccucc

SEQ ID NO: 20864 - RNA, 363 nt, Artificial Sequence
  derived and/or modified sequence opt2 from anti-OX40_HeavyChain
cagguccagcuccaggaguccggccccggccucgucaagcccucccagacccucucccucaccugcgccgucuacggcggcuccuucuccuccggcuacuggaacuggauccgcaagcaccccggcaagggccucgaguacaucggcuacaucuccuacaacggcaucaccuaccacaaccccucccucaagucccgcaucaccaucaaccccgacaccuccaagaaccaguacucccuccagcucaacuccgucacccccgaggacaccgccgucuacuacugcgcccgcuaccgcuacgacuacgacggcggccacgccauggacuacuggggccagggcacccucgucaccgucuccucc

SEQ ID NO: 20865 - RNA, 363 nt, Artificial Sequence
  derived and/or modified sequence opt2 from anti-OX40_HeavyChain
cagguccagcuccaggaguccggccccggccucgucaagcccucccagacccucucccucaccugcgccgucuacggcggcuccuucuccuccggcuacuggaacuggauccgcaagcaccccggcaagggccucgaguacaucggcuacaucuccuacaacgccaucaccuaccacaaccccucccucaagucccgcaucaccaucaaccgcgacaccuccaagaaccaguacucccuccagcucaacuccgucacccccgaggacaccgccgucuacuacugcgcccgcuacaaguacgacuacgacgccggccacgccauggacuacuggggccagggcacccucgucaccgucuccucc

SEQ ID NO: 20866 - RNA, 363 nt, Artificial Sequence
  derived and/or modified sequence opt2 from anti-OX40_HeavyChain
cagguccagcuccaggaguccggccccggccucgucaagcccucccagacccucucccucaccugcgccgucuacggcggcuccuucuccuccggcuacuggaacuggauccgcaagcaccccggcaagggccucgaguacaucggcuacaucuccuacaacgccaucaccuaccacaaccccucccucaagucccgcaucaccaucaaccgcgacaccuccaagaaccaguacucccuccagcucaacuccgucacccccgaggacaccgccgucuacuacugcgcccgcuaccgcuacgacuacgacggcggccacgccauggacuacuggggccagggcacccucgucaccgucuccucc

SEQ ID NO: 20867 - RNA, 363 nt, Artificial Sequence
  derived and/or modified sequence opt2 from anti-OX40_HeavyChain
cagguccagcuccaggaguccggccccggccucgucaagcccucccagacccucucccucaccugcgccgucuacggcggcuccuucuccuccggcuacuggaacuggauccgcaagcaccccggcaagggccucgaguacaucggcuacaucuccuacaacggcaucaccuaccacaaccccucccucaagucccgcaucaccaucaaccgcgacaccuccaagaaccaguacucccuccagcucaacuccgucacccccgaggacaccgccgucuacuacugcgcccgcuacaaguacgacuacgacggcggccacgccauggacuacuggggccagggcacccucgucaccgucuccucc

SEQ ID NO: 20868 - RNA, 363 nt, Artificial Sequence
  derived and/or modified sequence opt2 from anti-OX40_HeavyChain
cagguccagcuccaggaguccggccccggccucgucaagcccucccagacccucucccucaccugcgccgucuacggcggcuccuucuccuccggcuacuggaacuggauccgcaagcaccccggcaagggccucgaguacaucggcuacaucuccuacuccggcaucaccuaccacaaccccucccucaagucccgcaucaccaucaaccgcgacaccuccaagaaccaguacucccuccagcucaacuccgucacccccgaggacaccgccgucuacuacugcgcccgcuaccgcuacgacuacgacggcggccacgccauggacuacuggggccagggcacccucgucaccgucuccucc

SEQ ID NO: 20869 - RNA, 363 nt, Artificial Sequence
  derived and/or modified sequence opt2 from anti-OX40_HeavyChain
cagguccagcuccaggaguccggccccggccucgucaagcccucccagacccucucccucaccugcgccgucuacggcggcuccuucuccuccggcuacuggaacuggauccgcaagcaccccggcaagggccucgaguacaucggcuacaucuccuacuccggcaucaccuaccacaaccccucccucaagucccgcaucaccaucaaccgcgacaccuccaagaaccaguacucccuccagcucaacuccgucacccccgaggacaccgccgucuacuacugcgcccgcuacaaguacgacuacgacggcggccacgccauggacuacuggggccagggcacccucgucaccgucuccucc

SEQ ID NO: 20870 - RNA, 363 nt, Artificial Sequence
  derived and/or modified sequence opt2 from anti-OX40_HeavyChain
gagguccagcuccaggaguccggccccucccucgucaagcccucccagacccucucccucaccugcuccgucaccggcgacuccuucaccuccggcuacuggaacuggauccgcaaguuccccggcaaccgccucgaguacaugggcuacaucuccuacaacgccaucaccuaccacaaccccucccucaagucccgcaucuccaucacccgcgacaccuccaagaaccacuacuaccuccagcucaacuccgucaccaccgaggacaccgccaccuacuucugcgcccgcuaccgcuacgacuacgacggcggccacgccauggacuacuggggccagggcacccucgucaccgucuccucc

SEQ ID NO: 20871 - RNA, 363 nt, Artificial Sequence
  derived and/or modified sequence opt2 from anti-OX40_HeavyChain
cagguccagcuccaggaguccggccccggccucgucaagcccucccagacccucucccucaccugcgccgucuacggcggcuccuucuccuccggcuacuggaacuggauccgcaagcaccccggcaagggccucgaguacaucggcuacaucuccuacaacgccaucaccuaccacaaccccucccucaagucccgcaucaccaucaaccgcgacaccuccaagaaccaguacucccuccagcucaacuccgucacccccgaggacaccgccgucuacuacugcgcccgcuacaaguacgacuacgacggcggccacgccauggacuacuggggccagggcacccucgucaccgucuccucc

SEQ ID NO: 20872 - RNA, 372 nt, Artificial Sequence
  derived and/or modified sequence opt2 from anti-OX40_HeavyChain
gagguccagcucgucgaguccggcggcggccucguccagcccggccgcucccuccgccucuccugcgccgccuccggcuucaccuucgacgacuacgccaugcacuggguccgccaggcccccggcaagggccucgagugggucuccggcaucuccuggaacuccggcuccaucggcuacgccgacuccgucaagggccgcuucaccaucucccgcgacaacgccaagaacucccucuaccuccagaugaacucccuccgcgccgaggacaccgcccucuacuacugcgccaaggaccaguccaccgccgacuacuacuucuacuacggcauggacgucuggggccagggcaccaccgucaccgucuccucc

SEQ ID NO: 20873 - RNA, 381 nt, Artificial Sequence
  derived and/or modified sequence opt2 from anti-OX40_LightChain
auggagacccccgcccagcuccucuuccuccuccuccucuggcuccccgacaccaccggcgagaucguccucacccagucccccggcacccucucccucucccccggcgagcgcgccauccucuccugccgcgccucccaguccgucuccuccuccuuccucgccugguaccagcagaagcccggccaggccccccgccuccucaucuacggcgccuucucccgcgccaccggcauccccgaccgcuucuccggcuccggcuccggcaccgacuucacccucaccaucucccgccucgagcccgaggacuucgccgucuacuacugccagcaguacgacuccucccgcaccuucggccagggcaccaaggucgagaucaag

SEQ ID NO: 20874 - RNA, 381 nt, Artificial Sequence
  derived and/or modified sequence opt2 from anti-OX40_LightChain
auggaggcccccgcccagcuccucuuccuccuccuccucuggcuccccgacaccaccggcgagaucguccucacccagucccccgccacccucucccucucccccggcgagcgcgccacccucuccugccgcgccucccagggcgucuccuccuaccucgccugguaccagcagaagcccggccaggccccccgccuccucaucuacgacgccuccaaccgcgccaccggcauccccgcccgcuucuccggcuccggccccggcaccgacuucacccucaccaucuccucccucgagcccgaggacuucgccgucuacuacugccagcagcgcuccaacuggcaccccaccuucggccagggcaccaaggucgagaucaag

SEQ ID NO: 20875 - RNA, 381 nt, Artificial Sequence
  derived and/or modified sequence opt2 from anti-OX40_LightChain
auggaggcccccgcccagcuccucuuccuccuccuccucuggcuccccgacaccaccggcgagaucguccucacccagucccccgccacccucucccucucccccggcgagcgcgccacccucuccugccgcgccucccaguccgucuccuccuaccucgccugguaccagcagaagcccggccaggccccccgccuccucaucuacgacgccuccaaccgcgccaccggcauccccgcccgcuucuccggcuccggcuccggcaccgacuucacccucaccaucuccucccucgagcccgaggacuucgccgucuacuacugccagcagcgcuccaacuggcccaucaccuucggccagggcacccgccucgagaucaag

SEQ ID NO: 20876 - RNA, 387 nt, Artificial Sequence
  derived and/or modified sequence opt2 from anti-OX40_LightChain
auggagacccccgcccagcuccucuuccuccuccuccucuggcuccccgacaccaccggcgagaucguccucacccagucccccggcacccucucccucucccccggcgagcgcgccacccucuccugccgcgccucccaguccgucuccuccuccuaccucgccugguaccagcagaagcccggccaggccccccgccuccucaucuacggcgccuccucccgcgccaccggcauccccgaccgcuucuccggcuccggcuccggcaccgacuucacccucaccaucucccgccucgagcccgaggacuucgccgucuacuacugccagcaguacgacuccucccucaccuucggcggcggcaccaaggucgagaucaagcgcacc

SEQ ID NO: 20877 - RNA, 390 nt, Artificial Sequence
  derived and/or modified sequence opt2 from anti-OX40_LightChain
auggacaugcgcguccucgcccagcuccucggccuccuccuccucugcuuccccggcgcccgcugcgacauccagaugacccagucccccuccucccucuccgccuccgucggcaaccgcgucaccaucaccugccgcgccucccaggacaucuccuccuggcucgccugguaccagcagaagcccgagaaggcccccaagucccucaucuacgccgccuccucccuccaguccggcguccccucccgcuucuccggcuccggcuccggcaccgacuucacccucaccaucuccucccuccagcccgaggacuucgccaccuacuacugccagcaguacaacuccuacccccucaccuucggccagggcacccgccucgagaucaagcgc

SEQ ID NO: 20878 - RNA, 408 nt, Artificial Sequence
  derived and/or modified sequence opt2 from anti-OX40_HeavyChain
auggacacccucugcuccacccuccuccuccucaccauccccuccuggguccucucccagaucacccucaaggaguccggccccacccucgucaagcccacccagacccucacccucuccugcaccuucuccggcuucucccucuccaccuccggcgucggcgucggcuggauccgccagccccccggcaaggcccucgaguggcucgcccucauccacugggacgacgccgagcgcuacucccccucccucaagucccgccucaccaucaccaaggacaccuccaagaaccaggucguccucaccaugaccaacauggaccucgucgacaccgccaccuacuacugcgcccacacccgcggcgccuucgacaucuggggccagggcaccauggucaccgucuccucc

SEQ ID NO: 20879 - RNA, 408 nt, Artificial Sequence
  derived and/or modified sequence opt2 from anti-OX40_HeavyChain
auggacacccucugcuccacccuccuccuccucaccauccccuccuggguccucucccagaucacccucaaggaguccggccccacccucgucaagcccacccagacccucacccucaccugcaccuucuccggcuucucccucuccaccuccggcgucggcgucggcuggauccgccagccccccggcaaggcccucgaguggcucgcccucaucuacugggacgaccacucccccuacucccccucccucaagucccgccucaccaucaccaaggacaccuccaagaaccaggucguccucaccaugaccaacauggaccccgucgacaccgccaccuacuacugcgcccgcacccgcggcgccuucgacaucuggggccagggcaccauggucaccgucuccucc

SEQ ID NO: 20880 - RNA, 420 nt, Artificial Sequence
  derived and/or modified sequence opt2 from anti-OX40_HeavyChain
auggaguggggccccugcugggucuuccucgucgucauccucgagggcguccagugcggcguccagcucgucgaguccggcggcggccucguccagcccggcggcucccuccgccucuccugcgccgccuccggcuucaccuucuccuccuacuccaugaacuggguccgccaggcccccggcaagggccucgagugggucuccuacaucuccuccuccuccuccaccaucuacuacgccgacuccgucaagggccgcuucaccaucucccgcgacaacgccaagaacucccucuaccuccagaugaacucccuccgcgacgaggacaccgccgucuacuacugcgcccgcggcgucuaccacaacggcugguccuucuucgacuacuggggccagggcacccuccucaccgucuccucc

SEQ ID NO: 20881 - RNA, 423 nt, Artificial Sequence
  derived and/or modified sequence opt2 from anti-OX40_HeavyChain
auggacacccucugcuccacccuccuccuccucaccauccccuccuggguccucucccagaucacccucaaggaguccggccccacccucgucaagcccaagcagacccucacccucaccugcaccuucuccggcuucucccucuccaccuccggcaugggcgucggcuggauccgccagccccccggcaaggcccucgaguggcucgccgucaucuacugggacgaccaccagcucuacucccccucccucaagucccgccucaccaucaccaaggacaccuccaagaaccaggucguccucaccaugaccaacauggaccccgucgacaccgccaccuacuacugcgcccaccgccgcggcgccuuccagcacuggggccagggcacccucgucaccgucuccuccgccuccaccaagggc

SEQ ID NO: 20882 - RNA, 462 nt, Artificial Sequence
  derived and/or modified sequence opt2 from anti-OX40_HeavyChain
augaccaugaucacccccucccucguccccuccuccgacccccucgucaccgccgccuccguccucgaguucgcccuccucauccgccucaccaucggccaggccgucgucuccacccaguccaccggcggcggccucguccagcccggccgcucccuccgccucuccugcgccgccuccggcuucacccucgacgacuacggcaugcacuggguccgccaggcccccggcaagggccucgagugggucuccggcaucuccuggaacuccgacuccaucggcuacgucgacuccgucaagggccgcuucaccaucucccgcgacaacgccaagaacucccucuaccuccagaugaacucccuccgcgucgaggacaccgcccucuacuacugcgucaaggacaucuccggcugguacuccuucgacuacuggggccagggcacccucgucaccgucuccucc

SEQ ID NO: 20883 - RNA, 639 nt, Artificial Sequence
  derived and/or modified sequence opt2 from anti-OX40_LightChain
gagaucgucgucacccagucccccgccacccucucccucucccccggcgagcgcgccacccucuccugccgcgccucccaguccgucuccuccuaccucgccugguaccagcagaagcccggccaggccccccgccuccucaucuacgacgccuccaaccgcgccaccggcauccccgcccgcuucuccggcuccggcuccggcaccgacuucacccucaccaucuccucccucgagcccgaggacuucgccgucuacuacugccagcagcgcuccaacuggcccaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 20884 - RNA, 1350 nt, Artificial Sequence
  derived and/or modified sequence opt2 from anti-OX40_HeavyChain
gagguccagcucgucgaguccggcggcggccucguccagcccggccgcucccuccgccucuccugcgccgccuccggcuucaccuucgacgacuacgccaugcacuggguccgccaggcccccggcaagggccucgagugggucuccggcaucuccuggaacuccggcuccaucggcuacgccgacuccgucaagggccgcuucaccaucucccgcgacaacgccaagaacucccucuaccuccagaugaacucccuccgcgccgaggacaccgcccucuacuacugcgccaaggaccaguccaccgccgacuacuacuucuacuacggcauggacgucuggggccagggcaccaccgucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccaacuucggcacccagaccuacaccugcaacgucgaccacaagcccuccaacaccaaggucgacaagaccgucgagcgcaagugcugcgucgagugcccccccugccccgccccccccgucgccggccccuccgucuuccucuucccccccaagcccaaggacacccucaugaucucccgcacccccgaggucaccugcgucgucgucgacgucucccacgaggaccccgagguccaguucaacugguacgucgacggcgucgagguccacaacgccaagaccaagccccgcgaggagcaguucaacuccaccuuccgcgucgucuccguccucaccgucguccaccaggacuggcucaacggcaaggaguacaagugcaaggucuccaacaagggccuccccgcccccaucgagaagaccaucuccaagaccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccaugcucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 20885 - RNA, 21 nt, Artificial Sequence
  derived and/or modified sequence opt2 from anti-HIV_VRC01_VRC02_NIH45-46_LightChain_CDR
ugccagcaguacgaguucuuc

SEQ ID NO: 20886 - RNA, 42 nt, Artificial Sequence; identical to SEQ ID NO: 13244
  derived and/or modified sequence opt2 from anti-HIV_VRC01_HeavyChain_CDR

SEQ ID NO: 20887 - RNA, 21 nt, Artificial Sequence
  derived and/or modified sequence opt2 from anti-HIV_3BNC60_LightChain_CDR
ugccaggucuacgaguucauc

SEQ ID NO: 20888 - RNA, 36 nt, Artificial Sequence
  derived and/or modified sequence opt2 from anti-HIV_3BNC60_HeavyChain_CDR
gcccgccagcgcuccgacuucugggacuucgacguc

SEQ ID NO: 20889 - RNA, 36 nt, Artificial Sequence
  derived and/or modified sequence opt2 from anti-HIV_5H/I1-BMV-D5_HeavyChain_CDR
gcccgcgacaaccccacccuccucggcuccgacuac

SEQ ID NO: 20890 - RNA, 33 nt, Artificial Sequence; identical to SEQ ID NO: 13248
  derived and/or modified sequence opt2 from anti-HIV_8ANC195_LightChain_CDR

SEQ ID NO: 20891 - RNA, 33 nt, Artificial Sequence
  derived and/or modified sequence opt2 from anti-HIV_CH01_CH02_CH03_LightChain_CDR
ugccagcaguacggcggcucccccuacaccuuc

SEQ ID NO: 20892 - RNA, 78 nt, Artificial Sequence
  derived and/or modified sequence opt2 from anti-HIV_CH01_HeavyChain_CDR
gcccgcggcaccgacuacaccaucgacgacgccggcauccacuaccagggcuccggcaccuucugguacuucgaccuc

SEQ ID NO: 20893 - RNA, 78 nt, Artificial Sequence
  derived and/or modified sequence opt2 from anti-HIV_CH02_HeavyChain_CDR
gcccgcggcaccgacuacaccaucgacgaccagggccgcuucuaccagggcuccggcaccuucugguacuucgacuuc

SEQ ID NO: 20894 - RNA, 78 nt, Artificial Sequence
  derived and/or modified sequence opt2 from anti-HIV_CH03_HeavyChain_CDR
gcccgcggcaccgacuacaccaucgacgaccagggcaucuucuacaagggcuccggcaccuucugguacuucgaccuc

SEQ ID NO: 20895 - RNA, 33 nt, Artificial Sequence
  derived and/or modified sequence opt2 from anti-HIV_CH04_LightChain_CDR
ugccagcaguacggccgcucccccuacaccuuc

SEQ ID NO: 20896 - RNA, 78 nt, Artificial Sequence
  derived and/or modified sequence opt2 from anti-HIV_CH04_HeavyChain_CDR
gcccgcggcaccgacuacaccaucgacgaccagggcauccgcuaccagggcuccggcaccuucugguacuucgacguc

SEQ ID NO: 20897 - RNA, 54 nt, Artificial Sequence
  derived and/or modified sequence opt2 from anti-HIV_NIH45-46_HeavyChain_CDR
acccgcggcaaguacugcaccgcccgcgacuacuacaacugggacuucgagcac

SEQ ID NO: 20898 - RNA, 90 nt, Artificial Sequence
  derived and/or modified sequence opt2 from anti-HIV_PG16_HeavyChain_CDR
gcccgcgaggccggcggccccaucuggcacgacgacgucaaguacuacgacuucaacgacggcuacuacaacuaccacuacauggacguc

SEQ ID NO: 20899 - RNA, 36 nt, Artificial Sequence
  derived and/or modified sequence opt2 from anti-HIV_PGT122_LightChain_CDR
cacaucugggacucccgccgccccaccaacuggguc

SEQ ID NO: 20900 - RNA, 72 nt, Artificial Sequence
  derived and/or modified sequence opt2 from anti-HIV_PGT122_HeavyChain_CDR
accaagcacggccgccgcaucuacggcgucgucgccuucaaggagugguucaccuacuucuacauggacguc

SEQ ID NO: 20901 - RNA, 36 nt, Artificial Sequence
  derived and/or modified sequence opt2 from anti-HIV_PGT123_LightChain_CDR
cacaucuacgacgcccgcggcggcaccaacuggguc

SEQ ID NO: 20902 - RNA, 72 nt, Artificial Sequence
  derived and/or modified sequence opt2 from anti-HIV_PGT123_HeavyChain_CDR
gcccuccacggcaagcgcaucuacggcaucgucgcccucggcgagcucuucaccuacuucuacauggacguc

SEQ ID NO: 20903 - RNA, 30 nt, Artificial Sequence
  derived and/or modified sequence opt2 from anti-HIV_PGT125_PGT128_LightChain_CDR
ggcucccucgucggcaacugggacgucauc

SEQ ID NO: 20904 - RNA, 57 nt, Artificial Sequence
  derived and/or modified sequence opt2 from anti-HIV_PGT125_HeavyChain_CDR
uucgacggcgagguccucgucuacaaccacuggcccaagcccgccugggucgaccuc

SEQ ID NO: 20905 - RNA, 30 nt, Artificial Sequence
  derived and/or modified sequence opt2 from anti-HIV_PGT126_PGT127_LightChain_CDR
uccucccucgucggcaacugggacgucauc

SEQ ID NO: 20906 - RNA, 57 nt, Artificial Sequence
  derived and/or modified sequence opt2 from anti-HIV_PGT126_HeavyChain_CDR
uucgacggcgagguccucgucuaccacgacuggcccaagcccgccugggucgaccuc

SEQ ID NO: 20907 - RNA, 57 nt, Artificial Sequence
  derived and/or modified sequence opt2 from anti-HIV_PGT127_HeavyChain_CDR
uucggcggcgagguccucgucuaccgcgacuggcccaagcccgccugggucgaccuc

SEQ ID NO: 20908 - RNA, 57 nt, Artificial Sequence
  derived and/or modified sequence opt2 from anti-HIV_PGT128_HeavyChain_CDR
uucggcggcgagguccuccgcuacaccgacuggcccaagcccgccugggucgaccuc

SEQ ID NO: 20909 - RNA, 30 nt, Artificial Sequence
  derived and/or modified sequence opt2 from anti-HIV_PGT130_LightChain_CDR
uccucccucuucggccgcugggacgucguc

SEQ ID NO: 20910 - RNA, 57 nt, Artificial Sequence
  derived and/or modified sequence opt2 from anti-HIV_PGT130_HeavyChain_CDR
uccggcggcgacauccucuacuacuacgaguggcagaagccccacugguucuccccc

SEQ ID NO: 20911 - RNA, 30 nt, Artificial Sequence
  derived and/or modified sequence opt2 from anti-HIV_PGT131_LightChain_CDR
uccucccucuccggccgcugggacaucguc

SEQ ID NO: 20912 - RNA, 57 nt, Artificial Sequence
  derived and/or modified sequence opt2 from anti-HIV_PGT131_HeavyChain_CDR
uccggcggcgacauccucuacuacaucgaguggcagaagccccacugguucuacccc

SEQ ID NO: 20913 - RNA, 27 nt, Artificial Sequence
  derived and/or modified sequence opt2 from anti-HIV_PGT135_PGT136_PGT137_LightChain_CDR
cagcaguacgaggaguggccccgcacc

SEQ ID NO: 20914 - RNA, 54 nt, Artificial Sequence
  derived and/or modified sequence opt2 from anti-HIV_PGT135_HeavyChain_CDR
caccgccaccacgacgucuucaugcucguccccaucgccggcugguucgacguc

SEQ ID NO: 20915 - RNA, 54 nt, Artificial Sequence
  derived and/or modified sequence opt2 from anti-HIV_PGT136_HeavyChain_CDR
cacaaguaccacgacaucuuccgcgucguccccgucgccggcugguucgacccc

SEQ ID NO: 20916 - RNA, 54 nt, Artificial Sequence
  derived and/or modified sequence opt2 from anti-HIV_PGT137_HeavyChain_CDR
cacaaguaccacgacaucgucauggucguccccaucgccggcugguucgacccc

SEQ ID NO: 20917 - RNA, 27 nt, Artificial Sequence
  derived and/or modified sequence opt2 from anti-HIV_PGT141_PGT142_PGT143_PGT144_LightChain_CDR
augcagggccucaaccgccccuggacc

SEQ ID NO: 20918 - RNA, 96 nt, Artificial Sequence
  derived and/or modified sequence opt2 from anti-HIV_PGT141_HeavyChain_CDR
ggcuccaagcaccgccuccgcgacuacguccucuacgacgacuacggccucaucaacuaccaggaguggaacgacuaccucgaguuccucgacguc

SEQ ID NO: 20919 - RNA, 96 nt, Artificial Sequence
  derived and/or modified sequence opt2 from anti-HIV_PGT144_HeavyChain_CDR
ggcuccaagcaccgccuccgcgacuacguccucuacgacgacuacggccucaucaaccagcaggaguggaacgacuaccucgaguuccucgacguc

SEQ ID NO: 20920 - RNA, 27 nt, Artificial Sequence
  derived and/or modified sequence opt2 from anti-HIV_PGT145_LightChain_CDR
augcagggccuccacucccccuggacc

SEQ ID NO: 20921 - RNA, 93 nt, Artificial Sequence
  derived and/or modified sequence opt2 from anti-HIV_PGT145_HeavyChain_CDR
ggcuccaagcaccgccuccgcgacuacuuccucuacaacgaguacggccccaacuacgaggaguggggcgacuaccucgccacccucgacguc

SEQ ID NO: 20922 - RNA, 21 nt, Artificial Sequence
  derived and/or modified sequence opt2 from anti-HIV_VRC-CH30_VRC-CH31_VRC-CH32_VRC-CH33_VRC-CH34_LightChain _CDR
ugccagcaguacgagaccuuc

SEQ ID NO: 20923 - RNA, 45 nt, Artificial Sequence
  derived and/or modified sequence opt2 from anti-HIV_VRC-CH30_VRC-CH31_VRC-CH32_VRC-CH34_HeavyChain_CDR
gcccgcgcccagaagcgcggccgcuccgagugggccuacgcccac

SEQ ID NO: 20924 - RNA, 45 nt, Artificial Sequence
  derived and/or modified sequence opt2 from anti-HIV_VRC-CH33_HeavyChain_CDR
gcccgcgcccagaagcgcgcccgcuccgagugggccuacgcccac

SEQ ID NO: 20925 - RNA, 21 nt, Artificial Sequence
  derived and/or modified sequence opt2 from anti-HIV_VRC-PG04_LightChain_CDR
ugccagcagcucgaguucuuc

SEQ ID NO: 20926 - RNA, 48 nt, Artificial Sequence
  derived and/or modified sequence opt2 from anti-HIV_VRC-PG04_HeavyChain_CDR
gcccgccagaaguucuacaccggcggccagggcugguacuucgaccuc

SEQ ID NO: 20927 - RNA, 21 nt, Artificial Sequence
  derived and/or modified sequence opt2 from anti-HIV_VRC-PG04b_LightChain_CDR
ugccagcaggucgaguucuuc

SEQ ID NO: 20928 - RNA, 48 nt, Artificial Sequence
  derived and/or modified sequence opt2 from anti-HIV_VRC-PG04b_HeavyChain_CDR
gcccgccagaaguucgagcgcggcggccagggcugguacuucgaccuc

SEQ ID NO: 20929 - RNA, 21 nt, Artificial Sequence
  derived and/or modified sequence opt2 from anti-HIV_VRC03_LightChain_CDR
ugccagcaguucgaguucuuc

SEQ ID NO: 20930 - RNA, 48 nt, Artificial Sequence
  derived and/or modified sequence opt2 from anti-HIV_VRC03_HeavyChain_CDR
guccgccgcggcuccugcgacuacugcggcgacuuccccuggcaguac

SEQ ID NO: 20931 - RNA, 21 nt, Artificial Sequence
  derived and/or modified sequence opt2 from anti-HIV_1TJG_P-Chain
gagcucgacaagugggccucc

SEQ ID NO: 20932 - RNA, 69 nt, Artificial Sequence
  derived and/or modified sequence opt2 from anti-HIV_2B1H_P-Chain
aacaacaccaagaaguccaucaagauccgcccccgccaggccuucuacgccaccaacggcaucaucggc

SEQ ID NO: 20933 - RNA, 69 nt, Artificial Sequence
  derived and/or modified sequence opt2 from anti-HIV_2B1A_P-Chain
aacaacacccgcaaguccauccaccucggccccggccgcgccuucuacgccaccggcgacaucaucggc

SEQ ID NO: 20934 - RNA, 57 nt, Artificial Sequence
  derived and/or modified sequence opt2 from anti-HIV_2B0S_P-Chain
aagcgcaagcgcauccacaucggccccggccgcgccuucuacaccaccaagaacgcc

SEQ ID NO: 20935 - RNA, 69 nt, Artificial Sequence
  derived and/or modified sequence opt2 from anti-HIV_3UJJ_P-Chain
aacaacacccgcaaguccauccgcaucggccccggccaggccuucuacgccaccggcgacaucaucggc

SEQ ID NO: 20936 - RNA, 69 nt, Artificial Sequence
  derived and/or modified sequence opt2 from anti-HIV_3UJI_P-Chain
uacaacaagcgcaagcgcauccacaucggccccggccgcgccuucuacaccaccaagaacaucaucggc

SEQ ID NO: 20937 - RNA, 75 nt, Artificial Sequence
  derived and/or modified sequence opt2 from anti-HIV_3MLZ_P-Chain
uccaacaacacccgcaagggcauccacaucggccccggccgcgccuucuacgccaccggccagaucaccggcgac

SEQ ID NO: 20938 - RNA, 60 nt, Artificial Sequence
  derived and/or modified sequence opt2 from anti-HIV_3MLV_Q-Chain
aacaacacccgcaagcgcauccgcgucggccccggccagaccgucuacgccaccaacgcc

SEQ ID NO: 20939 - RNA, 69 nt, Artificial Sequence
  derived and/or modified sequence opt2 from anti-HIV_3MLU_P-Chain
aacaacacccgcaaguccauccgcaucggccccggccaggccuucuacgccaccggcggcaucaucggc

SEQ ID NO: 20940 - RNA, 60 nt, Artificial Sequence
  derived and/or modified sequence opt2 from anti-HIV_3MLR_P-Chain
aacaacaccaagaagggcaucgccaucggccccggccgcacccucuacgcccgcgagaag

SEQ ID NO: 20941 - RNA, 48 nt, Artificial Sequence
  derived and/or modified sequence opt2 from anti-HIV_4XCF_P-Chain
aacuggugggacaucaccaacuggcucugguacaucaagaagaagaag

SEQ ID NO: 20942 - RNA, 45 nt, Artificial Sequence
  derived and/or modified sequence opt2 from anti-HIV_4XBE_P-Chain
aacugguucgacaucaccaacuggcucugguacaucaagaagaag

SEQ ID NO: 20943 - RNA, 48 nt, Artificial Sequence
  derived and/or modified sequence opt2 from anti-HIV_4XAW_P-Chain
aacugguucgacaucaccaacuggcucugguacaucaagaagaagaag

SEQ ID NO: 20944 - RNA, 45 nt, Artificial Sequence
  derived and/or modified sequence opt2 from anti-HIV_2QSC_P-Chain
cgcaagcgcauccacaucggccccggccgcgccuucuacaccacc

SEQ ID NO: 20945 - RNA, 60 nt, Artificial Sequence
  derived and/or modified sequence opt2 from anti-HIV_3MLS_S-Chain
gccugccaggccuucuacgccuccuccccccgcaaguccauccacaucggcgccugcgcc

SEQ ID NO: 20946 - RNA, 42 nt, Artificial Sequence
  derived and/or modified sequence opt2 from anti-HIV_3GO1_P-Chain
cgcaagcgcauccacaucggccccggccgcgccuucuacacc

SEQ ID NO: 20947 - RNA, 42 nt, Artificial Sequence
  derived and/or modified sequence opt2 from anti-HIV_4M1D_Q-Chain
ugccgcauccacaucggccccggccgcgccuucuacaccugc

SEQ ID NO: 20948 - RNA, 39 nt, Artificial Sequence
  derived and/or modified sequence opt2 from anti-HIV_3C2A_Q-Chain
aaguccauccaccucggccccggccgcgccuucuacgcc

SEQ ID NO: 20949 - RNA, 12 nt, Artificial Sequence
  derived and/or modified sequence opt2 from anti-HIV_CDR
caguccaagacc

SEQ ID NO: 20950 - RNA, 12 nt, Artificial Sequence
  derived and/or modified sequence opt2 from anti-HIV_CDR
gaccucaucgac

SEQ ID NO: 20951 - RNA, 15 nt, Artificial Sequence
  derived and/or modified sequence opt2 from anti-HIV_CDR
gaccacuacuggucc

SEQ ID NO: 20952 - RNA, 15 nt, Artificial Sequence
  derived and/or modified sequence opt2 from anti-HIV_CDR
ggccgcuucuggucc

SEQ ID NO: 20953 - RNA, 15 nt, Artificial Sequence
  derived and/or modified sequence opt2 from anti-HIV_CDR
aacuacuacuggacc

SEQ ID NO: 20954 - RNA, 15 nt, Artificial Sequence
  derived and/or modified sequence opt2 from anti-HIV_CDR
gacgccuacuggucc

SEQ ID NO: 20955 - RNA, 15 nt, Artificial Sequence
  derived and/or modified sequence opt2 from anti-HIV_CDR
gacuccuacuggucc

SEQ ID NO: 20956 - RNA, 15 nt, Artificial Sequence
  derived and/or modified sequence opt2 from anti-HIV_CDR
gacaacuacuggucc

SEQ ID NO: 20957 - RNA, 15 nt, Artificial Sequence
  derived and/or modified sequence opt2 from anti-HIV_CDR
aacuccuacuggacc

SEQ ID NO: 20958 - RNA, 15 nt, Artificial Sequence
  derived and/or modified sequence opt2 from anti-HIV_CDR
uccuacuacuggucc

SEQ ID NO: 20959 - RNA, 15 nt, Artificial Sequence
  derived and/or modified sequence opt2 from anti-HIV_CDR
uccuucggcaugcac

SEQ ID NO: 20960 - RNA, 15 nt, Artificial Sequence
  derived and/or modified sequence opt2 from anti-HIV_CDR
gccgccuuccagugg

SEQ ID NO: 20961 - RNA, 15 nt, Artificial Sequence
  derived and/or modified sequence opt2 from anti-HIV_CDR
cagcagcuccgcacc

SEQ ID NO: 20962 - RNA, 15 nt, Artificial Sequence
  derived and/or modified sequence opt2 from anti-HIV_CDR
cagcaguacgacucc

SEQ ID NO: 20963 - RNA, 15 nt, Artificial Sequence
  derived and/or modified sequence opt2 from anti-HIV_CDR
cagcagcucgccacc

SEQ ID NO: 20964 - RNA, 15 nt, Artificial Sequence
  derived and/or modified sequence opt2 from anti-HIV_CDR
gaguccuuccagugg

SEQ ID NO: 20965 - RNA, 15 nt, Artificial Sequence
  derived and/or modified sequence opt2 from anti-HIV_CDR
gaggucuacgaguuc

SEQ ID NO: 20966 - RNA, 15 nt, Artificial Sequence
  derived and/or modified sequence opt2 from anti-HIV_CDR
gccucccucgaguuc

SEQ ID NO: 20967 - RNA, 15 nt, Artificial Sequence
  derived and/or modified sequence opt2 from anti-HIV_CDR
uccgucuacgaguuc

SEQ ID NO: 20968 - RNA, 15 nt, Artificial Sequence
  derived and/or modified sequence opt2 from anti-HIV_CDR
gccgcccucgaguuc

SEQ ID NO: 20969 - RNA, 15 nt, Artificial Sequence
  derived and/or modified sequence opt2 from anti-HIV_CDR
gccgucgucgaguuc

SEQ ID NO: 20970 - RNA, 15 nt, Artificial Sequence
  derived and/or modified sequence opt2 from anti-HIV_CDR
cagcucuucgaguuc

SEQ ID NO: 20971 - RNA, 15 nt, Artificial Sequence
  derived and/or modified sequence opt2 from anti-HIV_CDR
gccgucuuccagugg

SEQ ID NO: 20972 - RNA, 15 nt, Artificial Sequence
  derived and/or modified sequence opt2 from anti-HIV_CDR
gccguccucgaguuc

SEQ ID NO: 20973 - RNA, 15 nt, Artificial Sequence
  derived and/or modified sequence opt2 from anti-HIV_CDR
aacggcuucgacguc

SEQ ID NO: 20974 - RNA, 15 nt, Artificial Sequence
  derived and/or modified sequence opt2 from anti-HIV_CDR
cagcaguacgaguuc

SEQ ID NO: 20975 - RNA, 15 nt, Artificial Sequence
  derived and/or modified sequence opt2 from anti-HIV_CDR
cagcacuacgaguuc

SEQ ID NO: 20976 - RNA, 15 nt, Artificial Sequence
  derived and/or modified sequence opt2 from anti-HIV_CDR
caggucuacgagguc

SEQ ID NO: 20977 - RNA, 15 nt, Artificial Sequence
  derived and/or modified sequence opt2 from anti-HIV_CDR
caggucuacgaguuc

SEQ ID NO: 20978 - RNA, 15 nt, Artificial Sequence
  derived and/or modified sequence opt2 from anti-HIV_CDR
uucuccaaggagucc

SEQ ID NO: 20979 - RNA, 15 nt, Artificial Sequence
  derived and/or modified sequence opt2 from anti-HIV_CDR
cucaagcucuccucc

SEQ ID NO: 20980 - RNA, 15 nt, Artificial Sequence
  derived and/or modified sequence opt2 from anti-HIV_CDR
uacaaggucuccucc

SEQ ID NO: 20981 - RNA, 15 nt, Artificial Sequence
  derived and/or modified sequence opt2 from anti-HIV_CDR
cccccccaggagucc

SEQ ID NO: 20982 - RNA, 15 nt, Artificial Sequence
  derived and/or modified sequence opt2 from anti-HIV_CDR
accgcccgcgacuac

SEQ ID NO: 20983 - RNA, 15 nt, Artificial Sequence
  derived and/or modified sequence opt2 from anti-HIV_CDR
augcaguccauccag

SEQ ID NO: 20984 - RNA, 15 nt, Artificial Sequence
  derived and/or modified sequence opt2 from anti-HIV_CDR
caccagcucgacacc

SEQ ID NO: 20985 - RNA, 15 nt, Artificial Sequence
  derived and/or modified sequence opt2 from anti-HIV_CDR
caccagcucgacucc

SEQ ID NO: 20986 - RNA, 15 nt, Artificial Sequence
  derived and/or modified sequence opt2 from anti-HIV_CDR
cagcagcucggcacc

SEQ ID NO: 20987 - RNA, 15 nt, Artificial Sequence
  derived and/or modified sequence opt2 from anti-HIV_CDR
cagaaggccaccacc

SEQ ID NO: 20988 - RNA, 15 nt, Artificial Sequence
  derived and/or modified sequence opt2 from anti-HIV_CDR
cucuucgccggcacc

SEQ ID NO: 20989 - RNA, 18 nt, Artificial Sequence
  derived and/or modified sequence opt2 from anti-HIV_CDR
guccgcggcuccuccccc

SEQ ID NO: 20990 - RNA, 18 nt, Artificial Sequence
  derived and/or modified sequence opt2 from anti-HIV_CDR
ggccuccucuucgucguc

SEQ ID NO: 20991 - RNA, 18 nt, Artificial Sequence
  derived and/or modified sequence opt2 from anti-HIV_CDR
auggacuggaccuggucc

SEQ ID NO: 20992 - RNA, 18 nt, Artificial Sequence
  derived and/or modified sequence opt2 from anti-HIV_CDR
auggacuggaccuggcgc

SEQ ID NO: 20993 - RNA, 18 nt, Artificial Sequence
  derived and/or modified sequence opt2 from anti-HIV_CDR
augaagcaccucugguuc

SEQ ID NO: 20994 - RNA, 18 nt, Artificial Sequence
  derived and/or modified sequence opt2 from anti-HIV_CDR
auggacuggaucuggcgc

SEQ ID NO: 20995 - RNA, 18 nt, Artificial Sequence
  derived and/or modified sequence opt2 from anti-HIV_CDR
auggacuggaccuggacc

SEQ ID NO: 20996 - RNA, 18 nt, Artificial Sequence
  derived and/or modified sequence opt2 from anti-HIV_CDR
augaagcaccucuuccuc

SEQ ID NO: 20997 - RNA, 18 nt, Artificial Sequence
  derived and/or modified sequence opt2 from anti-HIV_CDR
cagcuccuccaguccaac

SEQ ID NO: 20998 - RNA, 18 nt, Artificial Sequence
  derived and/or modified sequence opt2 from anti-HIV_CDR
ggcggcucccccgagcac

SEQ ID NO: 20999 - RNA, 18 nt, Artificial Sequence
  derived and/or modified sequence opt2 from anti-HIV_CDR
cucgagggcaccgacuac

SEQ ID NO: 21000 - RNA, 18 nt, Artificial Sequence
  derived and/or modified sequence opt2 from anti-HIV_CDR
cagcaguaccccuccacc

SEQ ID NO: 21001 - RNA, 21 nt, Artificial Sequence
  derived and/or modified sequence opt2 from anti-HIV_CDR
aacaaccacgaccgccccucc

SEQ ID NO: 21002 - RNA, 21 nt, Artificial Sequence
  derived and/or modified sequence opt2 from anti-HIV_CDR
aacaaccaggaccgccccgcc

SEQ ID NO: 21003 - RNA, 21 nt, Artificial Sequence
  derived and/or modified sequence opt2 from anti-HIV_CDR
aacaacaacgaccgccccucc

SEQ ID NO: 21004 - RNA, 21 nt, Artificial Sequence
  derived and/or modified sequence opt2 from anti-HIV_CDR
aacaaccaggaccgccccucc

SEQ ID NO: 21005 - RNA, 21 nt, Artificial Sequence
  derived and/or modified sequence opt2 from anti-HIV_CDR
gacgacuccgaccgccccucc

SEQ ID NO: 21006 - RNA, 21 nt, Artificial Sequence
  derived and/or modified sequence opt2 from anti-HIV_CDR
ugggccuccacccgccacacc

SEQ ID NO: 21007 - RNA, 21 nt, Artificial Sequence
  derived and/or modified sequence opt2 from anti-HIV_CDR
ggcgccaccgcccgcgacuuc

SEQ ID NO: 21008 - RNA, 21 nt, Artificial Sequence
  derived and/or modified sequence opt2 from anti-HIV_CDR
gccuccaucaagcucgcccuc

SEQ ID NO: 21009 - RNA, 21 nt, Artificial Sequence
  derived and/or modified sequence opt2 from anti-HIV_CDR
cagcaguacggccgcuccccc

SEQ ID NO: 21010 - RNA, 21 nt, Artificial Sequence
  derived and/or modified sequence opt2 from anti-HIV_CDR
cagcaguacuacaucuccccc

SEQ ID NO: 21011 - RNA, 21 nt, Artificial Sequence
  derived and/or modified sequence opt2 from anti-HIV_CDR
cagcagucccacucccccucc

SEQ ID NO: 21012 - RNA, 21 nt, Artificial Sequence
  derived and/or modified sequence opt2 from anti-HIV_CDR
ggccgcugcgcccgccgcugg

SEQ ID NO: 21013 - RNA, 21 nt, Artificial Sequence
  derived and/or modified sequence opt2 from anti-HIV_CDR
cgcuuccucuucgucgucgcc

SEQ ID NO: 21014 - RNA, 21 nt, Artificial Sequence
  derived and/or modified sequence opt2 from anti-HIV_CDR
auguccgucuccuuccucauc

SEQ ID NO: 21015 - RNA, 21 nt, Artificial Sequence
  derived and/or modified sequence opt2 from anti-HIV_CDR
ggcuccuccaaccgcugcccc

SEQ ID NO: 21016 - RNA, 21 nt, Artificial Sequence
  derived and/or modified sequence opt2 from anti-HIV_CDR
augaagcaccucugguucuuc

SEQ ID NO: 21017 - RNA, 21 nt, Artificial Sequence
  derived and/or modified sequence opt2 from anti-HIV_CDR
gccuccugggacuucgacuuc

SEQ ID NO: 21018 - RNA, 21 nt, Artificial Sequence
  derived and/or modified sequence opt2 from anti-HIV_CDR
gagaucggcgucgccgagcac

SEQ ID NO: 21019 - RNA, 21 nt, Artificial Sequence
  derived and/or modified sequence opt2 from anti-HIV_CDR
cagaaguacgacaccgccccc

SEQ ID NO: 21020 - RNA, 21 nt, Artificial Sequence
  derived and/or modified sequence opt2 from anti-HIV_CDR
cagcaguccuccuccaccccc

SEQ ID NO: 21021 - RNA, 21 nt, Artificial Sequence
  derived and/or modified sequence opt2 from anti-HIV_CDR
cagcaguccgccggcaccccc

SEQ ID NO: 21022 - RNA, 21 nt, Artificial Sequence
  derived and/or modified sequence opt2 from anti-HIV_CDR
cagcaguccuccuccaagccc

SEQ ID NO: 21023 - RNA, 21 nt, Artificial Sequence
  derived and/or modified sequence opt2 from anti-HIV_CDR
caggaguacaacaccuacacc

SEQ ID NO: 21024 - RNA, 21 nt, Artificial Sequence
  derived and/or modified sequence opt2 from anti-HIV_CDR
caggaguacaacaacuacaac

SEQ ID NO: 21025 - RNA, 21 nt, Artificial Sequence
  derived and/or modified sequence opt2 from anti-HIV_CDR
cacuacgacgcccucgacuac

SEQ ID NO: 21026 - RNA, 24 nt, Artificial Sequence
  derived and/or modified sequence opt2 from anti-HIV_CDR
gccaucuucaagggcguccagugc

SEQ ID NO: 21027 - RNA, 24 nt, Artificial Sequence
  derived and/or modified sequence opt2 from anti-HIV_CDR
ggcccccucggcgacuacgacuuc

SEQ ID NO: 21028 - RNA, 24 nt, Artificial Sequence
  derived and/or modified sequence opt2 from anti-HIV_CDR
cagcaguacggcuccucccuccgc

SEQ ID NO: 21029 - RNA, 24 nt, Artificial Sequence
  derived and/or modified sequence opt2 from anti-HIV_CDR
cagcaguacucccacuaccgcacc

SEQ ID NO: 21030 - RNA, 24 nt, Artificial Sequence
  derived and/or modified sequence opt2 from anti-HIV_CDR
caguacuacggcauguccgucacc

SEQ ID NO: 21031 - RNA, 24 nt, Artificial Sequence
  derived and/or modified sequence opt2 from anti-HIV_CDR
cagcaguacgagaacuggcucacc

SEQ ID NO: 21032 - RNA, 24 nt, Artificial Sequence
  derived and/or modified sequence opt2 from anti-HIV_CDR
uccggcguccacuacauggacguc

SEQ ID NO: 21033 - RNA, 24 nt, Artificial Sequence
  derived and/or modified sequence opt2 from anti-HIV_CDR
cagcaguacuccggcccccucacc

SEQ ID NO: 21034 - RNA, 24 nt, Artificial Sequence
  derived and/or modified sequence opt2 from anti-HIV_CDR
cagcaguacuacaccguccccucc

SEQ ID NO: 21035 - RNA, 24 nt, Artificial Sequence
  derived and/or modified sequence opt2 from anti-HIV_CDR
cagcaguacggcuccuccaucacc

SEQ ID NO: 21036 - RNA, 24 nt, Artificial Sequence
  derived and/or modified sequence opt2 from anti-HIV_CDR
caccaguacaacaagugggacacc

SEQ ID NO: 21037 - RNA, 24 nt, Artificial Sequence
  derived and/or modified sequence opt2 from anti-HIV_CDR
cagcaguccuacaccaccccccuc

SEQ ID NO: 21038 - RNA, 24 nt, Artificial Sequence
  derived and/or modified sequence opt2 from anti-HIV_CDR
cagcgcugggagaccaucgacuac

SEQ ID NO: 21039 - RNA, 24 nt, Artificial Sequence
  derived and/or modified sequence opt2 from anti-HIV_CDR
ugcuccuacgccggcuccuacacc

SEQ ID NO: 21040 - RNA, 24 nt, Artificial Sequence
  derived and/or modified sequence opt2 from anti-HIV_CDR
cagcaguacgacaaccuccccacc

SEQ ID NO: 21041 - RNA, 24 nt, Artificial Sequence
  derived and/or modified sequence opt2 from anti-HIV_CDR
cagcagugcacccucccccucacc

SEQ ID NO: 21042 - RNA, 24 nt, Artificial Sequence
  derived and/or modified sequence opt2 from anti-HIV_CDR
cagcaguccuacuccuccgucacc

SEQ ID NO: 21043 - RNA, 24 nt, Artificial Sequence
  derived and/or modified sequence opt2 from anti-HIV_CDR
cagcagucccacaccuccgucacc

SEQ ID NO: 21044 - RNA, 24 nt, Artificial Sequence
  derived and/or modified sequence opt2 from anti-HIV_CDR
cagcagaccuacgccuccgucacc

SEQ ID NO: 21045 - RNA, 24 nt, Artificial Sequence
  derived and/or modified sequence opt2 from anti-HIV_CDR
cagcaguacaacuccgacuacacc

SEQ ID NO: 21046 - RNA, 24 nt, Artificial Sequence
  derived and/or modified sequence opt2 from anti-HIV_CDR
caccucuacgucucccgccccguc

SEQ ID NO: 21047 - RNA, 24 nt, Artificial Sequence
  derived and/or modified sequence opt2 from anti-HIV_CDR
cagcaguacggccgcuccccccuc

SEQ ID NO: 21048 - RNA, 24 nt, Artificial Sequence
  derived and/or modified sequence opt2 from anti-HIV_CDR
cagcaguacggcuccuccccccuc

SEQ ID NO: 21049 - RNA, 24 nt, Artificial Sequence
  derived and/or modified sequence opt2 from anti-HIV_CDR
cagcaguacaacgacuggcccgcc

SEQ ID NO: 21050 - RNA, 24 nt, Artificial Sequence
  derived and/or modified sequence opt2 from anti-HIV_CDR
caccaguacggcuccucccagcgc

SEQ ID NO: 21051 - RNA, 24 nt, Artificial Sequence
  derived and/or modified sequence opt2 from anti-HIV_CDR
cagcagaccuacuccuccgucacc

SEQ ID NO: 21052 - RNA, 24 nt, Artificial Sequence
  derived and/or modified sequence opt2 from anti-HIV_CDR
cagcagaccuaccgcuccgucacc

SEQ ID NO: 21053 - RNA, 24 nt, Artificial Sequence
  derived and/or modified sequence opt2 from anti-HIV_CDR
cagcaguacggcuccuccuggacc

SEQ ID NO: 21054 - RNA, 24 nt, Artificial Sequence
  derived and/or modified sequence opt2 from anti-HIV_CDR
uccuccuacgccggcaucaacaac

SEQ ID NO: 21055 - RNA, 24 nt, Artificial Sequence
  derived and/or modified sequence opt2 from anti-HIV_CDR
cagaaguacggcuccucccucacc

SEQ ID NO: 21056 - RNA, 24 nt, Artificial Sequence
  derived and/or modified sequence opt2 from anti-HIV_CDR
augcaggcccucgagacccucggc

SEQ ID NO: 21057 - RNA, 24 nt, Artificial Sequence
  derived and/or modified sequence opt2 from anti-HIV_CDR
cagcaguacgccggcucccucacc

SEQ ID NO: 21058 - RNA, 24 nt, Artificial Sequence
  derived and/or modified sequence opt2 from anti-HIV_CDR
cgcaacuggggcaacuucgaccac

SEQ ID NO: 21059 - RNA, 27 nt, Artificial Sequence
  derived and/or modified sequence opt2 from anti-HIV_CDR
cagcagcacuacaccacccccuggacc

SEQ ID NO: 21060 - RNA, 27 nt, Artificial Sequence
  derived and/or modified sequence opt2 from anti-HIV_CDR
cagcaguccuucgccguccccuacacc

SEQ ID NO: 21061 - RNA, 27 nt, Artificial Sequence
  derived and/or modified sequence opt2 from anti-HIV_CDR
cagcaguacaaguccuacuccggcacc

SEQ ID NO: 21062 - RNA, 27 nt, Artificial Sequence
  derived and/or modified sequence opt2 from anti-HIV_CDR
caccaguacgccuacuccccccgcacc

SEQ ID NO: 21063 - RNA, 27 nt, Artificial Sequence
  derived and/or modified sequence opt2 from anti-HIV_CDR
cagcaguacaacuccuucccccccacc

SEQ ID NO: 21064 - RNA, 27 nt, Artificial Sequence
  derived and/or modified sequence opt2 from anti-HIV_CDR
cagcagaccuacuccaacccccgcaug

SEQ ID NO: 21065 - RNA, 27 nt, Artificial Sequence
  derived and/or modified sequence opt2 from anti-HIV_CDR
cagcaguacgaggacccccccuggacc

SEQ ID NO: 21066 - RNA, 27 nt, Artificial Sequence
  derived and/or modified sequence opt2 from anti-HIV_CDR
caccaguacuucaacaccccccgcacc

SEQ ID NO: 21067 - RNA, 27 nt, Artificial Sequence
  derived and/or modified sequence opt2 from anti-HIV_CDR
caccaguacuucuccaccccccgcacc

SEQ ID NO: 21068 - RNA, 27 nt, Artificial Sequence
  derived and/or modified sequence opt2 from anti-HIV_CDR
cagcaccgcuccaacuggcccuggacc

SEQ ID NO: 21069 - RNA, 27 nt, Artificial Sequence
  derived and/or modified sequence opt2 from anti-HIV_CDR
cgcggccgccgccagaucggcgacuac

SEQ ID NO: 21070 - RNA, 27 nt, Artificial Sequence
  derived and/or modified sequence opt2 from anti-HIV_CDR
cagcaguacggccucucccccuggacc

SEQ ID NO: 21071 - RNA, 27 nt, Artificial Sequence
  derived and/or modified sequence opt2 from anti-HIV_CDR
cagcagaccuacaccucccccaucacc

SEQ ID NO: 21072 - RNA, 27 nt, Artificial Sequence
  derived and/or modified sequence opt2 from anti-HIV_CDR
cagcaguacggcuccuccccccccacc

SEQ ID NO: 21073 - RNA, 27 nt, Artificial Sequence
  derived and/or modified sequence opt2 from anti-HIV_CDR
cagcaguacggcaccuccuccugcacc

SEQ ID NO: 21074 - RNA, 27 nt, Artificial Sequence
  derived and/or modified sequence opt2 from anti-HIV_CDR
cagcaguacgacgacgcccccaucacc

SEQ ID NO: 21075 - RNA, 27 nt, Artificial Sequence
  derived and/or modified sequence opt2 from anti-HIV_CDR
ggcccccuccuccgcuaccucgacucc

SEQ ID NO: 21076 - RNA, 27 nt, Artificial Sequence
  derived and/or modified sequence opt2 from anti-HIV_CDR
ugccucaagaagaccuccuccuacguc

SEQ ID NO: 21077 - RNA, 27 nt, Artificial Sequence
  derived and/or modified sequence opt2 from anti-HIV_CDR
cagcaguacaaccacuggccccagacc

SEQ ID NO: 21078 - RNA, 27 nt, Artificial Sequence
  derived and/or modified sequence opt2 from anti-HIV_CDR
cagcaguacuccaaccuccccuacacc

SEQ ID NO: 21079 - RNA, 27 nt, Artificial Sequence
  derived and/or modified sequence opt2 from anti-HIV_CDR
cagcaguacgacaccuaccccggcacc

SEQ ID NO: 21080 - RNA, 27 nt, Artificial Sequence
  derived and/or modified sequence opt2 from anti-HIV_CDR
caggaguacuccuccacccccuacaac

SEQ ID NO: 21081 - RNA, 27 nt, Artificial Sequence
  derived and/or modified sequence opt2 from anti-HIV_CDR
ggcgccugggacgacacccucuacguc

SEQ ID NO: 21082 - RNA, 27 nt, Artificial Sequence
  derived and/or modified sequence opt2 from anti-HIV_CDR
gccgccugggacgacacccucuacguc

SEQ ID NO: 21083 - RNA, 27 nt, Artificial Sequence
  derived and/or modified sequence opt2 from anti-HIV_CDR
cagcaguacuacuccgacuccaucacc

SEQ ID NO: 21084 - RNA, 27 nt, Artificial Sequence
  derived and/or modified sequence opt2 from anti-HIV_CDR
cagcaguacggccgcucccccuacacc

SEQ ID NO: 21085 - RNA, 27 nt, Artificial Sequence
  derived and/or modified sequence opt2 from anti-HIV_CDR
cagcaguacaccaacuaccccuggacc

SEQ ID NO: 21086 - RNA, 27 nt, Artificial Sequence
  derived and/or modified sequence opt2 from anti-HIV_CDR
cagcagcgccacaacuggcccaucucc

SEQ ID NO: 21087 - RNA, 27 nt, Artificial Sequence
  derived and/or modified sequence opt2 from anti-HIV_CDR
cagcaguaccacaacuggccccgcacc

SEQ ID NO: 21088 - RNA, 27 nt, Artificial Sequence
  derived and/or modified sequence opt2 from anti-HIV_CDR
cagcagcgcuccaccuggccccccacc

SEQ ID NO: 21089 - RNA, 27 nt, Artificial Sequence
  derived and/or modified sequence opt2 from anti-HIV_CDR
cagcaguacgacuccuucuccuggacc

SEQ ID NO: 21090 - RNA, 27 nt, Artificial Sequence
  derived and/or modified sequence opt2 from anti-HIV_CDR
cagcaguacaacaaccuccccgucacc

SEQ ID NO: 21091 - RNA, 27 nt, Artificial Sequence
  derived and/or modified sequence opt2 from anti-HIV_CDR
cagcaguacaaccgcuacuccuacacc

SEQ ID NO: 21092 - RNA, 27 nt, Artificial Sequence
  derived and/or modified sequence opt2 from anti-HIV_CDR
caggaguacuacauccuccccugcucc

SEQ ID NO: 21093 - RNA, 27 nt, Artificial Sequence
  derived and/or modified sequence opt2 from anti-HIV_CDR
cagcaguacgacaaccuccucgcccac

SEQ ID NO: 21094 - RNA, 27 nt, Artificial Sequence
  derived and/or modified sequence opt2 from anti-HIV_CDR
caccagugcgacaaccucaucgcccgc

SEQ ID NO: 21095 - RNA, 27 nt, Artificial Sequence
  derived and/or modified sequence opt2 from anti-HIV_CDR
cagcaguccuucuccacccucuggacc

SEQ ID NO: 21096 - RNA, 27 nt, Artificial Sequence
  derived and/or modified sequence opt2 from anti-HIV_CDR
caccaguccuacuccaccccccccacc

SEQ ID NO: 21097 - RNA, 27 nt, Artificial Sequence
  derived and/or modified sequence opt2 from anti-HIV_CDR
cagcagggcuacuccacccccuggacc

SEQ ID NO: 21098 - RNA, 27 nt, Artificial Sequence
  derived and/or modified sequence opt2 from anti-HIV_CDR
cagcaguacuccaccaccccccgcacc

SEQ ID NO: 21099 - RNA, 27 nt, Artificial Sequence
  derived and/or modified sequence opt2 from anti-HIV_CDR
cagcucuacaacuccgucccccagacc

SEQ ID NO: 21100 - RNA, 27 nt, Artificial Sequence
  derived and/or modified sequence opt2 from anti-HIV_CDR
cagcagcgcaccuccuggccccagacc

SEQ ID NO: 21101 - RNA, 27 nt, Artificial Sequence
  derived and/or modified sequence opt2 from anti-HIV_CDR
cagcaguucaacaccuacucccagacc

SEQ ID NO: 21102 - RNA, 27 nt, Artificial Sequence
  derived and/or modified sequence opt2 from anti-HIV_CDR
augcagucccuccagacccccaucacc

SEQ ID NO: 21103 - RNA, 27 nt, Artificial Sequence
  derived and/or modified sequence opt2 from anti-HIV_CDR
cagcaguacaacuccuacccccucacc

SEQ ID NO: 21104 - RNA, 27 nt, Artificial Sequence
  derived and/or modified sequence opt2 from anti-HIV_CDR
cagcaguacaacuccuacuccggcacc

SEQ ID NO: 21105 - RNA, 27 nt, Artificial Sequence
  derived and/or modified sequence opt2 from anti-HIV_CDR
caguccuacgacuccucccucuccggc

SEQ ID NO: 21106 - RNA, 27 nt, Artificial Sequence
  derived and/or modified sequence opt2 from anti-HIV_CDR
ucccagggcaacaccgccaucgacuac

SEQ ID NO: 21107 - RNA, 27 nt, Artificial Sequence
  derived and/or modified sequence opt2 from anti-HIV_CDR
gaggagccccgcgacgccuucgaccuc

SEQ ID NO: 21108 - RNA, 27 nt, Artificial Sequence
  derived and/or modified sequence opt2 from anti-HIV_CDR
cagcaguccuacaccacccccgucacc

SEQ ID NO: 21109 - RNA, 27 nt, Artificial Sequence
  derived and/or modified sequence opt2 from anti-HIV_CDR
gccggccgcgagggcugguucgacccc

SEQ ID NO: 21110 - RNA, 27 nt, Artificial Sequence
  derived and/or modified sequence opt2 from anti-HIV_CDR
cagcaguacuacuccaccccccacacc

SEQ ID NO: 21111 - RNA, 27 nt, Artificial Sequence
  derived and/or modified sequence opt2 from anti-HIV_CDR
cagcaguccuacuccaucgccggcacc

SEQ ID NO: 21112 - RNA, 27 nt, Artificial Sequence
  derived and/or modified sequence opt2 from anti-HIV_CDR
cagaacuacaacaagcccccccgcacc

SEQ ID NO: 21113 - RNA, 27 nt, Artificial Sequence
  derived and/or modified sequence opt2 from anti-HIV_CDR
augcaguccauccagcucccccucacc

SEQ ID NO: 21114 - RNA, 27 nt, Artificial Sequence
  derived and/or modified sequence opt2 from anti-HIV_CDR
augcaggcccuccagaccucccucacc

SEQ ID NO: 21115 - RNA, 27 nt, Artificial Sequence
  derived and/or modified sequence opt2 from anti-HIV_CDR
cagcaguacuccuccuccccccgcacc

SEQ ID NO: 21116 - RNA, 27 nt, Artificial Sequence
  derived and/or modified sequence opt2 from anti-HIV_CDR
caggccugggacuccuccaccgccguc

SEQ ID NO: 21117 - RNA, 27 nt, Artificial Sequence
  derived and/or modified sequence opt2 from anti-HIV_CDR
cagcacuacaacaacuggcccuacacc

SEQ ID NO: 21118 - RNA, 27 nt, Artificial Sequence
  derived and/or modified sequence opt2 from anti-HIV_CDR
cagcaguacgaccgccuccccaucacc

SEQ ID NO: 21119 - RNA, 27 nt, Artificial Sequence
  derived and/or modified sequence opt2 from anti-HIV_CDR
cagcaguacggcuccucccccaucacc

SEQ ID NO: 21120 - RNA, 27 nt, Artificial Sequence
  derived and/or modified sequence opt2 from anti-HIV_CDR
cagcaguacgacgucuggccccucacc

SEQ ID NO: 21121 - RNA, 27 nt, Artificial Sequence
  derived and/or modified sequence opt2 from anti-HIV_CDR
caccaguacgccuccuccccccgcacc

SEQ ID NO: 21122 - RNA, 27 nt, Artificial Sequence
  derived and/or modified sequence opt2 from anti-HIV_CDR
augcagucccuccaccuccccuacacc

SEQ ID NO: 21123 - RNA, 27 nt, Artificial Sequence
  derived and/or modified sequence opt2 from anti-HIV_CDR
cagcaguacuacuccuccccccucacc

SEQ ID NO: 21124 - RNA, 27 nt, Artificial Sequence
  derived and/or modified sequence opt2 from anti-HIV_CDR
cagcagcacgacaccuuccccuucacc

SEQ ID NO: 21125 - RNA, 27 nt, Artificial Sequence
  derived and/or modified sequence opt2 from anti-HIV_CDR
cagcaguccuacuccacccccuacacc

SEQ ID NO: 21126 - RNA, 27 nt, Artificial Sequence
  derived and/or modified sequence opt2 from anti-HIV_CDR
cagcaguacaagaccuaccccgucacc

SEQ ID NO: 21127 - RNA, 27 nt, Artificial Sequence
  derived and/or modified sequence opt2 from anti-HIV_CDR
cagcaguacuacuccacccccgucacc

SEQ ID NO: 21128 - RNA, 27 nt, Artificial Sequence
  derived and/or modified sequence opt2 from anti-HIV_CDR
cagcaguacaacuggccccccuucacc

SEQ ID NO: 21129 - RNA, 27 nt, Artificial Sequence
  derived and/or modified sequence opt2 from anti-HIV_CDR
augcagggcacccacuggcccuggacc

SEQ ID NO: 21130 - RNA, 27 nt, Artificial Sequence
  derived and/or modified sequence opt2 from anti-HIV_CDR
caccagugcggcuccuccccccgcacc

SEQ ID NO: 21131 - RNA, 27 nt, Artificial Sequence
  derived and/or modified sequence opt2 from anti-HIV_CDR
cagcaguacaacuccuacuuccgcacc

SEQ ID NO: 21132 - RNA, 27 nt, Artificial Sequence
  derived and/or modified sequence opt2 from anti-HIV_CDR
cagcaguaccacaacuggccccccucc

SEQ ID NO: 21133 - RNA, 27 nt, Artificial Sequence
  derived and/or modified sequence opt2 from anti-HIV_CDR
augcagggcaccuacuggcucuggacc

SEQ ID NO: 21134 - RNA, 27 nt, Artificial Sequence
  derived and/or modified sequence opt2 from anti-HIV_CDR
cagcagggcuucuccgcccccuucacc

SEQ ID NO: 21135 - RNA, 27 nt, Artificial Sequence
  derived and/or modified sequence opt2 from anti-HIV_CDR
cagcaguacaacaccuacccccucacc

SEQ ID NO: 21136 - RNA, 27 nt, Artificial Sequence
  derived and/or modified sequence opt2 from anti-HIV_CDR
augcagggcacccacuggccccgcacc

SEQ ID NO: 21137 - RNA, 27 nt, Artificial Sequence
  derived and/or modified sequence opt2 from anti-HIV_CDR
uucggccgcacccccugguucgacccc

SEQ ID NO: 21138 - RNA, 27 nt, Artificial Sequence
  derived and/or modified sequence opt2 from anti-HIV_CDR
cagcaguacuucaccuccgucaucacc

SEQ ID NO: 21139 - RNA, 27 nt, Artificial Sequence
  derived and/or modified sequence opt2 from anti-HIV_CDR
caccacuacauguccgaccuccagacc

SEQ ID NO: 21140 - RNA, 27 nt, Artificial Sequence
  derived and/or modified sequence opt2 from anti-HIV_CDR
caccacuacuccuccuccucccacacc

SEQ ID NO: 21141 - RNA, 27 nt, Artificial Sequence
  derived and/or modified sequence opt2 from anti-HIV_CDR
caccacuacaaguccgacugccagacc

SEQ ID NO: 21142 - RNA, 27 nt, Artificial Sequence
  derived and/or modified sequence opt2 from anti-HIV_CDR
cagcaccgcuccuccuggccccucacc

SEQ ID NO: 21143 - RNA, 27 nt, Artificial Sequence
  derived and/or modified sequence opt2 from anti-HIV_CDR
cuccagcaccacuccuaccccuggacc

SEQ ID NO: 21144 - RNA, 27 nt, Artificial Sequence
  derived and/or modified sequence opt2 from anti-HIV_CDR
cagcaguacggcaccucccccggcacc

SEQ ID NO: 21145 - RNA, 27 nt, Artificial Sequence
  derived and/or modified sequence opt2 from anti-HIV_CDR
cagcaguacggcuccucccccaccacc

SEQ ID NO: 21146 - RNA, 27 nt, Artificial Sequence
  derived and/or modified sequence opt2 from anti-HIV_CDR
cagcaguacggcaccucccccaccacc

SEQ ID NO: 21147 - RNA, 27 nt, Artificial Sequence
  derived and/or modified sequence opt2 from anti-HIV_CDR
augcaggccacccacuggccccccggc

SEQ ID NO: 21148 - RNA, 27 nt, Artificial Sequence
  derived and/or modified sequence opt2 from anti-HIV_CDR
cagcgcuacaaccgcgaccccuacauc

SEQ ID NO: 21149 - RNA, 27 nt, Artificial Sequence
  derived and/or modified sequence opt2 from anti-HIV_CDR
cagcaguacgacaaccucccccucgcc

SEQ ID NO: 21150 - RNA, 27 nt, Artificial Sequence
  derived and/or modified sequence opt2 from anti-HIV_CDR
uccuccuacuccgccaccggcgucgcc

SEQ ID NO: 21151 - RNA, 27 nt, Artificial Sequence
  derived and/or modified sequence opt2 from anti-HIV_CDR
cagcacuacggcaacucccgcuggacc

SEQ ID NO: 21152 - RNA, 27 nt, Artificial Sequence
  derived and/or modified sequence opt2 from anti-HIV_CDR
cagcaguacgagaccuaccccuggacc

SEQ ID NO: 21153 - RNA, 27 nt, Artificial Sequence
  derived and/or modified sequence opt2 from anti-HIV_CDR
cagcaguacggcuccucccccuccacc

SEQ ID NO: 21154 - RNA, 27 nt, Artificial Sequence
  derived and/or modified sequence opt2 from anti-HIV_CDR
cagcagucccagcgcaccccccacacc

SEQ ID NO: 21155 - RNA, 27 nt, Artificial Sequence
  derived and/or modified sequence opt2 from anti-HIV_CDR
cagcaguacgacauccucccccucacc

SEQ ID NO: 21156 - RNA, 27 nt, Artificial Sequence
  derived and/or modified sequence opt2 from anti-HIV_CDR
cagcaguccaacuccucccccuggacc

SEQ ID NO: 21157 - RNA, 27 nt, Artificial Sequence
  derived and/or modified sequence opt2 from anti-HIV_CDR
cagcaguccuacgacaccccccgcacc

SEQ ID NO: 21158 - RNA, 27 nt, Artificial Sequence
  derived and/or modified sequence opt2 from anti-HIV_CDR
cagcaguucggcuccucccccggcacc

SEQ ID NO: 21159 - RNA, 27 nt, Artificial Sequence
  derived and/or modified sequence opt2 from anti-HIV_CDR
caccaguacggcuccuccccccagacc

SEQ ID NO: 21160 - RNA, 27 nt, Artificial Sequence
  derived and/or modified sequence opt2 from anti-HIV_CDR
caccaguacggcuccuccccccagucc

SEQ ID NO: 21161 - RNA, 27 nt, Artificial Sequence
  derived and/or modified sequence opt2 from anti-HIV_CDR
cuccagcacaacuccuacccccucacc

SEQ ID NO: 21162 - RNA, 27 nt, Artificial Sequence
  derived and/or modified sequence opt2 from anti-HIV_CDR
cagcaguacaacgacuggcccaucacc

SEQ ID NO: 21163 - RNA, 27 nt, Artificial Sequence
  derived and/or modified sequence opt2 from anti-HIV_CDR
cagcagaccuucaccuuccccuacacc

SEQ ID NO: 21164 - RNA, 27 nt, Artificial Sequence
  derived and/or modified sequence opt2 from anti-HIV_CDR
cagcaguccuacaccuuccccuacauc

SEQ ID NO: 21165 - RNA, 27 nt, Artificial Sequence
  derived and/or modified sequence opt2 from anti-HIV_CDR
caguacuacggcuccucccccuacacc

SEQ ID NO: 21166 - RNA, 27 nt, Artificial Sequence
  derived and/or modified sequence opt2 from anti-HIV_CDR
cagcaguccuucggcaccccccgcacc

SEQ ID NO: 21167 - RNA, 27 nt, Artificial Sequence
  derived and/or modified sequence opt2 from anti-HIV_CDR
cagcaguacaacgacuggccccgcacc

SEQ ID NO: 21168 - RNA, 27 nt, Artificial Sequence
  derived and/or modified sequence opt2 from anti-HIV_CDR
cagcaguacggcuccuccccccgcacc

SEQ ID NO: 21169 - RNA, 27 nt, Artificial Sequence
  derived and/or modified sequence opt2 from anti-HIV_CDR
cuccagcacaaccgcuaccccuggacc

SEQ ID NO: 21170 - RNA, 27 nt, Artificial Sequence
  derived and/or modified sequence opt2 from anti-HIV_CDR
cuccagcacaacaacuaccccuggacc

SEQ ID NO: 21171 - RNA, 27 nt, Artificial Sequence
  derived and/or modified sequence opt2 from anti-HIV_CDR
cuccaguacuccaccuacccccucacc

SEQ ID NO: 21172 - RNA, 27 nt, Artificial Sequence
  derived and/or modified sequence opt2 from anti-HIV_CDR
cuccaguacaacgccuacccccucacc

SEQ ID NO: 21173 - RNA, 27 nt, Artificial Sequence
  derived and/or modified sequence opt2 from anti-HIV_CDR
cagcaguacgacuccgcccccgucacc

SEQ ID NO: 21174 - RNA, 27 nt, Artificial Sequence
  derived and/or modified sequence opt2 from anti-HIV_CDR
cagcagaccuacaccuuccccuacucc

SEQ ID NO: 21175 - RNA, 27 nt, Artificial Sequence
  derived and/or modified sequence opt2 from anti-HIV_CDR
ggcuacgacaacuccggccccgacuac

SEQ ID NO: 21176 - RNA, 27 nt, Artificial Sequence
  derived and/or modified sequence opt2 from anti-HIV_CDR
cagcaguacaacaacuggccccccgcc

SEQ ID NO: 21177 - RNA, 27 nt, Artificial Sequence
  derived and/or modified sequence opt2 from anti-HIV_CDR
caccaguacgcccucucccccuggacc

SEQ ID NO: 21178 - RNA, 27 nt, Artificial Sequence
  derived and/or modified sequence opt2 from anti-HIV_CDR
cagaaguacgacaccgaccccaugacc

SEQ ID NO: 21179 - RNA, 27 nt, Artificial Sequence
  derived and/or modified sequence opt2 from anti-HIV_CDR
cagcaguacaacuacuaccccaucacc

SEQ ID NO: 21180 - RNA, 27 nt, Artificial Sequence
  derived and/or modified sequence opt2 from anti-HIV_CDR
cagcagaccuucaccgaccccgucacc

SEQ ID NO: 21181 - RNA, 27 nt, Artificial Sequence
  derived and/or modified sequence opt2 from anti-HIV_CDR
gccgccugggacgacucccuccacguc

SEQ ID NO: 21182 - RNA, 27 nt, Artificial Sequence
  derived and/or modified sequence opt2 from anti-HIV_CDR
cagcaguacgccuccucccccuucacc

SEQ ID NO: 21183 - RNA, 27 nt, Artificial Sequence
  derived and/or modified sequence opt2 from anti-HIV_CDR
cagcaguccuccuccacccccuucacc

SEQ ID NO: 21184 - RNA, 27 nt, Artificial Sequence
  derived and/or modified sequence opt2 from anti-HIV_CDR
cagcagcgcuccaacugggccaucacc

SEQ ID NO: 21185 - RNA, 27 nt, Artificial Sequence
  derived and/or modified sequence opt2 from anti-HIV_CDR
cagcaguacggcuccucccccuucacc

SEQ ID NO: 21186 - RNA, 27 nt, Artificial Sequence
  derived and/or modified sequence opt2 from anti-HIV_CDR
cagaaguacaacggcgcccccuggacc

SEQ ID NO: 21187 - RNA, 27 nt, Artificial Sequence
  derived and/or modified sequence opt2 from anti-HIV_CDR
cagaaguacaacaacgcccccuggacc

SEQ ID NO: 21188 - RNA, 27 nt, Artificial Sequence
  derived and/or modified sequence opt2 from anti-HIV_CDR
cagcagcgcgucaacuggccccccaac

SEQ ID NO: 21189 - RNA, 27 nt, Artificial Sequence
  derived and/or modified sequence opt2 from anti-HIV_CDR
cagcagcgcggccacuggccccucacc

SEQ ID NO: 21190 - RNA, 27 nt, Artificial Sequence
  derived and/or modified sequence opt2 from anti-HIV_CDR
cagcaguaccgcuacuccgucaucauc

SEQ ID NO: 21191 - RNA, 27 nt, Artificial Sequence
  derived and/or modified sequence opt2 from anti-HIV_CDR
cagcaguccggcaccucccuccucacc

SEQ ID NO: 21192 - RNA, 27 nt, Artificial Sequence
  derived and/or modified sequence opt2 from anti-HIV_CDR
augaagucccagcacuccccccgcacc

SEQ ID NO: 21193 - RNA, 27 nt, Artificial Sequence
  derived and/or modified sequence opt2 from anti-HIV_CDR
augcagccccuccagacccccuacacc

SEQ ID NO: 21194 - RNA, 27 nt, Artificial Sequence
  derived and/or modified sequence opt2 from anti-HIV_CDR
cagcaguacaccgccuaccccuggacc

SEQ ID NO: 21195 - RNA, 27 nt, Artificial Sequence
  derived and/or modified sequence opt2 from anti-HIV_CDR
cuccagaaccacaacuacccccgcacc

SEQ ID NO: 21196 - RNA, 27 nt, Artificial Sequence
  derived and/or modified sequence opt2 from anti-HIV_CDR
cuccagacccacuccuacccccgcacc

SEQ ID NO: 21197 - RNA, 30 nt, Artificial Sequence
  derived and/or modified sequence opt2 from anti-HIV_CDR
gccgccugggacgacuccuucgacuacguc

SEQ ID NO: 21198 - RNA, 30 nt, Artificial Sequence
  derived and/or modified sequence opt2 from anti-HIV_CDR
cagcacuccuucggcuccccccccuggacc

SEQ ID NO: 21199 - RNA, 30 nt, Artificial Sequence
  derived and/or modified sequence opt2 from anti-HIV_CDR
uccuccuucacccccaccaacacccucguc

SEQ ID NO: 21200 - RNA, 30 nt, Artificial Sequence
  derived and/or modified sequence opt2 from anti-HIV_CDR
cagcaguacggcacccuccacccccgcacc

SEQ ID NO: 21201 - RNA, 30 nt, Artificial Sequence
  derived and/or modified sequence opt2 from anti-HIV_CDR
cagcaguacaacaacuggccccccaucacc

SEQ ID NO: 21202 - RNA, 30 nt, Artificial Sequence
  derived and/or modified sequence opt2 from anti-HIV_CDR
cagcaguacuaccaguggcucuccuacacc

SEQ ID NO: 21203 - RNA, 30 nt, Artificial Sequence
  derived and/or modified sequence opt2 from anti-HIV_CDR
cagcagcgcgccaacuggcgccuccucacc

SEQ ID NO: 21204 - RNA, 30 nt, Artificial Sequence
  derived and/or modified sequence opt2 from anti-HIV_CDR
cgccacuccgacuacugcgaccucgacguc

SEQ ID NO: 21205 - RNA, 30 nt, Artificial Sequence
  derived and/or modified sequence opt2 from anti-HIV_CDR
cgccgcuccgacuacugcgacuucgacguc

SEQ ID NO: 21206 - RNA, 30 nt, Artificial Sequence
  derived and/or modified sequence opt2 from anti-HIV_CDR
cgccacaccgacuacugcgacuucgacguc

SEQ ID NO: 21207 - RNA, 30 nt, Artificial Sequence
  derived and/or modified sequence opt2 from anti-HIV_CDR
cagcgcuccgacuacugggacuucgacguc

SEQ ID NO: 21208 - RNA, 30 nt, Artificial Sequence
  derived and/or modified sequence opt2 from anti-HIV_CDR
cgccacuccgacuacugcgacuucgacauc

SEQ ID NO: 21209 - RNA, 30 nt, Artificial Sequence
  derived and/or modified sequence opt2 from anti-HIV_CDR
ugcgaggucgacgccgacgagaccaucacc

SEQ ID NO: 21210 - RNA, 30 nt, Artificial Sequence
  derived and/or modified sequence opt2 from anti-HIV_CDR
ugcgaggucgacgccgaggagaccaucauc

SEQ ID NO: 21211 - RNA, 30 nt, Artificial Sequence
  derived and/or modified sequence opt2 from anti-HIV_CDR
cagcgcuccgacuucugggacuucgacguc

SEQ ID NO: 21212 - RNA, 30 nt, Artificial Sequence
  derived and/or modified sequence opt2 from anti-HIV_CDR
cgccacuccgacuacugcgacuucgacguc

SEQ ID NO: 21213 - RNA, 30 nt, Artificial Sequence
  derived and/or modified sequence opt2 from anti-HIV_CDR
ugcuccuacgccggcggccgcaccgucguc

SEQ ID NO: 21214 - RNA, 30 nt, Artificial Sequence
  derived and/or modified sequence opt2 from anti-HIV_CDR
gccgccugggacgacucccucgacuacguc

SEQ ID NO: 21215 - RNA, 30 nt, Artificial Sequence
  derived and/or modified sequence opt2 from anti-HIV_CDR
cagcagcgcuccaacuggccccgccucacc

SEQ ID NO: 21216 - RNA, 30 nt, Artificial Sequence
  derived and/or modified sequence opt2 from anti-HIV_CDR
cagcaguacaacaacuggccccccuucacc

SEQ ID NO: 21217 - RNA, 30 nt, Artificial Sequence
  derived and/or modified sequence opt2 from anti-HIV_CDR
augcagggcaccuacuggcccccccucacc

SEQ ID NO: 21218 - RNA, 30 nt, Artificial Sequence
  derived and/or modified sequence opt2 from anti-HIV_CDR
cagcaguacggcuccucccuccucuacacc

SEQ ID NO: 21219 - RNA, 30 nt, Artificial Sequence
  derived and/or modified sequence opt2 from anti-HIV_CDR
cagcaguccuucggcaucccccccuggacc

SEQ ID NO: 21220 - RNA, 30 nt, Artificial Sequence
  derived and/or modified sequence opt2 from anti-HIV_CDR
ugcuccuacgccggcuccuacuccuacguc

SEQ ID NO: 21221 - RNA, 30 nt, Artificial Sequence
  derived and/or modified sequence opt2 from anti-HIV_CDR
uacuccuacgccggcaacucccucggcguc

SEQ ID NO: 21222 - RNA, 30 nt, Artificial Sequence
  derived and/or modified sequence opt2 from anti-HIV_CDR
uccuccuacaccaucuccuccccccgcguc

SEQ ID NO: 21223 - RNA, 30 nt, Artificial Sequence
  derived and/or modified sequence opt2 from anti-HIV_CDR
caggagugggagcuccagcccuucgacuac

SEQ ID NO: 21224 - RNA, 30 nt, Artificial Sequence
  derived and/or modified sequence opt2 from anti-HIV_CDR
cucauccccgucuccggcgccuucgacguc

SEQ ID NO: 21225 - RNA, 30 nt, Artificial Sequence; identical to SEQ ID NO: 13583
  derived and/or modified sequence opt2 from anti-HIV_CDR

SEQ ID NO: 21226 - RNA, 30 nt, Artificial Sequence
  derived and/or modified sequence opt2 from anti-HIV_CDR
caggaguacggccgcuccccccccuucccc

SEQ ID NO: 21227 - RNA, 30 nt, Artificial Sequence
  derived and/or modified sequence opt2 from anti-HIV_CDR
acccucgacggcaacuuccacugggacuuc

SEQ ID NO: 21228 - RNA, 30 nt, Artificial Sequence
  derived and/or modified sequence opt2 from anti-HIV_CDR
uucacccagcgccagggcggcuucgacuac

SEQ ID NO: 21229 - RNA, 30 nt, Artificial Sequence
  derived and/or modified sequence opt2 from anti-HIV_CDR
cagcaguacuacaaguggccccccaucacc

SEQ ID NO: 21230 - RNA, 30 nt, Artificial Sequence
  derived and/or modified sequence opt2 from anti-HIV_CDR
cagcaguacggcuccuccgcccccuacacc

SEQ ID NO: 21231 - RNA, 30 nt, Artificial Sequence
  derived and/or modified sequence opt2 from anti-HIV_CDR
cagcagcucaacuccgacccccccuggacc

SEQ ID NO: 21232 - RNA, 30 nt, Artificial Sequence
  derived and/or modified sequence opt2 from anti-HIV_CDR
cagcaccacggcuccucccccaccuggacc

SEQ ID NO: 21233 - RNA, 30 nt, Artificial Sequence
  derived and/or modified sequence opt2 from anti-HIV_CDR
cagcaguacaagaaguggccccccuggacc

SEQ ID NO: 21234 - RNA, 30 nt, Artificial Sequence
  derived and/or modified sequence opt2 from anti-HIV_CDR
cagcaguacggcuucucccuccccgucacc

SEQ ID NO: 21235 - RNA, 30 nt, Artificial Sequence
  derived and/or modified sequence opt2 from anti-HIV_CDR
caguccuacaacggcgacccccccgucacc

SEQ ID NO: 21236 - RNA, 30 nt, Artificial Sequence
  derived and/or modified sequence opt2 from anti-HIV_CDR
cagcaguacggcuccucccgccgcuggacc

SEQ ID NO: 21237 - RNA, 30 nt, Artificial Sequence
  derived and/or modified sequence opt2 from anti-HIV_CDR
cagcaguucaacuccuaccccccccucacc

SEQ ID NO: 21238 - RNA, 30 nt, Artificial Sequence
  derived and/or modified sequence opt2 from anti-HIV_CDR
cgcgagggcucccagggcgccuucgacauc

SEQ ID NO: 21239 - RNA, 30 nt, Artificial Sequence
  derived and/or modified sequence opt2 from anti-HIV_CDR
ggcgacuccggccccaccggcuucgacuac

SEQ ID NO: 21240 - RNA, 30 nt, Artificial Sequence
  derived and/or modified sequence opt2 from anti-HIV_CDR
guccgccgcggcuccuccuaccccgacuac

SEQ ID NO: 21241 - RNA, 30 nt, Artificial Sequence
  derived and/or modified sequence opt2 from anti-HIV_CDR
uccgccuacuaccgcaacugguucgacucc

SEQ ID NO: 21242 - RNA, 30 nt, Artificial Sequence
  derived and/or modified sequence opt2 from anti-HIV_CDR
caguccuacgacuccuccgucuccgucguc

SEQ ID NO: 21243 - RNA, 30 nt, Artificial Sequence
  derived and/or modified sequence opt2 from anti-HIV_CDR
uccuccuacaccuccucccucacccucguc

SEQ ID NO: 21244 - RNA, 30 nt, Artificial Sequence
  derived and/or modified sequence opt2 from anti-HIV_CDR
uacgagggcaagcgcuccggcauggacguc

SEQ ID NO: 21245 - RNA, 30 nt, Artificial Sequence
  derived and/or modified sequence opt2 from anti-HIV_CDR
cagcaguacggcuccucccccgaguacacc

SEQ ID NO: 21246 - RNA, 30 nt, Artificial Sequence; identical to SEQ ID NO: 13604
  derived and/or modified sequence opt2 from anti-HIV_CDR

SEQ ID NO: 21247 - RNA, 30 nt, Artificial Sequence
  derived and/or modified sequence opt2 from anti-HIV_CDR
cagcaguacgacaaccucccccgcgucacc

SEQ ID NO: 21248 - RNA, 30 nt, Artificial Sequence
  derived and/or modified sequence opt2 from anti-HIV_CDR
ggcgccuacaccaccaccuccacccucguc

SEQ ID NO: 21249 - RNA, 30 nt, Artificial Sequence
  derived and/or modified sequence opt2 from anti-HIV_CDR
cagcaguacaaguccuacuccccccucacc

SEQ ID NO: 21250 - RNA, 30 nt, Artificial Sequence
  derived and/or modified sequence opt2 from anti-HIV_CDR
cagcaguccuacaacacccgcccccucacc

SEQ ID NO: 21251 - RNA, 30 nt, Artificial Sequence
  derived and/or modified sequence opt2 from anti-HIV_CDR
cagcaguacggcggcuccccccccgacacc

SEQ ID NO: 21252 - RNA, 30 nt, Artificial Sequence
  derived and/or modified sequence opt2 from anti-HIV_CDR
ugcuccuacaccuccuccgccaccgucguc

SEQ ID NO: 21253 - RNA, 30 nt, Artificial Sequence
  derived and/or modified sequence opt2 from anti-HIV_CDR
ugcucccacaccuccuccgacacccucguc

SEQ ID NO: 21254 - RNA, 30 nt, Artificial Sequence
  derived and/or modified sequence opt2 from anti-HIV_CDR
cagcacuacggcaacuccccccgcgucacc

SEQ ID NO: 21255 - RNA, 30 nt, Artificial Sequence
  derived and/or modified sequence opt2 from anti-HIV_CDR
gacgccuucgucuccuccgccauggacguc

SEQ ID NO: 21256 - RNA, 30 nt, Artificial Sequence
  derived and/or modified sequence opt2 from anti-HIV_CDR
cuccgcgccaccacccccggcuucgacuac

SEQ ID NO: 21257 - RNA, 30 nt, Artificial Sequence
  derived and/or modified sequence opt2 from anti-HIV_CDR
cuccgcgccaccauccccggcuucgacuac

SEQ ID NO: 21258 - RNA, 30 nt, Artificial Sequence
  derived and/or modified sequence opt2 from anti-HIV_CDR
cuccgcgccaccaucgccggcuucgacuac

SEQ ID NO: 21259 - RNA, 30 nt, Artificial Sequence
  derived and/or modified sequence opt2 from anti-HIV_CDR
ugcuccuacgccggcuccuacaucuggguc

SEQ ID NO: 21260 - RNA, 30 nt, Artificial Sequence
  derived and/or modified sequence opt2 from anti-HIV_CDR
ugcuccuacgccggcaccuacuccuacguc

SEQ ID NO: 21261 - RNA, 30 nt, Artificial Sequence
  derived and/or modified sequence opt2 from anti-HIV_CDR
uccuccuacgccggcuccaacaacuucguc

SEQ ID NO: 21262 - RNA, 30 nt, Artificial Sequence
  derived and/or modified sequence opt2 from anti-HIV_CDR
ggcuccuucaccaccucccucacccucguc

SEQ ID NO: 21263 - RNA, 30 nt, Artificial Sequence
  derived and/or modified sequence opt2 from anti-HIV_CDR
cagcaguacgccaccuccucccucuacacc

SEQ ID NO: 21264 - RNA, 30 nt, Artificial Sequence
  derived and/or modified sequence opt2 from anti-HIV_CDR
cagugguacggcacccuccacccccgcacc

SEQ ID NO: 21265 - RNA, 30 nt, Artificial Sequence
  derived and/or modified sequence opt2 from anti-HIV_CDR
uccuccuacuccuccaccaacaccuacguc

SEQ ID NO: 21266 - RNA, 30 nt, Artificial Sequence
  derived and/or modified sequence opt2 from anti-HIV_CDR
accuucaucaccgccuccugguucgacucc

SEQ ID NO: 21267 - RNA, 30 nt, Artificial Sequence
  derived and/or modified sequence opt2 from anti-HIV_CDR
accggcggccuccuccgcuuccccgagguc

SEQ ID NO: 21268 - RNA, 30 nt, Artificial Sequence
  derived and/or modified sequence opt2 from anti-HIV_CDR
ugcuccuacgccggcuccuacaccuacguc

SEQ ID NO: 21269 - RNA, 30 nt, Artificial Sequence
  derived and/or modified sequence opt2 from anti-HIV_CDR
cagcagcgcuacuccuggcccucccucacc

SEQ ID NO: 21270 - RNA, 30 nt, Artificial Sequence
  derived and/or modified sequence opt2 from anti-HIV_CDR
cuccagugcggcuccuccccccccuacacc

SEQ ID NO: 21271 - RNA, 30 nt, Artificial Sequence
  derived and/or modified sequence opt2 from anti-HIV_CDR
uccuccuacgccggcaccaaccacuggguc

SEQ ID NO: 21272 - RNA, 30 nt, Artificial Sequence
  derived and/or modified sequence opt2 from anti-HIV_CDR
uccuccuacgccgccaccaaccacuggguc

SEQ ID NO: 21273 - RNA, 30 nt, Artificial Sequence
  derived and/or modified sequence opt2 from anti-HIV_CDR
caguacuacggcaccuccccccccuccacc

SEQ ID NO: 21274 - RNA, 30 nt, Artificial Sequence
  derived and/or modified sequence opt2 from anti-HIV_CDR
caguacuacggcuccuccccccccuccacc

SEQ ID NO: 21275 - RNA, 30 nt, Artificial Sequence
  derived and/or modified sequence opt2 from anti-HIV_CDR
caggaguucggccgcgccccccccuacccc

SEQ ID NO: 21276 - RNA, 30 nt, Artificial Sequence
  derived and/or modified sequence opt2 from anti-HIV_CDR
caggaguacggccgcuccccccccuacccc

SEQ ID NO: 21277 - RNA, 30 nt, Artificial Sequence
  derived and/or modified sequence opt2 from anti-HIV_CDR
caggaguacggccgcgccccccccuacccc

SEQ ID NO: 21278 - RNA, 30 nt, Artificial Sequence
  derived and/or modified sequence opt2 from anti-HIV_CDR
cacaucgccgucggcggcuccgaggagcac

SEQ ID NO: 21279 - RNA, 30 nt, Artificial Sequence
  derived and/or modified sequence opt2 from anti-HIV_CDR
cacaucgccgucggcggcuccgaggaccac

SEQ ID NO: 21280 - RNA, 30 nt, Artificial Sequence
  derived and/or modified sequence opt2 from anti-HIV_CDR
cacaucgccgucggcggccgcgaggaggag

SEQ ID NO: 21281 - RNA, 33 nt, Artificial Sequence
  derived and/or modified sequence opt2 from anti-HIV_CDR
ggcgagaagucccgcggcucccgcgccguccag

SEQ ID NO: 21282 - RNA, 33 nt, Artificial Sequence
  derived and/or modified sequence opt2 from anti-HIV_CDR
ggcgagaaguccuucgccucccgcgccguccag

SEQ ID NO: 21283 - RNA, 33 nt, Artificial Sequence
  derived and/or modified sequence opt2 from anti-HIV_CDR
ggccgccaggcccucggcucccgcgccguccag

SEQ ID NO: 21284 - RNA, 33 nt, Artificial Sequence
  derived and/or modified sequence opt2 from anti-HIV_CDR
ggcgaggagucccucggcucccgcuccgucauc

SEQ ID NO: 21285 - RNA, 33 nt, Artificial Sequence
  derived and/or modified sequence opt2 from anti-HIV_CDR
ggcgagaagucccucggcucccgcgccguccag

SEQ ID NO: 21286 - RNA, 33 nt, Artificial Sequence
  derived and/or modified sequence opt2 from anti-HIV_CDR
ggcaaggaguccaucggcucccgcgccguccag

SEQ ID NO: 21287 - RNA, 33 nt, Artificial Sequence
  derived and/or modified sequence opt2 from anti-HIV_CDR
ggcggcaacaacaucggcuccaaguccguccac

SEQ ID NO: 21288 - RNA, 33 nt, Artificial Sequence
  derived and/or modified sequence opt2 from anti-HIV_CDR
ggcgagaaguccaucggcucccgcgccguccag

SEQ ID NO: 21289 - RNA, 33 nt, Artificial Sequence
  derived and/or modified sequence opt2 from anti-HIV_CDR
aaggccucccaggacgucuccaccgccgucgcc

SEQ ID NO: 21290 - RNA, 33 nt, Artificial Sequence
  derived and/or modified sequence opt2 from anti-HIV_CDR
ggcucccgcaaccucucccaccgccuccucucc

SEQ ID NO: 21291 - RNA, 33 nt, Artificial Sequence
  derived and/or modified sequence opt2 from anti-HIV_CDR
ggcaccuacgacucccagggcuccacccgccuc

SEQ ID NO: 21292 - RNA, 33 nt, Artificial Sequence
  derived and/or modified sequence opt2 from anti-HIV_CDR
cagcagcgcaccaucuggccccccggcugcucc

SEQ ID NO: 21293 - RNA, 33 nt, Artificial Sequence
  derived and/or modified sequence opt2 from anti-HIV_CDR
ggcaccugggacuccucccucuccgccguccuc

SEQ ID NO: 21294 - RNA, 33 nt, Artificial Sequence
  derived and/or modified sequence opt2 from anti-HIV_CDR
gccuccugggacaacucccucuccggccccguc

SEQ ID NO: 21295 - RNA, 33 nt, Artificial Sequence
  derived and/or modified sequence opt2 from anti-HIV_CDR
gccuccugggacgacucccucuccggcuggguc

SEQ ID NO: 21296 - RNA, 33 nt, Artificial Sequence
  derived and/or modified sequence opt2 from anti-HIV_CDR
cuccuccuccccuacuacggcggccccuggauc

SEQ ID NO: 21297 - RNA, 33 nt, Artificial Sequence
  derived and/or modified sequence opt2 from anti-HIV_CDR
cagcaccgcaccaacuggccccccuccaucacc

SEQ ID NO: 21298 - RNA, 33 nt, Artificial Sequence
  derived and/or modified sequence opt2 from anti-HIV_CDR
caguccuacgaccgcucccuccgcggcuccguc

SEQ ID NO: 21299 - RNA, 33 nt, Artificial Sequence
  derived and/or modified sequence opt2 from anti-HIV_CDR
uccuccggcaacuacgacuucgccuucgacauc

SEQ ID NO: 21300 - RNA, 33 nt, Artificial Sequence
  derived and/or modified sequence opt2 from anti-HIV_CDR
uccuccggcaacuacgacuucgccuacgacauc

SEQ ID NO: 21301 - RNA, 33 nt, Artificial Sequence
  derived and/or modified sequence opt2 from anti-HIV_CDR
uccuccggcaacuucgaguucgccuucgagauc

SEQ ID NO: 21302 - RNA, 33 nt, Artificial Sequence
  derived and/or modified sequence opt2 from anti-HIV_CDR
gccaccuacgacucccacggcuccauccgccuc

SEQ ID NO: 21303 - RNA, 33 nt, Artificial Sequence
  derived and/or modified sequence opt2 from anti-HIV_CDR
ggcaccuacgacaccucccucucccuccgccuc

SEQ ID NO: 21304 - RNA, 33 nt, Artificial Sequence
  derived and/or modified sequence opt2 from anti-HIV_CDR
gccgccuucgacuccgcccucucccucccccuc

SEQ ID NO: 21305 - RNA, 33 nt, Artificial Sequence
  derived and/or modified sequence opt2 from anti-HIV_CDR
gccaccuacgacuccgacggcuccauccgccuc

SEQ ID NO: 21306 - RNA, 33 nt, Artificial Sequence
  derived and/or modified sequence opt2 from anti-HIV_CDR
gccaccuacgacuccggcugguccauccgccuc

SEQ ID NO: 21307 - RNA, 33 nt, Artificial Sequence
  derived and/or modified sequence opt2 from anti-HIV_CDR
gccaccuacgacaccggccucucccuccgccuc

SEQ ID NO: 21308 - RNA, 33 nt, Artificial Sequence
  derived and/or modified sequence opt2 from anti-HIV_CDR
gccgccuacgacuccacccucucccuccgccuc

SEQ ID NO: 21309 - RNA, 33 nt, Artificial Sequence
  derived and/or modified sequence opt2 from anti-HIV_CDR
gccgccuacgacuccgccgucucccuccccguc

SEQ ID NO: 21310 - RNA, 33 nt, Artificial Sequence
  derived and/or modified sequence opt2 from anti-HIV_CDR
gccaccuacgacaccgaccucucccuccgccuc

SEQ ID NO: 21311 - RNA, 33 nt, Artificial Sequence
  derived and/or modified sequence opt2 from anti-HIV_CDR
gccgccuacgacuccucccucucccuccgccuc

SEQ ID NO: 21312 - RNA, 33 nt, Artificial Sequence
  derived and/or modified sequence opt2 from anti-HIV_CDR
gccgccuacgacuccaccuucucccuccccguc

SEQ ID NO: 21313 - RNA, 33 nt, Artificial Sequence
  derived and/or modified sequence opt2 from anti-HIV_CDR
gccaccuacgacucccagggcuccacccgccuc

SEQ ID NO: 21314 - RNA, 33 nt, Artificial Sequence
  derived and/or modified sequence opt2 from anti-HIV_CDR
gccaccuacgacucccagcgcuccauccgccuc

SEQ ID NO: 21315 - RNA, 33 nt, Artificial Sequence
  derived and/or modified sequence opt2 from anti-HIV_CDR
gccgucuacgacuccucccucucccucggccuc

SEQ ID NO: 21316 - RNA, 33 nt, Artificial Sequence
  derived and/or modified sequence opt2 from anti-HIV_CDR
cagcaccgcuccaucuggccccucaugugcacc

SEQ ID NO: 21317 - RNA, 33 nt, Artificial Sequence
  derived and/or modified sequence opt2 from anti-HIV_CDR
cuccagcccgucuacaucuuccgcggcaccugg

SEQ ID NO: 21318 - RNA, 33 nt, Artificial Sequence
  derived and/or modified sequence opt2 from anti-HIV_CDR
ugcgaggucgacgccgacgagaccgucaccugc

SEQ ID NO: 21319 - RNA, 33 nt, Artificial Sequence
  derived and/or modified sequence opt2 from anti-HIV_CDR
ugcgaggucgacgccgaggucaccaugaccguc

SEQ ID NO: 21320 - RNA, 33 nt, Artificial Sequence
  derived and/or modified sequence opt2 from anti-HIV_CDR
uccuccuacgccgacaccaacgacuucggcguc

SEQ ID NO: 21321 - RNA, 33 nt, Artificial Sequence
  derived and/or modified sequence opt2 from anti-HIV_CDR
ugcuccuucaccuacgucaaccccaccuaccuc

SEQ ID NO: 21322 - RNA, 33 nt, Artificial Sequence
  derived and/or modified sequence opt2 from anti-HIV_CDR
ggcaccugggacggcucccucaccaccggcguc

SEQ ID NO: 21323 - RNA, 33 nt, Artificial Sequence
  derived and/or modified sequence opt2 from anti-HIV_CDR
caguccuacgacaacucccucuccggcuggguc

SEQ ID NO: 21324 - RNA, 33 nt, Artificial Sequence
  derived and/or modified sequence opt2 from anti-HIV_CDR
cagcaguacuacuccaucccccccuggaccuuc

SEQ ID NO: 21325 - RNA, 33 nt, Artificial Sequence
  derived and/or modified sequence opt2 from anti-HIV_CDR
augcagggcaccuacuggccccccuccaucacc

SEQ ID NO: 21326 - RNA, 33 nt, Artificial Sequence
  derived and/or modified sequence opt2 from anti-HIV_CDR
caguccuacgacuccucccucggcgucgagguc

SEQ ID NO: 21327 - RNA, 33 nt, Artificial Sequence
  derived and/or modified sequence opt2 from anti-HIV_CDR
caggucugggacuccggccgcgacuccuggguc

SEQ ID NO: 21328 - RNA, 33 nt, Artificial Sequence
  derived and/or modified sequence opt2 from anti-HIV_CDR
caguccuacgacuccucccucuccggcuggguc

SEQ ID NO: 21329 - RNA, 33 nt, Artificial Sequence
  derived and/or modified sequence opt2 from anti-HIV_CDR
ggcuccugggacggcucccucaacgccggcguc

SEQ ID NO: 21330 - RNA, 33 nt, Artificial Sequence
  derived and/or modified sequence opt2 from anti-HIV_CDR
cucuccgccgacuccuccuccaccuaccagguc

SEQ ID NO: 21331 - RNA, 33 nt, Artificial Sequence
  derived and/or modified sequence opt2 from anti-HIV_CDR
ugcuccuacgccggccgcgacaccuccuggguc

SEQ ID NO: 21332 - RNA, 33 nt, Artificial Sequence
  derived and/or modified sequence opt2 from anti-HIV_CDR
cagcagcgcuccaacuggccccccggccucacc

SEQ ID NO: 21333 - RNA, 33 nt, Artificial Sequence
  derived and/or modified sequence opt2 from anti-HIV_CDR
aagggccgcggcuacggcuacugguucgacucc

SEQ ID NO: 21334 - RNA, 33 nt, Artificial Sequence
  derived and/or modified sequence opt2 from anti-HIV_CDR
gagauggccgccaccuccgacgccuucgacauc

SEQ ID NO: 21335 - RNA, 33 nt, Artificial Sequence
  derived and/or modified sequence opt2 from anti-HIV_CDR
uccaucuacuccaccggccccgcccccgucuac

SEQ ID NO: 21336 - RNA, 33 nt, Artificial Sequence
  derived and/or modified sequence opt2 from anti-HIV_CDR
cgcggcucccuccucaucaaguacuucgacuac

SEQ ID NO: 21337 - RNA, 33 nt, Artificial Sequence
  derived and/or modified sequence opt2 from anti-HIV_CDR
cagcaguacgacaaccuccccccccgcgucacc

SEQ ID NO: 21338 - RNA, 33 nt, Artificial Sequence
  derived and/or modified sequence opt2 from anti-HIV_CDR
gacguccgccucgucgccguccccggcgccgac

SEQ ID NO: 21339 - RNA, 33 nt, Artificial Sequence
  derived and/or modified sequence opt2 from anti-HIV_CDR
cagcagcgcaccaccuggccccccgaguacacc

SEQ ID NO: 21340 - RNA, 33 nt, Artificial Sequence
  derived and/or modified sequence opt2 from anti-HIV_CDR
gccgccugggacgacucccucaacggcuggguc

SEQ ID NO: 21341 - RNA, 33 nt, Artificial Sequence
  derived and/or modified sequence opt2 from anti-HIV_CDR
cgccgccgcuccgccuggucccccuucgacucc

SEQ ID NO: 21342 - RNA, 33 nt, Artificial Sequence
  derived and/or modified sequence opt2 from anti-HIV_CDR
gccaccugggacuccucccuccgcaccgcccuc

SEQ ID NO: 21343 - RNA, 33 nt, Artificial Sequence
  derived and/or modified sequence opt2 from anti-HIV_CDR
ggcaccugggacuccucccuccgcgccgcccuc

SEQ ID NO: 21344 - RNA, 33 nt, Artificial Sequence
  derived and/or modified sequence opt2 from anti-HIV_CDR
cagcagcgcuccaucuggccccccucccucacc

SEQ ID NO: 21345 - RNA, 33 nt, Artificial Sequence
  derived and/or modified sequence opt2 from anti-HIV_CDR
gaguuccagaccuccggcgucguccgcgagggc

SEQ ID NO: 21346 - RNA, 33 nt, Artificial Sequence
  derived and/or modified sequence opt2 from anti-HIV_CDR
cacaucggcgccggcggccccuacuccgaguac

SEQ ID NO: 21347 - RNA, 33 nt, Artificial Sequence
  derived and/or modified sequence opt2 from anti-HIV_CDR
cgcggccacuccuucaccucccccuucgacucc

SEQ ID NO: 21348 - RNA, 33 nt, Artificial Sequence
  derived and/or modified sequence opt2 from anti-HIV_CDR
cagcaccucaacuccuacccccgcauguacacc

SEQ ID NO: 21349 - RNA, 33 nt, Artificial Sequence
  derived and/or modified sequence opt2 from anti-HIV_CDR
cagcagcgcuccaacuggccccccaagaucacc

SEQ ID NO: 21350 - RNA, 33 nt, Artificial Sequence
  derived and/or modified sequence opt2 from anti-HIV_CDR
gccgccugggacgacucccucggcggcgucguc

SEQ ID NO: 21351 - RNA, 33 nt, Artificial Sequence
  derived and/or modified sequence opt2 from anti-HIV_CDR
ggcaccugggacuccucccucuccgccgucguc

SEQ ID NO: 21352 - RNA, 33 nt, Artificial Sequence
  derived and/or modified sequence opt2 from anti-HIV_CDR
cagcagcgcgccaacuggccccccggcggcacc

SEQ ID NO: 21353 - RNA, 33 nt, Artificial Sequence
  derived and/or modified sequence opt2 from anti-HIV_CDR
ggcggcggcuacccccgcggcaacauggacguc

SEQ ID NO: 21354 - RNA, 33 nt, Artificial Sequence
  derived and/or modified sequence opt2 from anti-HIV_CDR
cuccuccuccucuacuacggcggccccuggauc

SEQ ID NO: 21355 - RNA, 33 nt, Artificial Sequence
  derived and/or modified sequence opt2 from anti-HIV_CDR
cagcagcgcggcaucuggccccuccagaucacc

SEQ ID NO: 21356 - RNA, 33 nt, Artificial Sequence
  derived and/or modified sequence opt2 from anti-HIV_CDR
cgcucccccggcggcggcuacgccuucgacauc

SEQ ID NO: 21357 - RNA, 33 nt, Artificial Sequence
  derived and/or modified sequence opt2 from anti-HIV_CDR
uccggccccggccuccuccgcggcuucgacuac

SEQ ID NO: 21358 - RNA, 33 nt, Artificial Sequence
  derived and/or modified sequence opt2 from anti-HIV_CDR
cagcagcgcaccacccgcccccccgaguacacc

SEQ ID NO: 21359 - RNA, 33 nt, Artificial Sequence
  derived and/or modified sequence opt2 from anti-HIV_CDR
cagcagcgcaccacccgcccccccgacuacacc

SEQ ID NO: 21360 - RNA, 33 nt, Artificial Sequence
  derived and/or modified sequence opt2 from anti-HIV_CDR
cagggccgcaccacccgcccccccgacuacacc

SEQ ID NO: 21361 - RNA, 33 nt, Artificial Sequence
  derived and/or modified sequence opt2 from anti-HIV_CDR
cagcagcgcuccaccaccccccccgaguacacc

SEQ ID NO: 21362 - RNA, 33 nt, Artificial Sequence
  derived and/or modified sequence opt2 from anti-HIV_CDR
cagcagcgcaccuccuggccccucgcccucucc

SEQ ID NO: 21363 - RNA, 33 nt, Artificial Sequence
  derived and/or modified sequence opt2 from anti-HIV_CDR
cgcggccacuccuucucccuccccuucgacucc

SEQ ID NO: 21364 - RNA, 36 nt, Artificial Sequence
  derived and/or modified sequence opt2 from anti-HIV_CDR
cacuacugggacucccgcucccccaucuccuggguc

SEQ ID NO: 21365 - RNA, 36 nt, Artificial Sequence
  derived and/or modified sequence opt2 from anti-HIV_CDR
cacaagugggacucccgcuccccccucuccuggguc

SEQ ID NO: 21366 - RNA, 36 nt, Artificial Sequence
  derived and/or modified sequence opt2 from anti-HIV_CDR
cacaugugggacucccgcuccggcuucuccuggucc

SEQ ID NO: 21367 - RNA, 36 nt, Artificial Sequence
  derived and/or modified sequence opt2 from anti-HIV_CDR
cacaucugggacucccgcguccccaccaaguggguc

SEQ ID NO: 21368 - RNA, 36 nt, Artificial Sequence
  derived and/or modified sequence opt2 from anti-HIV_CDR
caggucugggacuccuccuccgaccaccccuggguc

SEQ ID NO: 21369 - RNA, 36 nt, Artificial Sequence
  derived and/or modified sequence opt2 from anti-HIV_CDR
cacaucuacgacgcccgccgccccaccaacuggguc

SEQ ID NO: 21370 - RNA, 36 nt, Artificial Sequence
  derived and/or modified sequence opt2 from anti-HIV_CDR
cucgacggcgaggccuuccgcuacuaccucgaccuc

SEQ ID NO: 21371 - RNA, 36 nt, Artificial Sequence
  derived and/or modified sequence opt2 from anti-HIV_CDR
ccccaguacaaccucggccgcgacccccucgacguc

SEQ ID NO: 21372 - RNA, 36 nt, Artificial Sequence
  derived and/or modified sequence opt2 from anti-HIV_CDR
cccgagcccuccuccaucgucgccccccucuacuac

SEQ ID NO: 21373 - RNA, 36 nt, Artificial Sequence
  derived and/or modified sequence opt2 from anti-HIV_CDR
ggcggcggcgacggccgcaacuggcaccuccacccc

SEQ ID NO: 21374 - RNA, 36 nt, Artificial Sequence
  derived and/or modified sequence opt2 from anti-HIV_CDR
cccaaguccggccgcgacuacugguccuucgaccuc

SEQ ID NO: 21375 - RNA, 36 nt, Artificial Sequence
  derived and/or modified sequence opt2 from anti-HIV_CDR
ccccgcggcggccgcgacaacugguccuuccacguc

SEQ ID NO: 21376 - RNA, 36 nt, Artificial Sequence
  derived and/or modified sequence opt2 from anti-HIV_CDR
ccccacucccccgacgacgccuggucccucgacguc

SEQ ID NO: 21377 - RNA, 36 nt, Artificial Sequence
  derived and/or modified sequence opt2 from anti-HIV_CDR
ccccuccgcggcggcgacaccuggcacuaccacucc

SEQ ID NO: 21378 - RNA, 36 nt, Artificial Sequence
  derived and/or modified sequence opt2 from anti-HIV_CDR
cuccagcccgucuacauccuccgcuccaucugccac

SEQ ID NO: 21379 - RNA, 36 nt, Artificial Sequence
  derived and/or modified sequence opt2 from anti-HIV_CDR
cuccagcccgucuacauccucaagugcaacuggugc

SEQ ID NO: 21380 - RNA, 36 nt, Artificial Sequence
  derived and/or modified sequence opt2 from anti-HIV_CDR
gaguaccgcuucgacgacuggggcccccucgaccac

SEQ ID NO: 21381 - RNA, 36 nt, Artificial Sequence
  derived and/or modified sequence opt2 from anti-HIV_CDR
gccgccugggacgacucccucaacggccacggcguc

SEQ ID NO: 21382 - RNA, 36 nt, Artificial Sequence
  derived and/or modified sequence opt2 from anti-HIV_CDR
cucuacuucgacugggccccccacgccuucgacauc

SEQ ID NO: 21383 - RNA, 36 nt, Artificial Sequence
  derived and/or modified sequence opt2 from anti-HIV_CDR
ggccucuacgacuccuccggcuacuacuucggcuac

SEQ ID NO: 21384 - RNA, 36 nt, Artificial Sequence
  derived and/or modified sequence opt2 from anti-HIV_CDR
cucggcugcuccggcggcuccugcuacgaggacucc

SEQ ID NO: 21385 - RNA, 36 nt, Artificial Sequence
  derived and/or modified sequence opt2 from anti-HIV_CDR
gccuccggcuccuacauccucggcaccauggacguc

SEQ ID NO: 21386 - RNA, 36 nt, Artificial Sequence
  derived and/or modified sequence opt2 from anti-HIV_CDR
uacuccaccgacaacuccggcaagcagcacuggguc

SEQ ID NO: 21387 - RNA, 36 nt, Artificial Sequence
  derived and/or modified sequence opt2 from anti-HIV_CDR
gucaagcaguuccucgaguggcucuaccucgacuac

SEQ ID NO: 21388 - RNA, 36 nt, Artificial Sequence
  derived and/or modified sequence opt2 from anti-HIV_CDR
ggcguccgcuccaucgucggcgcccacuucgacuac

SEQ ID NO: 21389 - RNA, 36 nt, Artificial Sequence
  derived and/or modified sequence opt2 from anti-HIV_CDR
ggcgucggcacccgcuacuacgucuacuucgacucc

SEQ ID NO: 21390 - RNA, 36 nt, Artificial Sequence
  derived and/or modified sequence opt2 from anti-HIV_CDR
gcccccuacaucuccuccucccaccucgacuacugg

SEQ ID NO: 21391 - RNA, 36 nt, Artificial Sequence
  derived and/or modified sequence opt2 from anti-HIV_CDR
cgcggcaucgccgccgccggcuucuacuuccagcac

SEQ ID NO: 21392 - RNA, 36 nt, Artificial Sequence
  derived and/or modified sequence opt2 from anti-HIV_CDR
cgcggcaucgccgccgccgccuucuacuuccagacc

SEQ ID NO: 21393 - RNA, 36 nt, Artificial Sequence
  derived and/or modified sequence opt2 from anti-HIV_CDR
cgcggcaucgccgccgccggcuucuacuuccagaac

SEQ ID NO: 21394 - RNA, 36 nt, Artificial Sequence
  derived and/or modified sequence opt2 from anti-HIV_CDR
caguccuacgacaccucccucaccgacaccggcguc

SEQ ID NO: 21395 - RNA, 36 nt, Artificial Sequence
  derived and/or modified sequence opt2 from anti-HIV_CDR
caguccuacgacaccucccucuccgacaccggcguc

SEQ ID NO: 21396 - RNA, 36 nt, Artificial Sequence
  derived and/or modified sequence opt2 from anti-HIV_CDR
cgcaccacccucgucaacuucggcgucuucgaccuc

SEQ ID NO: 21397 - RNA, 36 nt, Artificial Sequence
  derived and/or modified sequence opt2 from anti-HIV_CDR
cccgucgucaacaccauccuccccuacugcgacguc

SEQ ID NO: 21398 - RNA, 36 nt, Artificial Sequence
  derived and/or modified sequence opt2 from anti-HIV_CDR
ugcuacuccggccgcucccgcuacuucuucgacucc

SEQ ID NO: 21399 - RNA, 36 nt, Artificial Sequence
  derived and/or modified sequence opt2 from anti-HIV_CDR
gccgccugggacgacucccucgacggcuucuggguc

SEQ ID NO: 21400 - RNA, 36 nt, Artificial Sequence
  derived and/or modified sequence opt2 from anti-HIV_CDR
cuccgccgcggcuacuacgacuccggcgaggacuac

SEQ ID NO: 21401 - RNA, 36 nt, Artificial Sequence
  derived and/or modified sequence opt2 from anti-HIV_CDR
cuccgccgcggcuacuucgacuccggcggcgaccac

SEQ ID NO: 21402 - RNA, 36 nt, Artificial Sequence
  derived and/or modified sequence opt2 from anti-HIV_CDR
uccuccuacaccuccuccuccacccucggcgucguc

SEQ ID NO: 21403 - RNA, 36 nt, Artificial Sequence
  derived and/or modified sequence opt2 from anti-HIV_CDR
cucgacggcgaggccuuccgcuacuacuucgacucc

SEQ ID NO: 21404 - RNA, 36 nt, Artificial Sequence
  derived and/or modified sequence opt2 from anti-HIV_CDR
cgccgcggccagcgccuccucgccuacuucgacuac

SEQ ID NO: 21405 - RNA, 36 nt, Artificial Sequence
  derived and/or modified sequence opt2 from anti-HIV_CDR
ccccaguacaaccucggccgcgagccccucaacguc

SEQ ID NO: 21406 - RNA, 36 nt, Artificial Sequence
  derived and/or modified sequence opt2 from anti-HIV_CDR
gcccaccacgacuucuggcgcgcccccgucgacguc

SEQ ID NO: 21407 - RNA, 36 nt, Artificial Sequence
  derived and/or modified sequence opt2 from anti-HIV_CDR
ggccgccgcgagggccucaacuuccuccucgacuac

SEQ ID NO: 21408 - RNA, 36 nt, Artificial Sequence
  derived and/or modified sequence opt2 from anti-HIV_CDR
cccgagcccuccuccaucgucggcgcccucuacuac

SEQ ID NO: 21409 - RNA, 36 nt, Artificial Sequence
  derived and/or modified sequence opt2 from anti-HIV_CDR
ggccccgacgacuucugguccggcuaccccaaguac

SEQ ID NO: 21410 - RNA, 36 nt, Artificial Sequence
  derived and/or modified sequence opt2 from anti-HIV_CDR
gacuacuccgccgccggccgccaccucuucgacucc

SEQ ID NO: 21411 - RNA, 36 nt, Artificial Sequence
  derived and/or modified sequence opt2 from anti-HIV_CDR
gacuacaccgcccgcggccgccacuucuucgacuac

SEQ ID NO: 21412 - RNA, 36 nt, Artificial Sequence
  derived and/or modified sequence opt2 from anti-HIV_CDR
gacuacaccgccuccggccgccacuucuucgacuac

SEQ ID NO: 21413 - RNA, 36 nt, Artificial Sequence
  derived and/or modified sequence opt2 from anti-HIV_CDR
caguccuacgacuccucccucuccggcuccuggguc

SEQ ID NO: 21414 - RNA, 36 nt, Artificial Sequence
  derived and/or modified sequence opt2 from anti-HIV_CDR
cccgcccaggccggcgucggcccccgcuucgacuac

SEQ ID NO: 21415 - RNA, 36 nt, Artificial Sequence
  derived and/or modified sequence opt2 from anti-HIV_CDR
ggcgccaucaacuccuccccccucuacuucgacucc

SEQ ID NO: 21416 - RNA, 36 nt, Artificial Sequence
  derived and/or modified sequence opt2 from anti-HIV_CDR
ggcgacaucaccuccuccccccucuacuucgacuuc

SEQ ID NO: 21417 - RNA, 36 nt, Artificial Sequence
  derived and/or modified sequence opt2 from anti-HIV_CDR
ggcgccaucaacuccucccccuccuacuucgacucc

SEQ ID NO: 21418 - RNA, 36 nt, Artificial Sequence
  derived and/or modified sequence opt2 from anti-HIV_CDR
ugggucgucaccgccgccgaggaguacuucgacuac

SEQ ID NO: 21419 - RNA, 39 nt, Artificial Sequence
  derived and/or modified sequence opt2 from anti-HIV_CDR
gacccccaggucgagguccgcggcaacgccuucgacauc

SEQ ID NO: 21420 - RNA, 39 nt, Artificial Sequence
  derived and/or modified sequence opt2 from anti-HIV_CDR
gaccacggcgacccccgcaccggcuacuacuucgacuac

SEQ ID NO: 21421 - RNA, 39 nt, Artificial Sequence
  derived and/or modified sequence opt2 from anti-HIV_CDR
gacgaguccggcuacgaccucaacuggcaccucgacucc

SEQ ID NO: 21422 - RNA, 39 nt, Artificial Sequence
  derived and/or modified sequence opt2 from anti-HIV_CDR
gacggcuccggcgacgaccgcaacuggcaccucgacccc

SEQ ID NO: 21423 - RNA, 39 nt, Artificial Sequence
  derived and/or modified sequence opt2 from anti-HIV_CDR
gaccgccgcgacgacggccucgacuggcuccucgacccc

SEQ ID NO: 21424 - RNA, 39 nt, Artificial Sequence
  derived and/or modified sequence opt2 from anti-HIV_CDR
gacggcggcggcgacgaccgcaccuggcuccucgacgcc

SEQ ID NO: 21425 - RNA, 39 nt, Artificial Sequence
  derived and/or modified sequence opt2 from anti-HIV_CDR
gacggcuccggcgacgcccgcgacuggcaccuccacccc

SEQ ID NO: 21426 - RNA, 39 nt, Artificial Sequence
  derived and/or modified sequence opt2 from anti-HIV_CDR
gacggcuccggcgacgacaccuccugguaccucgacccc

SEQ ID NO: 21427 - RNA, 39 nt, Artificial Sequence
  derived and/or modified sequence opt2 from anti-HIV_CDR
gacggcuccggcgacgacaccuccuggcaccucgacccc

SEQ ID NO: 21428 - RNA, 39 nt, Artificial Sequence
  derived and/or modified sequence opt2 from anti-HIV_CDR
gaccgccgcgacgacgaccgcgccuggcuccucgacccc

SEQ ID NO: 21429 - RNA, 39 nt, Artificial Sequence
  derived and/or modified sequence opt2 from anti-HIV_CDR
gacggcuccggcgacgcccgcgacuggcaccucgacccc

SEQ ID NO: 21430 - RNA, 39 nt, Artificial Sequence
  derived and/or modified sequence opt2 from anti-HIV_CDR
gacggcuccggcgacgccaccuccuggcaccuccacccc

SEQ ID NO: 21431 - RNA, 39 nt, Artificial Sequence
  derived and/or modified sequence opt2 from anti-HIV_CDR
gacgaguccggcgacgaccucaaguggcaccuccacccc

SEQ ID NO: 21432 - RNA, 39 nt, Artificial Sequence
  derived and/or modified sequence opt2 from anti-HIV_CDR
gacggcuccggcgacgacaccuccuggcaccuccacccc

SEQ ID NO: 21433 - RNA, 39 nt, Artificial Sequence
  derived and/or modified sequence opt2 from anti-HIV_CDR
gcccagggcgacauccucaccgagggcuacuucgacuac

SEQ ID NO: 21434 - RNA, 39 nt, Artificial Sequence
  derived and/or modified sequence opt2 from anti-HIV_CDR
gaccgcauguucuggcagcagcucgccaaguacgacucc

SEQ ID NO: 21435 - RNA, 39 nt, Artificial Sequence
  derived and/or modified sequence opt2 from anti-HIV_CDR
uccaccugggacuacucccucuccgcccacgaggacguc

SEQ ID NO: 21436 - RNA, 39 nt, Artificial Sequence
  derived and/or modified sequence opt2 from anti-HIV_CDR
gccgccugggacgacucccucuccggccucaacuggguc

SEQ ID NO: 21437 - RNA, 39 nt, Artificial Sequence
  derived and/or modified sequence opt2 from anti-HIV_CDR
cucuccuccgaccgcaucgucgucgucggccccgacuac

SEQ ID NO: 21438 - RNA, 39 nt, Artificial Sequence
  derived and/or modified sequence opt2 from anti-HIV_CDR
gaggccggcuccgucaccgccaccggccccuucgacucc

SEQ ID NO: 21439 - RNA, 39 nt, Artificial Sequence
  derived and/or modified sequence opt2 from anti-HIV_CDR
gacuucggccgcgccuacgccaucggcuacuucgaguac

SEQ ID NO: 21440 - RNA, 39 nt, Artificial Sequence
  derived and/or modified sequence opt2 from anti-HIV_CDR
gaccgcgcccccuacggcgccuucgagcccuucgacuuc

SEQ ID NO: 21441 - RNA, 39 nt, Artificial Sequence
  derived and/or modified sequence opt2 from anti-HIV_CDR
aacggccacuccucccucggcggcggcuacuucccccac

SEQ ID NO: 21442 - RNA, 39 nt, Artificial Sequence
  derived and/or modified sequence opt2 from anti-HIV_CDR
aacggccacuccgcccucggcggcgaguacuuccagcac

SEQ ID NO: 21443 - RNA, 39 nt, Artificial Sequence
  derived and/or modified sequence opt2 from anti-HIV_CDR
gccgcccgccgcgccuucuacuacuacuacauggacguc

SEQ ID NO: 21444 - RNA, 39 nt, Artificial Sequence
  derived and/or modified sequence opt2 from anti-HIV_CDR
gccaacuacuacgacuccuccggcuacggccucgacauc

SEQ ID NO: 21445 - RNA, 39 nt, Artificial Sequence
  derived and/or modified sequence opt2 from anti-HIV_CDR
cacucccgccccggcgcccccccccacuacuucgacuac

SEQ ID NO: 21446 - RNA, 39 nt, Artificial Sequence
  derived and/or modified sequence opt2 from anti-HIV_CDR
ggccucaccgucgccacccucuacgacgccuucgacguc

SEQ ID NO: 21447 - RNA, 39 nt, Artificial Sequence
  derived and/or modified sequence opt2 from anti-HIV_CDR
cgcgaccgcuacaacuggaaguacuacuaccucgacguc

SEQ ID NO: 21448 - RNA, 39 nt, Artificial Sequence
  derived and/or modified sequence opt2 from anti-HIV_CDR
gaccgcggcuccuccggcugguacggcuggcucgacccc

SEQ ID NO: 21449 - RNA, 39 nt, Artificial Sequence
  derived and/or modified sequence opt2 from anti-HIV_CDR
gaccgccucuccuccuucugguccggcggcaucgaccag

SEQ ID NO: 21450 - RNA, 39 nt, Artificial Sequence
  derived and/or modified sequence opt2 from anti-HIV_CDR
gacgucaucgucggcgcccuccucggcgccuucgacauc

SEQ ID NO: 21451 - RNA, 39 nt, Artificial Sequence
  derived and/or modified sequence opt2 from anti-HIV_CDR
caccucaucgcccccaccgccggcaacuacuucuacccc

SEQ ID NO: 21452 - RNA, 39 nt, Artificial Sequence
  derived and/or modified sequence opt2 from anti-HIV_CDR
gacucccgcccccaggcccucgucgccgcccucgacguc

SEQ ID NO: 21453 - RNA, 39 nt, Artificial Sequence
  derived and/or modified sequence opt2 from anti-HIV_CDR
gacgagaucgucggcgcccuccucggcgccuucgacauc

SEQ ID NO: 21454 - RNA, 39 nt, Artificial Sequence
  derived and/or modified sequence opt2 from anti-HIV_CDR
uccgaccccgccaucgccgccgccggcucccucgaccuc

SEQ ID NO: 21455 - RNA, 39 nt, Artificial Sequence
  derived and/or modified sequence opt2 from anti-HIV_CDR
cccuacguccagaccgucgccaccaccaccuucgacuuc

SEQ ID NO: 21456 - RNA, 39 nt, Artificial Sequence
  derived and/or modified sequence opt2 from anti-HIV_CDR
ggccccaaguccgucgccucccucuccuacuucgacaag

SEQ ID NO: 21457 - RNA, 39 nt, Artificial Sequence
  derived and/or modified sequence opt2 from anti-HIV_CDR
ggcgcccucugguucggccagcuccgcggccucgacccc

SEQ ID NO: 21458 - RNA, 39 nt, Artificial Sequence
  derived and/or modified sequence opt2 from anti-HIV_CDR
gaccuccgccccaugcgcggcaacugggccaugcacguc

SEQ ID NO: 21459 - RNA, 39 nt, Artificial Sequence
  derived and/or modified sequence opt2 from anti-HIV_CDR
gacccccaggucaaccgccgcggcaacugcuucgaccac

SEQ ID NO: 21460 - RNA, 39 nt, Artificial Sequence; identical to SEQ ID NO: 13818
  derived and/or modified sequence opt2 from anti-HIV_CDR

SEQ ID NO: 21461 - RNA, 39 nt, Artificial Sequence
  derived and/or modified sequence opt2 from anti-HIV_CDR
gucccccgcaccaccgccacccgcaacgccuucgacauc

SEQ ID NO: 21462 - RNA, 39 nt, Artificial Sequence
  derived and/or modified sequence opt2 from anti-HIV_CDR
cacaaguccguccuccucugguuccgcgagcucgacuac

SEQ ID NO: 21463 - RNA, 39 nt, Artificial Sequence
  derived and/or modified sequence opt2 from anti-HIV_CDR
gacuccgaggacuacgucgacuacuacuacauggacguc

SEQ ID NO: 21464 - RNA, 39 nt, Artificial Sequence
  derived and/or modified sequence opt2 from anti-HIV_CDR
cucccccgcaccaccggcauccgcaacgccuucgacauc

SEQ ID NO: 21465 - RNA, 39 nt, Artificial Sequence
  derived and/or modified sequence opt2 from anti-HIV_CDR
cucccccgcaccaccggcauccgcaacgccuucgacuuc

SEQ ID NO: 21466 - RNA, 42 nt, Artificial Sequence
  derived and/or modified sequence opt2 from anti-HIV_CDR
ggcacccucugguucggcgaguccggccuccgccucgaccac

SEQ ID NO: 21467 - RNA, 42 nt, Artificial Sequence
  derived and/or modified sequence opt2 from anti-HIV_CDR
gucgccuacguccacgucgucaccacccgcucccucgacaac

SEQ ID NO: 21468 - RNA, 42 nt, Artificial Sequence
  derived and/or modified sequence opt2 from anti-HIV_CDR
gccgacuacgaccuccucaccuccuccuaccacuucgacucc

SEQ ID NO: 21469 - RNA, 42 nt, Artificial Sequence
  derived and/or modified sequence opt2 from anti-HIV_CDR
acccgcugcuucggcgccaacugcuucaacuucauggacguc

SEQ ID NO: 21470 - RNA, 42 nt, Artificial Sequence
  derived and/or modified sequence opt2 from anti-HIV_CDR
ggcggccucuacugcuccuccaucuccugcaucauggacguc

SEQ ID NO: 21471 - RNA, 42 nt, Artificial Sequence
  derived and/or modified sequence opt2 from anti-HIV_CDR
aacgagccccaguaccacucccuccccggcauguucgacuac

SEQ ID NO: 21472 - RNA, 42 nt, Artificial Sequence
  derived and/or modified sequence opt2 from anti-HIV_CDR
gagccccgcgagaugggcacccucaccgccggcuucgaguac

SEQ ID NO: 21473 - RNA, 42 nt, Artificial Sequence
  derived and/or modified sequence opt2 from anti-HIV_CDR
gccaccggcuacuccuacggcuaccucgacgccuucgacauc

SEQ ID NO: 21474 - RNA, 42 nt, Artificial Sequence
  derived and/or modified sequence opt2 from anti-HIV_CDR
ggcucccucugguucggcgaguccggccuccgccucgaccac

SEQ ID NO: 21475 - RNA, 42 nt, Artificial Sequence
  derived and/or modified sequence opt2 from anti-HIV_CDR
gacaacaccaucuccggcgucgucccccgcugguucgacuac

SEQ ID NO: 21476 - RNA, 42 nt, Artificial Sequence
  derived and/or modified sequence opt2 from anti-HIV_CDR
aucuacgacggccgcggcuacuacuccuacuucuucgaccuc

SEQ ID NO: 21477 - RNA, 42 nt, Artificial Sequence
  derived and/or modified sequence opt2 from anti-HIV_CDR
gaccgcuucaacuggaacgacggcggcuacuucuucgacucc

SEQ ID NO: 21478 - RNA, 42 nt, Artificial Sequence
  derived and/or modified sequence opt2 from anti-HIV_CDR
ggccacuccuccuccuggaccaaguucaacugguucggcccc

SEQ ID NO: 21479 - RNA, 42 nt, Artificial Sequence
  derived and/or modified sequence opt2 from anti-HIV_CDR
uccaucgccgccgacgacuacuacuacuacuacauggacguc

SEQ ID NO: 21480 - RNA, 42 nt, Artificial Sequence
  derived and/or modified sequence opt2 from anti-HIV_CDR
uccuucuacgacaacggcggcuacuaccucggccucgacuac

SEQ ID NO: 21481 - RNA, 42 nt, Artificial Sequence
  derived and/or modified sequence opt2 from anti-HIV_CDR
gacaaggacgccuccaucuacggcuaccgcauccucaaccac

SEQ ID NO: 21482 - RNA, 42 nt, Artificial Sequence
  derived and/or modified sequence opt2 from anti-HIV_CDR
guccucaccgaccucgaccagggcaacccccgcauggacguc

SEQ ID NO: 21483 - RNA, 42 nt, Artificial Sequence
  derived and/or modified sequence opt2 from anti-HIV_CDR
cgcgagaucaaguucggcgagcucuccuucuacuucgacucc

SEQ ID NO: 21484 - RNA, 42 nt, Artificial Sequence
  derived and/or modified sequence opt2 from anti-HIV_CDR
cgcgagauccgcuucggcgagcucuccuucuacuucgacuac

SEQ ID NO: 21485 - RNA, 42 nt, Artificial Sequence
  derived and/or modified sequence opt2 from anti-HIV_CDR
ccccacucccccaccaacauccccucccgcccccucgacuac

SEQ ID NO: 21486 - RNA, 42 nt, Artificial Sequence
  derived and/or modified sequence opt2 from anti-HIV_CDR
ggcgacuacgacauccucaccuccuccuaccaguucgacuac

SEQ ID NO: 21487 - RNA, 42 nt, Artificial Sequence
  derived and/or modified sequence opt2 from anti-HIV_CDR
uccaccccccucgucuggccccccgccaacggccucgacguc

SEQ ID NO: 21488 - RNA, 42 nt, Artificial Sequence
  derived and/or modified sequence opt2 from anti-HIV_CDR
acccgcaacaccggcaacucccuccccuacugguucgaccuc

SEQ ID NO: 21489 - RNA, 45 nt, Artificial Sequence
  derived and/or modified sequence opt2 from anti-HIV_CDR
gagaagggccaguggcucaccgucccccccuacuacuucgacucc

SEQ ID NO: 21490 - RNA, 45 nt, Artificial Sequence
  derived and/or modified sequence opt2 from anti-HIV_CDR
ggcuccggccgcuggaccaucggcgcccgcaucuacuucgacaac

SEQ ID NO: 21491 - RNA, 45 nt, Artificial Sequence
  derived and/or modified sequence opt2 from anti-HIV_CDR
cucgaggccgacggcgccgacuacucccccaagauguucgacuuc

SEQ ID NO: 21492 - RNA, 45 nt, Artificial Sequence
  derived and/or modified sequence opt2 from anti-HIV_CDR
cucgaggccgacggcggcgacuacucccccaagauguucgacuac

SEQ ID NO: 21493 - RNA, 45 nt, Artificial Sequence
  derived and/or modified sequence opt2 from anti-HIV_CDR
cucgaggccgacggcgacaacuacucccccaagauggucgacuac

SEQ ID NO: 21494 - RNA, 45 nt, Artificial Sequence
  derived and/or modified sequence opt2 from anti-HIV_CDR
cucgaggccgacggcgacgacuacucccccaagauguucgacuac

SEQ ID NO: 21495 - RNA, 45 nt, Artificial Sequence
  derived and/or modified sequence opt2 from anti-HIV_CDR
cucgaggccgacggcuccgacuacucccccaagauguucgacuuc

SEQ ID NO: 21496 - RNA, 45 nt, Artificial Sequence
  derived and/or modified sequence opt2 from anti-HIV_CDR
cucgaggccgacggcgacgacuacucccccaagauguucgaccac

SEQ ID NO: 21497 - RNA, 45 nt, Artificial Sequence
  derived and/or modified sequence opt2 from anti-HIV_CDR
cucgaggccgacggcgacgacuacucccccaagauggucgacuac

SEQ ID NO: 21498 - RNA, 45 nt, Artificial Sequence
  derived and/or modified sequence opt2 from anti-HIV_CDR
gccccccgccucgaccucggcgagcucuccuccggcuuccacuuc

SEQ ID NO: 21499 - RNA, 45 nt, Artificial Sequence
  derived and/or modified sequence opt2 from anti-HIV_CDR
gccccccgccucgagcucggcgagcucuccuccggcuuccacuac

SEQ ID NO: 21500 - RNA, 45 nt, Artificial Sequence
  derived and/or modified sequence opt2 from anti-HIV_CDR
ggccgccuccucaugcaguggcccccccgcggcggcuucgacccc

SEQ ID NO: 21501 - RNA, 45 nt, Artificial Sequence
  derived and/or modified sequence opt2 from anti-HIV_CDR
ggccgccucuucaugcaguggcccccccgcggcggcuucgacccc

SEQ ID NO: 21502 - RNA, 45 nt, Artificial Sequence
  derived and/or modified sequence opt2 from anti-HIV_CDR
ggccgccucuucguccaguggcccccccagggcggcuucgacccc

SEQ ID NO: 21503 - RNA, 45 nt, Artificial Sequence
  derived and/or modified sequence opt2 from anti-HIV_CDR
ggccgccucuucaugcaguggcccccccagggcggcuucgacccc

SEQ ID NO: 21504 - RNA, 45 nt, Artificial Sequence
  derived and/or modified sequence opt2 from anti-HIV_CDR
ggccgccucuucguccaguggcccccccagggcggcuucgacacc

SEQ ID NO: 21505 - RNA, 45 nt, Artificial Sequence
  derived and/or modified sequence opt2 from anti-HIV_CDR
aacaacaacacccgcaaguccaucaacaucggccccggccgcgcc

SEQ ID NO: 21506 - RNA, 45 nt, Artificial Sequence; identical to SEQ ID NO: 13864
  derived and/or modified sequence opt2 from anti-HIV_CDR

SEQ ID NO: 21507 - RNA, 45 nt, Artificial Sequence
  derived and/or modified sequence opt2 from anti-HIV_CDR
gaccuccuccccgacuaccccgucuccuccgcccccgaggacuuc

SEQ ID NO: 21508 - RNA, 45 nt, Artificial Sequence
  derived and/or modified sequence opt2 from anti-HIV_CDR
gaguccuggcucuacuccaacggcgacuacuacuacauggacguc

SEQ ID NO: 21509 - RNA, 45 nt, Artificial Sequence
  derived and/or modified sequence opt2 from anti-HIV_CDR
cgcuacugcuccuccaccaccugcuaccgcggccacuucgacuac

SEQ ID NO: 21510 - RNA, 45 nt, Artificial Sequence
  derived and/or modified sequence opt2 from anti-HIV_CDR
cagaccaccgacgagggccgccaguggcucgucggcuuccagcac

SEQ ID NO: 21511 - RNA, 45 nt, Artificial Sequence
  derived and/or modified sequence opt2 from anti-HIV_CDR
cccuccuacggcggcuacgacgaccagggcugguacuucgaguac

SEQ ID NO: 21512 - RNA, 45 nt, Artificial Sequence
  derived and/or modified sequence opt2 from anti-HIV_CDR
gccgccauccccaucggcgacuccaaguacuccuacuucgacucc

SEQ ID NO: 21513 - RNA, 45 nt, Artificial Sequence
  derived and/or modified sequence opt2 from anti-HIV_CDR
gcccccccccccggcuccaccgagugggccuacuacuucgacuac

SEQ ID NO: 21514 - RNA, 45 nt, Artificial Sequence
  derived and/or modified sequence opt2 from anti-HIV_CDR
gcccaguuccacaacuccggcuacuacuacuccggccucgacuac

SEQ ID NO: 21515 - RNA, 45 nt, Artificial Sequence
  derived and/or modified sequence opt2 from anti-HIV_CDR
ggcggcuacgacuacggcgaccacuacuacuacuacauggacguc

SEQ ID NO: 21516 - RNA, 45 nt, Artificial Sequence
  derived and/or modified sequence opt2 from anti-HIV_CDR
ggcacccaguccuacuccgccgucgcccccggcugguucgacccc

SEQ ID NO: 21517 - RNA, 45 nt, Artificial Sequence
  derived and/or modified sequence opt2 from anti-HIV_CDR
aucaagggccccccccgcggcaacuucggcgucgccuucuacuuc

SEQ ID NO: 21518 - RNA, 45 nt, Artificial Sequence
  derived and/or modified sequence opt2 from anti-HIV_CDR
aaggucuacuccgacggcugguccccccccaccggcuucgucuac

SEQ ID NO: 21519 - RNA, 45 nt, Artificial Sequence
  derived and/or modified sequence opt2 from anti-HIV_CDR
cgcuacaaguaccuccccggcgaccagcacaugcccugggacaac

SEQ ID NO: 21520 - RNA, 45 nt, Artificial Sequence
  derived and/or modified sequence opt2 from anti-HIV_CDR
cgcuacaaguaccuccccggcgaccagcacaugcccugggacuac

SEQ ID NO: 21521 - RNA, 45 nt, Artificial Sequence
  derived and/or modified sequence opt2 from anti-HIV_CDR
ggcggcggcuacgccgucgucggccccaaguacggccucgacguc

SEQ ID NO: 21522 - RNA, 45 nt, Artificial Sequence
  derived and/or modified sequence opt2 from anti-HIV_CDR
cucgacuccuccuccggcugggaggaggucggcuacuucgaccgc

SEQ ID NO: 21523 - RNA, 45 nt, Artificial Sequence
  derived and/or modified sequence opt2 from anti-HIV_CDR
gagaacuacuccgacggcugggaggaggucggccacuucgacuac

SEQ ID NO: 21524 - RNA, 45 nt, Artificial Sequence
  derived and/or modified sequence opt2 from anti-HIV_CDR
gagaacuacuccgacggcugggaggaggucggccacuucgacucc

SEQ ID NO: 21525 - RNA, 45 nt, Artificial Sequence
  derived and/or modified sequence opt2 from anti-HIV_CDR
gagaacuacuccgacggcuggaacgaggucggccacuucgacuuc

SEQ ID NO: 21526 - RNA, 45 nt, Artificial Sequence
  derived and/or modified sequence opt2 from anti-HIV_CDR
gagaacuacuccgacggcugguacgaggucggccacuucgaccuc

SEQ ID NO: 21527 - RNA, 45 nt, Artificial Sequence
  derived and/or modified sequence opt2 from anti-HIV_CDR
gaccgccgccgcuuccucgaguggucccucuacggcauggacguc

SEQ ID NO: 21528 - RNA, 45 nt, Artificial Sequence
  derived and/or modified sequence opt2 from anti-HIV_CDR
ggcccccgcgucuucuucgaguccuccggcuacuacuuccgcgac

SEQ ID NO: 21529 - RNA, 45 nt, Artificial Sequence
  derived and/or modified sequence opt2 from anti-HIV_CDR
ggcccccgcguccucuucgaguccuccggccacuaccuccgcgac

SEQ ID NO: 21530 - RNA, 45 nt, Artificial Sequence
  derived and/or modified sequence opt2 from anti-HIV_CDR
ggcccccgcgucuucuucgaguccuccggcuacuacuuccgcaac

SEQ ID NO: 21531 - RNA, 45 nt, Artificial Sequence
  derived and/or modified sequence opt2 from anti-HIV_CDR
gagggcggcucccucugguucggcggcgccaacuggcucgacccc

SEQ ID NO: 21532 - RNA, 45 nt, Artificial Sequence
  derived and/or modified sequence opt2 from anti-HIV_CDR
gccgacuacgacaacaucugggacucccgcggcggcuucgaccuc

SEQ ID NO: 21533 - RNA, 45 nt, Artificial Sequence
  derived and/or modified sequence opt2 from anti-HIV_CDR
gucggcggcaccgucugguccggcuacuccaacuaccucgacuac

SEQ ID NO: 21534 - RNA, 45 nt, Artificial Sequence
  derived and/or modified sequence opt2 from anti-HIV_CDR
gacaaccgcgaccaguggcucguccuccgcuccugguucgacccc

SEQ ID NO: 21535 - RNA, 45 nt, Artificial Sequence
  derived and/or modified sequence opt2 from anti-HIV_CDR
gagaagggccagugggucacccucccccccuacuacuucgacucc

SEQ ID NO: 21536 - RNA, 48 nt, Artificial Sequence
  derived and/or modified sequence opt2 from anti-HIV_CDR
uacuucuccgacaccgaccgcuccgaguacucccccucccuccgcucc

SEQ ID NO: 21537 - RNA, 48 nt, Artificial Sequence
  derived and/or modified sequence opt2 from anti-HIV_CDR
uacaucuccgaccgcgaguccgccaccuacaaccccucccucaacucc

SEQ ID NO: 21538 - RNA, 48 nt, Artificial Sequence
  derived and/or modified sequence opt2 from anti-HIV_CDR
uacuucuccgacaccgagaaguccaacuacaaccccucccuccgcucc

SEQ ID NO: 21539 - RNA, 48 nt, Artificial Sequence
  derived and/or modified sequence opt2 from anti-HIV_CDR
uacaucuccgaccgcgccuccgccaccuacaaccccucccucaacucc

SEQ ID NO: 21540 - RNA, 48 nt, Artificial Sequence
  derived and/or modified sequence opt2 from anti-HIV_CDR
uacguccaccacuccggcgacaccaacuacaaccccucccucaagcgc

SEQ ID NO: 21541 - RNA, 48 nt, Artificial Sequence
  derived and/or modified sequence opt2 from anti-HIV_CDR
uacguccacaaguccggcgacaccaacuacucccccucccucaagucc

SEQ ID NO: 21542 - RNA, 48 nt, Artificial Sequence
  derived and/or modified sequence opt2 from anti-HIV_CDR
uacguccacgacuccggcgacaccaacuacaaccccucccucaagucc

SEQ ID NO: 21543 - RNA, 48 nt, Artificial Sequence
  derived and/or modified sequence opt2 from anti-HIV_CDR
uacaucuccaaguccgaguccgccaacuacaaccccucccucaacucc

SEQ ID NO: 21544 - RNA, 48 nt, Artificial Sequence
  derived and/or modified sequence opt2 from anti-HIV_CDR
uacaucuacuacuccggcuccaccaacuacaaccccucccucaagucc

SEQ ID NO: 21545 - RNA, 48 nt, Artificial Sequence
  derived and/or modified sequence opt2 from anti-HIV_CDR
uacguccacgacuccggcgacaucaacuacaaccccucccucaagaac

SEQ ID NO: 21546 - RNA, 48 nt, Artificial Sequence
  derived and/or modified sequence opt2 from anti-HIV_CDR
uccuacuacgacuucuccaucggcgacggcaacgacgccuucgacguc

SEQ ID NO: 21547 - RNA, 48 nt, Artificial Sequence
  derived and/or modified sequence opt2 from anti-HIV_CDR
ggcuuccgcggcucccccuucuccuccggcucccucuacuucgacucc

SEQ ID NO: 21548 - RNA, 48 nt, Artificial Sequence
  derived and/or modified sequence opt2 from anti-HIV_CDR
gucaucuccggccgcaucaccaucuucuacuacaacuacaucgacguc

SEQ ID NO: 21549 - RNA, 48 nt, Artificial Sequence
  derived and/or modified sequence opt2 from anti-HIV_CDR
gacggccucggcgaggucgcccccgacuaccgcuacggcaucgacguc

SEQ ID NO: 21550 - RNA, 48 nt, Artificial Sequence
  derived and/or modified sequence opt2 from anti-HIV_CDR
gacggccucggcgagcucgcccccgccuaccaguacggcaucgacguc

SEQ ID NO: 21551 - RNA, 48 nt, Artificial Sequence
  derived and/or modified sequence opt2 from anti-HIV_CDR
gacggccucggcgagcucgcccccgccuaccacuacggcaucgacguc

SEQ ID NO: 21552 - RNA, 48 nt, Artificial Sequence
  derived and/or modified sequence opt2 from anti-HIV_CDR
gacggccucggcgaggucgcccccgccuaccucuacggcaucgacgcc

SEQ ID NO: 21553 - RNA, 48 nt, Artificial Sequence
  derived and/or modified sequence opt2 from anti-HIV_CDR
gccgucaagggcuucugguucgacgaggucuacaacugguucggcccc

SEQ ID NO: 21554 - RNA, 48 nt, Artificial Sequence
  derived and/or modified sequence opt2 from anti-HIV_CDR
gccgucaagggcuucugguucgacgaccccuacaccugguucggcccc

SEQ ID NO: 21555 - RNA, 48 nt, Artificial Sequence
  derived and/or modified sequence opt2 from anti-HIV_CDR
gccgucaagggcuucugguucgacgagcccuccaccugguucggcccc

SEQ ID NO: 21556 - RNA, 48 nt, Artificial Sequence
  derived and/or modified sequence opt2 from anti-HIV_CDR
gccgucaagggccucugguucgacgagaccuacaccugguucggcccc

SEQ ID NO: 21557 - RNA, 48 nt, Artificial Sequence
  derived and/or modified sequence opt2 from anti-HIV_CDR
gccgucgccggccucugguucgaggacgccuacaacugguucggcccc

SEQ ID NO: 21558 - RNA, 48 nt, Artificial Sequence
  derived and/or modified sequence opt2 from anti-HIV_CDR
gccgaggccgagucccagucccacucccgccccaucauguucgacuac

SEQ ID NO: 21559 - RNA, 48 nt, Artificial Sequence
  derived and/or modified sequence opt2 from anti-HIV_CDR
gccgaggccgccuccgacucccacucccgccccaucauguucgaccac

SEQ ID NO: 21560 - RNA, 48 nt, Artificial Sequence
  derived and/or modified sequence opt2 from anti-HIV_CDR
cucgaggccgaguccgacucccacucccgccccaucauguucgaccac

SEQ ID NO: 21561 - RNA, 48 nt, Artificial Sequence
  derived and/or modified sequence opt2 from anti-HIV_CDR
gccgaggccgagucccagucccacucccgccccaucauguucgacucc

SEQ ID NO: 21562 - RNA, 48 nt, Artificial Sequence
  derived and/or modified sequence opt2 from anti-HIV_CDR
gccgaggccgagucccagucccacucccgccccaucauguucgacuuc

SEQ ID NO: 21563 - RNA, 48 nt, Artificial Sequence
  derived and/or modified sequence opt2 from anti-HIV_CDR
gacaacccccuccuccaguccggcgaguucuccuccucccucgagaac

SEQ ID NO: 21564 - RNA, 48 nt, Artificial Sequence
  derived and/or modified sequence opt2 from anti-HIV_CDR
gacaacccccuccuccaguccggcgaguucuccuccucccucgacaac

SEQ ID NO: 21565 - RNA, 48 nt, Artificial Sequence
  derived and/or modified sequence opt2 from anti-HIV_CDR
ggccgcgacuacaacuucuggggcggcggcggcaagaucaacuucccc

SEQ ID NO: 21566 - RNA, 48 nt, Artificial Sequence
  derived and/or modified sequence opt2 from anti-HIV_CDR
accaacugggccaacgacuucgucaccggcuacuaccgcuucgacuuc

SEQ ID NO: 21567 - RNA, 48 nt, Artificial Sequence
  derived and/or modified sequence opt2 from anti-HIV_CDR
gccggccacugcuccuccaccuccuccgucuacugccccuucgacaug

SEQ ID NO: 21568 - RNA, 48 nt, Artificial Sequence
  derived and/or modified sequence opt2 from anti-HIV_CDR
caggucuccuccuacuccuccuccggcuaccgccgcgaguucgacuac

SEQ ID NO: 21569 - RNA, 48 nt, Artificial Sequence
  derived and/or modified sequence opt2 from anti-HIV_CDR
cgcauggccacccucaccggcggcuacuacuacuacuacauggacguc

SEQ ID NO: 21570 - RNA, 48 nt, Artificial Sequence
  derived and/or modified sequence opt2 from anti-HIV_CDR
gagggcggcuacuccgacuucugguccggcuacuccggcuucgacuac

SEQ ID NO: 21571 - RNA, 48 nt, Artificial Sequence
  derived and/or modified sequence opt2 from anti-HIV_CDR
cucuacuacaacuucggcuccggcuacgacaccggcaucggcgaccac

SEQ ID NO: 21572 - RNA, 48 nt, Artificial Sequence
  derived and/or modified sequence opt2 from anti-HIV_CDR
gcccgcgagggccgcugguucuccgacaacuacuacgccauggacguc

SEQ ID NO: 21573 - RNA, 48 nt, Artificial Sequence
  derived and/or modified sequence opt2 from anti-HIV_CDR
gaccgcgucggccgccgccucggcgagcucuccgccggcuucgacuac

SEQ ID NO: 21574 - RNA, 48 nt, Artificial Sequence
  derived and/or modified sequence opt2 from anti-HIV_CDR
gcccgcccccgcucccccugggacuccaccggcugguccgucggcuac

SEQ ID NO: 21575 - RNA, 48 nt, Artificial Sequence
  derived and/or modified sequence opt2 from anti-HIV_CDR
uccuacuacgacuuccgcuccgacuccggcaacgacgccuucgacauc

SEQ ID NO: 21576 - RNA, 48 nt, Artificial Sequence
  derived and/or modified sequence opt2 from anti-HIV_CDR
uccuacuacgacuuccagaccgacuccggcaacgacgccuucgacguc

SEQ ID NO: 21577 - RNA, 48 nt, Artificial Sequence
  derived and/or modified sequence opt2 from anti-HIV_CDR
gacaaccccguccuccagcucggcgagcucuccuccucccucgacuac

SEQ ID NO: 21578 - RNA, 48 nt, Artificial Sequence
  derived and/or modified sequence opt2 from anti-HIV_CDR
ggcuuccgcggcucccccuucuccuccggcuccauguacuucgacucc

SEQ ID NO: 21579 - RNA, 48 nt, Artificial Sequence
  derived and/or modified sequence opt2 from anti-HIV_CDR
ggcuuccgcggcuccccccucuccuccggcucccucuacuucgacucc

SEQ ID NO: 21580 - RNA, 48 nt, Artificial Sequence
  derived and/or modified sequence opt2 from anti-HIV_CDR
ggcuuccgcggcaacgucuucuccaccggcugguucuaccucgacuuc

SEQ ID NO: 21581 - RNA, 48 nt, Artificial Sequence
  derived and/or modified sequence opt2 from anti-HIV_CDR
gaccgccucuccuucuccguccaggucgagcagggcguccucgacuac

SEQ ID NO: 21582 - RNA, 48 nt, Artificial Sequence
  derived and/or modified sequence opt2 from anti-HIV_CDR
gaccgccucuccuucuccguccaggucgagcagggcguccuccaguuc

SEQ ID NO: 21583 - RNA, 48 nt, Artificial Sequence
  derived and/or modified sequence opt2 from anti-HIV_CDR
guccucuccggccgcaucaccaucuucuacuacuacuacauggacguc

SEQ ID NO: 21584 - RNA, 51 nt, Artificial Sequence
  derived and/or modified sequence opt2 from anti-HIV_CDR
uacaucuccuccggcuccuccacccuccacuacgccgacaccgucaagggc

SEQ ID NO: 21585 - RNA, 51 nt, Artificial Sequence
  derived and/or modified sequence opt2 from anti-HIV_CDR
cgcuaccucgacuggucccccaucggccgcgacaccuacggcaccgacguc

SEQ ID NO: 21586 - RNA, 51 nt, Artificial Sequence
  derived and/or modified sequence opt2 from anti-HIV_CDR
cgcuacuucgacuggucccccuuccgccgcgacaccuacggcaccgacguc

SEQ ID NO: 21587 - RNA, 51 nt, Artificial Sequence
  derived and/or modified sequence opt2 from anti-HIV_CDR
ggccgcgacuacaacuucugguccggcggcggccgcuacuacuucgacuuc

SEQ ID NO: 21588 - RNA, 51 nt, Artificial Sequence
  derived and/or modified sequence opt2 from anti-HIV_CDR
ggcauccaggaggacuacgacuucuggcgcgaguaccgcgagcucgacuac

SEQ ID NO: 21589 - RNA, 51 nt, Artificial Sequence
  derived and/or modified sequence opt2 from anti-HIV_CDR
guccucaacaacaacacccgcaaguccaucaacaucggccccggccgcgcc

SEQ ID NO: 21590 - RNA, 51 nt, Artificial Sequence
  derived and/or modified sequence opt2 from anti-HIV_CDR
gaccucaacuucggcgucgucacccccuacuacuacuacuaccucgacguc

SEQ ID NO: 21591 - RNA, 51 nt, Artificial Sequence
  derived and/or modified sequence opt2 from anti-HIV_CDR
cacggccgcaccgucuucggcgucguccgcaacuacuacuacauggacguc

SEQ ID NO: 21592 - RNA, 51 nt, Artificial Sequence
  derived and/or modified sequence opt2 from anti-HIV_CDR
cacuacuacggcuccggccucaccaaggacuacuacgaguacaucgacguc

SEQ ID NO: 21593 - RNA, 51 nt, Artificial Sequence
  derived and/or modified sequence opt2 from anti-HIV_CDR
accuacuacaacuucugguccgaccagucccagggccucgacuucgacuac

SEQ ID NO: 21594 - RNA, 51 nt, Artificial Sequence
  derived and/or modified sequence opt2 from anti-HIV_CDR
ggcgucugggaggcccccgacggcuccuccuacuacuacuacauggccgac

SEQ ID NO: 21595 - RNA, 51 nt, Artificial Sequence
  derived and/or modified sequence opt2 from anti-HIV_CDR
gaccagggcggcuaccccgucucccccgucggccccaagugguucgacccc

SEQ ID NO: 21596 - RNA, 51 nt, Artificial Sequence
  derived and/or modified sequence opt2 from anti-HIV_CDR
cgcgacaaguaccaguacaucgacuccuccggcgacuaccccuucgaccgc

SEQ ID NO: 21597 - RNA, 51 nt, Artificial Sequence
  derived and/or modified sequence opt2 from anti-HIV_CDR
cagcuccgcgcccccaccacccgcuuccgccacggcggcuacuucgagaac

SEQ ID NO: 21598 - RNA, 51 nt, Artificial Sequence
  derived and/or modified sequence opt2 from anti-HIV_CDR
cagguccgcgcccccacccuccgcuuccgccacggcggcuacuucgagacc

SEQ ID NO: 21599 - RNA, 51 nt, Artificial Sequence
  derived and/or modified sequence opt2 from anti-HIV_CDR
gucuccaucaccuacgccggccucaucgucguccccggcgccuucgacguc

SEQ ID NO: 21600 - RNA, 51 nt, Artificial Sequence
  derived and/or modified sequence opt2 from anti-HIV_CDR
gucgccaucuccuacgccggccucaucgucguccccggccccuucgacguc

SEQ ID NO: 21601 - RNA, 51 nt, Artificial Sequence
  derived and/or modified sequence opt2 from anti-HIV_CDR
ucccucaccggccgccuccaccucggcgagcucuccuccggcaucggcccc

SEQ ID NO: 21602 - RNA, 51 nt, Artificial Sequence
  derived and/or modified sequence opt2 from anti-HIV_CDR
ggcggcuccgcccucaucaccaucuucggcgucgaccccaaguucgacccc

SEQ ID NO: 21603 - RNA, 51 nt, Artificial Sequence
  derived and/or modified sequence opt2 from anti-HIV_CDR
auggcccucaccuccggccccuacgacgucuccggcuacuacuucgacuac

SEQ ID NO: 21604 - RNA, 51 nt, Artificial Sequence
  derived and/or modified sequence opt2 from anti-HIV_CDR
auggcccucgccuccggccccuacgacgucuccggcuacuacuucgacuac

SEQ ID NO: 21605 - RNA, 51 nt, Artificial Sequence
  derived and/or modified sequence opt2 from anti-HIV_CDR
auggcccuccccuccggcccccucgaccgcuccggcuacuacuucgacgac

SEQ ID NO: 21606 - RNA, 54 nt, Artificial Sequence
  derived and/or modified sequence opt2 from anti-HIV_CDR
gucguccccauguucuccaucuucggcgucgucaaggccaacuacuucgacuac

SEQ ID NO: 21607 - RNA, 54 nt, Artificial Sequence
  derived and/or modified sequence opt2 from anti-HIV_CDR
aaccgccgcgucgccaugcccgaggccaugauccucuccuucuacauggacguc

SEQ ID NO: 21608 - RNA, 54 nt, Artificial Sequence
  derived and/or modified sequence opt2 from anti-HIV_CDR
ggccucugccgcggcggcaacugccgccucggccccuccggcuggcucgacccc

SEQ ID NO: 21609 - RNA, 54 nt, Artificial Sequence
  derived and/or modified sequence opt2 from anti-HIV_CDR
acccccccccacuacgacguccucaccggcuaccccuccuccguccucgaguuc

SEQ ID NO: 21610 - RNA, 54 nt, Artificial Sequence
  derived and/or modified sequence opt2 from anti-HIV_CDR
auccccuaccacuccgaguccuacuacaaggucgucaucggcggcuucgacguc

SEQ ID NO: 21611 - RNA, 54 nt, Artificial Sequence
  derived and/or modified sequence opt2 from anti-HIV_CDR
gccgaccccuucaaggucgcccaggacgagggccucuucgucaucuucgacuac

SEQ ID NO: 21612 - RNA, 54 nt, Artificial Sequence
  derived and/or modified sequence opt2 from anti-HIV_CDR
gccgaccccuucaaggucgcccaggacgagggccucuacgucaucuucgacuac

SEQ ID NO: 21613 - RNA, 54 nt, Artificial Sequence
  derived and/or modified sequence opt2 from anti-HIV_CDR
gccgaccgcuucaaggucgcccaggacgagggccucuucgucaucuucgacuac

SEQ ID NO: 21614 - RNA, 54 nt, Artificial Sequence
  derived and/or modified sequence opt2 from anti-HIV_CDR
ggccgccagaccuuccgcgccaucugguccggcccccccgccgucuucgacauc

SEQ ID NO: 21615 - RNA, 54 nt, Artificial Sequence
  derived and/or modified sequence opt2 from anti-HIV_CDR
ggccgccagaccuuccgcgccaucugguccggcccccccgucgucuucgacauc

SEQ ID NO: 21616 - RNA, 54 nt, Artificial Sequence
  derived and/or modified sequence opt2 from anti-HIV_CDR
ucccgcggcgacuacaacuucugguccggcuaccccgaguaccacuucgaccgc

SEQ ID NO: 21617 - RNA, 54 nt, Artificial Sequence
  derived and/or modified sequence opt2 from anti-HIV_CDR
cuccccaagucccgcauggucggcggcgaccaccuccccuucuaccccgacuuc

SEQ ID NO: 21618 - RNA, 54 nt, Artificial Sequence
  derived and/or modified sequence opt2 from anti-HIV_CDR
cucaccggccccuccggcuacugcgacuccuccggcugcuacugguucgacccc

SEQ ID NO: 21619 - RNA, 54 nt, Artificial Sequence
  derived and/or modified sequence opt2 from anti-HIV_CDR
ggcggcuccaugauccgcggcguccccucccccuucuacuacggcauggacguc

SEQ ID NO: 21620 - RNA, 54 nt, Artificial Sequence
  derived and/or modified sequence opt2 from anti-HIV_CDR
cucuucggcgccaagcgccucggcgucgcccccuccggcuacuacauggacguc

SEQ ID NO: 21621 - RNA, 54 nt, Artificial Sequence
  derived and/or modified sequence opt2 from anti-HIV_CDR
gaccgcuacgaggccgccugguucggcgccgacaaggucuacggcauggacguc

SEQ ID NO: 21622 - RNA, 54 nt, Artificial Sequence
  derived and/or modified sequence opt2 from anti-HIV_CDR
gagcaccgccuccccccccccaccggccgccgcacccgcaacugguucgacccc

SEQ ID NO: 21623 - RNA, 54 nt, Artificial Sequence
  derived and/or modified sequence opt2 from anti-HIV_CDR
ggccgcggcuccuuccagggcuuccagcaguacgaguacuacggcauggacguc

SEQ ID NO: 21624 - RNA, 54 nt, Artificial Sequence
  derived and/or modified sequence opt2 from anti-HIV_CDR
ggccgcggcuacucccacggcuuccagcaguacaacuacuacggcauggacguc

SEQ ID NO: 21625 - RNA, 54 nt, Artificial Sequence
  derived and/or modified sequence opt2 from anti-HIV_CDR
ggccgcggcuccuucaccggcuucgaccaguaccacuacuacggcauggacguc

SEQ ID NO: 21626 - RNA, 54 nt, Artificial Sequence
  derived and/or modified sequence opt2 from anti-HIV_CDR
ggccgcggcuccaccuuccccuccgcccaguucuccuacuucggccucgacguc

SEQ ID NO: 21627 - RNA, 54 nt, Artificial Sequence
  derived and/or modified sequence opt2 from anti-HIV_CDR
gaccucgcccgcuacggcgucaccuccaucguccccgaguucggcuucgacuuc

SEQ ID NO: 21628 - RNA, 54 nt, Artificial Sequence
  derived and/or modified sequence opt2 from anti-HIV_CDR
cgcggccgccucaacauccccucccccuccgccauccucaccgccuucgacguc

SEQ ID NO: 21629 - RNA, 54 nt, Artificial Sequence
  derived and/or modified sequence opt2 from anti-HIV_CDR
ggccccggcuccaugguccgcggccucaucgucaccuccuacggcauggacguc

SEQ ID NO: 21630 - RNA, 54 nt, Artificial Sequence
  derived and/or modified sequence opt2 from anti-HIV_CDR
aagcgcgucaccaucuucggcgucgucgacaccccccgcggcuacuucgacuac

SEQ ID NO: 21631 - RNA, 54 nt, Artificial Sequence
  derived and/or modified sequence opt2 from anti-HIV_CDR
ggccagcgcaacguccuccacuuccucgagcgcaagaacgacgccuucgacauc

SEQ ID NO: 21632 - RNA, 54 nt, Artificial Sequence
  derived and/or modified sequence opt2 from anti-HIV_CDR
gagcagaaggacuacgacuucuggaacggccucuacaaguacggcauggacguc

SEQ ID NO: 21633 - RNA, 57 nt, Artificial Sequence
  derived and/or modified sequence opt2 from anti-HIV_CDR
gacaccaccaccuucaccaccuucggcggcggccccaacaugggcggcuucgacccc

SEQ ID NO: 21634 - RNA, 57 nt, Artificial Sequence
  derived and/or modified sequence opt2 from anti-HIV_CDR
gccggccucgacuacaacuucuggaacggcaagggccgcaagggcgccuucgacguc

SEQ ID NO: 21635 - RNA, 57 nt, Artificial Sequence
  derived and/or modified sequence opt2 from anti-HIV_CDR
aacgaggccgacuaccacgacggcaacggccacucccuccgcggcauguucgacuac

SEQ ID NO: 21636 - RNA, 57 nt, Artificial Sequence
  derived and/or modified sequence opt2 from anti-HIV_CDR
aacgagccccaguaccacgacggcaacggccacucccuccccggcauguucgacucc

SEQ ID NO: 21637 - RNA, 57 nt, Artificial Sequence
  derived and/or modified sequence opt2 from anti-HIV_CDR
aacgagccccaguaccacgacgacaacggccacucccuccccggcaugaucgacuac

SEQ ID NO: 21638 - RNA, 57 nt, Artificial Sequence
  derived and/or modified sequence opt2 from anti-HIV_CDR
aacgagccccaguaccacgacggcaacggccacucccuccccggcauguucgacuuc

SEQ ID NO: 21639 - RNA, 57 nt, Artificial Sequence
  derived and/or modified sequence opt2 from anti-HIV_CDR
aacgagccccaguacuucgacggcuccggccacucccuccccggcauguucgacuac

SEQ ID NO: 21640 - RNA, 57 nt, Artificial Sequence
  derived and/or modified sequence opt2 from anti-HIV_CDR
cgcgaggccgacuaccacgacggcaacggccacacccuccccggcauguucgacuuc

SEQ ID NO: 21641 - RNA, 57 nt, Artificial Sequence
  derived and/or modified sequence opt2 from anti-HIV_CDR
aacgagccccaguacuacgacggcuccggccacucccuccccggcauguucgacuac

SEQ ID NO: 21642 - RNA, 57 nt, Artificial Sequence
  derived and/or modified sequence opt2 from anti-HIV_CDR
aacgagccccaguaccacgacggcaacggccacucccuccccggcauguucgacuac

SEQ ID NO: 21643 - RNA, 57 nt, Artificial Sequence
  derived and/or modified sequence opt2 from anti-HIV_CDR
caggacuccgacuuccacgacggccacggccacacccuccgcggcauguucgacucc

SEQ ID NO: 21644 - RNA, 57 nt, Artificial Sequence
  derived and/or modified sequence opt2 from anti-HIV_CDR
cucgacuggguccgcggcgucaugaaccucgucgagaaccacuacgccauggacguc

SEQ ID NO: 21645 - RNA, 57 nt, Artificial Sequence
  derived and/or modified sequence opt2 from anti-HIV_CDR
accaacggcaccgagaucuuccgccccggcggcggcgacaugcgcgacaacuggcgc

SEQ ID NO: 21646 - RNA, 57 nt, Artificial Sequence
  derived and/or modified sequence opt2 from anti-HIV_CDR
gacggccgcuacuccggcgacgaccaguacuacuaccacuacuacuacauggacguc

SEQ ID NO: 21647 - RNA, 57 nt, Artificial Sequence
  derived and/or modified sequence opt2 from anti-HIV_CDR
cucaccaagaaccccucccaggacuucuggggcuccuaccucuacuacuucgaggac

SEQ ID NO: 21648 - RNA, 57 nt, Artificial Sequence
  derived and/or modified sequence opt2 from anti-HIV_CDR
ggcgccaccuacuacuacgacuccuccggccaccagucccgccgcgccuucgacauc

SEQ ID NO: 21649 - RNA, 57 nt, Artificial Sequence
  derived and/or modified sequence opt2 from anti-HIV_CDR
gccuuccaggccuccaugguccgcggcgucaucgucgaccccuacggcauggacguc

SEQ ID NO: 21650 - RNA, 57 nt, Artificial Sequence
  derived and/or modified sequence opt2 from anti-HIV_CDR
caccgcgccgacuacgacuucuggaacggcuccaaccuccgcggcuacuucgacccc

SEQ ID NO: 21651 - RNA, 57 nt, Artificial Sequence
  derived and/or modified sequence opt2 from anti-HIV_CDR
caccgcgccaacuacgacuucuggggcggcuccaaccuccgcggcuacuucgacccc

SEQ ID NO: 21652 - RNA, 57 nt, Artificial Sequence
  derived and/or modified sequence opt2 from anti-HIV_CDR
ggcuuccacuucugguccggcaccggcacccgcccccgcaacugguacuucgaccuc

SEQ ID NO: 21653 - RNA, 57 nt, Artificial Sequence
  derived and/or modified sequence opt2 from anti-HIV_CDR
aacuaccucaucgagucccgcuacgacgagaaggacuacuacuacgccauggacguc

SEQ ID NO: 21654 - RNA, 57 nt, Artificial Sequence
  derived and/or modified sequence opt2 from anti-HIV_CDR
ucccgcggcuacgccuacgacuccggcggccacuacuuccccaccugguucgacccc

SEQ ID NO: 21655 - RNA, 57 nt, Artificial Sequence
  derived and/or modified sequence opt2 from anti-HIV_CDR
gacaccaccaccuucggcgccuucggcggcucccccaacaugggcggccucgacccc

SEQ ID NO: 21656 - RNA, 57 nt, Artificial Sequence
  derived and/or modified sequence opt2 from anti-HIV_CDR
caccucgucgucgccgucgccgccggccccgacuacuucuccuacggcauggacguc

SEQ ID NO: 21657 - RNA, 57 nt, Artificial Sequence
  derived and/or modified sequence opt2 from anti-HIV_CDR
gacaccaccaccuucuccuccuucggcuccccccccaacaugggcggccucgacccc

SEQ ID NO: 21658 - RNA, 57 nt, Artificial Sequence
  derived and/or modified sequence opt2 from anti-HIV_CDR
gacaccaccaccuucggcgccuucggcggcggcgccaacaugggcggccucgacccc

SEQ ID NO: 21659 - RNA, 57 nt, Artificial Sequence
  derived and/or modified sequence opt2 from anti-HIV_CDR
gacaccaccaccuucaccuccuucggcucccccccccgcaugggcggccucgacccc

SEQ ID NO: 21660 - RNA, 57 nt, Artificial Sequence
  derived and/or modified sequence opt2 from anti-HIV_CDR
gacaccaccaccuucuccuccuucggcucccccccccacaugggcggccucgacccc

SEQ ID NO: 21661 - RNA, 57 nt, Artificial Sequence
  derived and/or modified sequence opt2 from anti-HIV_CDR
gaccgcgucuccgacuacgacuucugguccggcaagcgcggcuacggcauggacguc

SEQ ID NO: 21662 - RNA, 57 nt, Artificial Sequence
  derived and/or modified sequence opt2 from anti-HIV_CDR
gagcucuccggcgaguaccacuucugguccggcaccuaccgcuacggcgucgacguc

SEQ ID NO: 21663 - RNA, 57 nt, Artificial Sequence
  derived and/or modified sequence opt2 from anti-HIV_CDR
cacggcgccuccgagaacuacggccccggcuccuacuccgccgagcacuuccagcac

SEQ ID NO: 21664 - RNA, 57 nt, Artificial Sequence
  derived and/or modified sequence opt2 from anti-HIV_CDR
cacggcgccuccgccaacuacggccccggcuccuacuccgccgagcacuuccagcac

SEQ ID NO: 21665 - RNA, 60 nt, Artificial Sequence
  derived and/or modified sequence opt2 from anti-HIV_CDR
cacgaggccccccgcuacuccuacgccuuccgccgcuacuaccacuacggccucgacguc

SEQ ID NO: 21666 - RNA, 60 nt, Artificial Sequence
  derived and/or modified sequence opt2 from anti-HIV_CDR
accuccaccuacgaccagugguccggccuccaccacgacggcgucauggccuucuccucc

SEQ ID NO: 21667 - RNA, 60 nt, Artificial Sequence
  derived and/or modified sequence opt2 from anti-HIV_CDR
ggcgaguucgacuccuccggcuucgacuacgaguccugguaccccuacuacauggacguc

SEQ ID NO: 21668 - RNA, 60 nt, Artificial Sequence
  derived and/or modified sequence opt2 from anti-HIV_CDR
ggccagaccgaccucaacgacgacuucugguccgaguacuccacccccggcuucgacuac

SEQ ID NO: 21669 - RNA, 60 nt, Artificial Sequence
  derived and/or modified sequence opt2 from anti-HIV_CDR
ggccagaccgaccucaacgacgaccucugguccgacuacuccacccccggcuucgacuac

SEQ ID NO: 21670 - RNA, 60 nt, Artificial Sequence
  derived and/or modified sequence opt2 from anti-HIV_CDR
aaccucaucgaggagucccagacccagcaggagaucaacgagcgcgaccuccucgcccuc

SEQ ID NO: 21671 - RNA, 60 nt, Artificial Sequence
  derived and/or modified sequence opt2 from anti-HIV_CDR
aaccucaucgaggagucccagauccagcaggagaagaacgagaaggagcuccucgagcuc

SEQ ID NO: 21672 - RNA, 60 nt, Artificial Sequence
  derived and/or modified sequence opt2 from anti-HIV_CDR
ucccucaucgagaacucccagauccagcaggagaagaacgagcaggaccuccuccagcuc

SEQ ID NO: 21673 - RNA, 60 nt, Artificial Sequence
  derived and/or modified sequence opt2 from anti-HIV_CDR
ucccucaucgaggagucccagauccagcaggagaagaacgagaaggagcuccucgagcuc

SEQ ID NO: 21674 - RNA, 60 nt, Artificial Sequence
  derived and/or modified sequence opt2 from anti-HIV_CDR
cgccucaucgaggagucccagacccagcaggagaagaacgagcaggagcuccucgagcuc

SEQ ID NO: 21675 - RNA, 60 nt, Artificial Sequence
  derived and/or modified sequence opt2 from anti-HIV_CDR
ucccucaucgaggagucccagacccagcaggagaagaacgagaaggagcuccucgagcuc

SEQ ID NO: 21676 - RNA, 60 nt, Artificial Sequence
  derived and/or modified sequence opt2 from anti-HIV_CDR
aaccuccucgaggagucccagaaccagcaggagaagaacgagcaggagcuccucgagcuc

SEQ ID NO: 21677 - RNA, 60 nt, Artificial Sequence
  derived and/or modified sequence opt2 from anti-HIV_CDR
acccucaucgaggagucccagaaccagcaggagaagaacgagcucgagcuccucgagcuc

SEQ ID NO: 21678 - RNA, 60 nt, Artificial Sequence
  derived and/or modified sequence opt2 from anti-HIV_CDR
acccuccaggaggagucccagaaccagcaggagaagaacgagcaggagcuccucgagcuc

SEQ ID NO: 21679 - RNA, 60 nt, Artificial Sequence
  derived and/or modified sequence opt2 from anti-HIV_CDR
ucccuccucgaggagucccagaaccagcaggagaagaacgagcaggagcuccucgagcuc

SEQ ID NO: 21680 - RNA, 60 nt, Artificial Sequence
  derived and/or modified sequence opt2 from anti-HIV_CDR
acccucaucgaggagucccagaaccagcaggagaagaaccagcaggagcuccuccagcuc

SEQ ID NO: 21681 - RNA, 60 nt, Artificial Sequence
  derived and/or modified sequence opt2 from anti-HIV_CDR
acccucaucgaggagucccagaaccagcaggagaagaacgagcaggagcuccucggccuc

SEQ ID NO: 21682 - RNA, 60 nt, Artificial Sequence
  derived and/or modified sequence opt2 from anti-HIV_CDR
acccucaucgaggagucccagaaccagcaggagaagaacgagcaggagcuccucgagcuc

SEQ ID NO: 21683 - RNA, 60 nt, Artificial Sequence
  derived and/or modified sequence opt2 from anti-HIV_CDR
ucccucaucgaggacucccagauccagcaggagaagaacgagaaggagcuccucgagcuc

SEQ ID NO: 21684 - RNA, 60 nt, Artificial Sequence
  derived and/or modified sequence opt2 from anti-HIV_CDR
ucccuccucgagaagucccagacccagcaggagaagaacgagcaggagcuccucgagcuc

SEQ ID NO: 21685 - RNA, 60 nt, Artificial Sequence
  derived and/or modified sequence opt2 from anti-HIV_CDR
ucccucaucgaggagucccagaaccagcaggagaagaacgagcaggagcuccucgagcuc

SEQ ID NO: 21686 - RNA, 60 nt, Artificial Sequence
  derived and/or modified sequence opt2 from anti-HIV_CDR
ggcgaccuccucggcuacaccgacuccugguacgaguucgacuacuacuacauggacguc

SEQ ID NO: 21687 - RNA, 60 nt, Artificial Sequence
  derived and/or modified sequence opt2 from anti-HIV_CDR
gacaccaacggcaccgagaucuuccgccccggcggcggcgacaugcgcgacaacuggcgc

SEQ ID NO: 21688 - RNA, 60 nt, Artificial Sequence
  derived and/or modified sequence opt2 from anti-HIV_CDR
gacgucgucgagcgccccggcuucggcgacuuccgcuacgacuacuacggcauggacguc

SEQ ID NO: 21689 - RNA, 60 nt, Artificial Sequence
  derived and/or modified sequence opt2 from anti-HIV_CDR
gaccagcgcgacugcuccaccaaccgcugcuucggcgucuucggcuacuacauggacguc

SEQ ID NO: 21690 - RNA, 60 nt, Artificial Sequence
  derived and/or modified sequence opt2 from anti-HIV_CDR
gaccgcuggguccgcccccaguuccccuccauggacuuccaguacaacggccucgacguc

SEQ ID NO: 21691 - RNA, 60 nt, Artificial Sequence
  derived and/or modified sequence opt2 from anti-HIV_CDR
gacuccggcuucgaccucgacuacuacgacaccaacgagcucuacuucggcuucgacuac

SEQ ID NO: 21692 - RNA, 60 nt, Artificial Sequence
  derived and/or modified sequence opt2 from anti-HIV_CDR
aaguaccccgccuacuacgacauccucaccgccaacuaccgcuccuacuacuucgacuac

SEQ ID NO: 21693 - RNA, 60 nt, Artificial Sequence
  derived and/or modified sequence opt2 from anti-HIV_CDR
aaguaccccgccuacuacgacauccucaccggcuacuaccgcaacuacuacuucgacuac

SEQ ID NO: 21694 - RNA, 60 nt, Artificial Sequence
  derived and/or modified sequence opt2 from anti-HIV_CDR
cgcgucaaguucccccucugguucggcgagaccaccuacuacuacuacggcauggacguc

SEQ ID NO: 21695 - RNA, 60 nt, Artificial Sequence
  derived and/or modified sequence opt2 from anti-HIV_CDR
gagcgcuccaccaaguacuccuucugguccgccgucaugcgccccgacgccuucgaccuc

SEQ ID NO: 21696 - RNA, 60 nt, Artificial Sequence
  derived and/or modified sequence opt2 from anti-HIV_CDR
cacgaggccccccgcuacuccuacgccuuccgcaacuacuaccacuacggccucgacguc

SEQ ID NO: 21697 - RNA, 60 nt, Artificial Sequence
  derived and/or modified sequence opt2 from anti-HIV_CDR
gagaacguccucauggaguccgacgacuacaacgacuacuacuacuacuacauggacguc

SEQ ID NO: 21698 - RNA, 60 nt, Artificial Sequence
  derived and/or modified sequence opt2 from anti-HIV_CDR
gagcgcguccucgucuuccccgaccaggacgccgacuacuacuacuacuucuucgacguc

SEQ ID NO: 21699 - RNA, 60 nt, Artificial Sequence
  derived and/or modified sequence opt2 from anti-HIV_CDR
gagcgcguccucgucguccccgaccaggacgccgacuacuacuacuacuucuucgacguc

SEQ ID NO: 21700 - RNA, 63 nt, Artificial Sequence
  derived and/or modified sequence opt2 from anti-HIV_CDR
gaccgcuccuccgccaucggcuacugcuccuccaucuccugcuacaagggcuccuucgacauc

SEQ ID NO: 21701 - RNA, 63 nt, Artificial Sequence
  derived and/or modified sequence opt2 from anti-HIV_CDR
gucgucaagaucgagccccucggcgucgcccccaccaaggccaagcgcgucgcccgcgagaag

SEQ ID NO: 21702 - RNA, 63 nt, Artificial Sequence
  derived and/or modified sequence opt2 from anti-HIV_CDR
gucguccgcaucgagccccucggcgucgcccccaccaaggccaagcgcgucgagcgcgagaag

SEQ ID NO: 21703 - RNA, 63 nt, Artificial Sequence
  derived and/or modified sequence opt2 from anti-HIV_CDR
gucguccgcaucgagccccucggcaucgcccccacccgcgccaagcgcgucgagcgcgagaag

SEQ ID NO: 21704 - RNA, 63 nt, Artificial Sequence
  derived and/or modified sequence opt2 from anti-HIV_CDR
gucgucaagaucgagcccaucggcgucgcccccaccaaggcccgccgcgucgagcgcgagaag

SEQ ID NO: 21705 - RNA, 63 nt, Artificial Sequence
  derived and/or modified sequence opt2 from anti-HIV_CDR
gucgucaagaucgagccccucggcgucgcccccacccgcgccaagcgcgucgagcgcgagaag

SEQ ID NO: 21706 - RNA, 63 nt, Artificial Sequence
  derived and/or modified sequence opt2 from anti-HIV_CDR
gucguccagaucgagccccucggcgucgcccccacccgcgccaagcgcgucgagcgcgagaag

SEQ ID NO: 21707 - RNA, 63 nt, Artificial Sequence
  derived and/or modified sequence opt2 from anti-HIV_CDR
gucguccgcaucgagccccucggcgucgcccccaccaaggccaagcgcguccagcgcgagaag

SEQ ID NO: 21708 - RNA, 63 nt, Artificial Sequence
  derived and/or modified sequence opt2 from anti-HIV_CDR
gucgucaagaucgagccccucggcgucgcccccaccaaggccaagcgcguccagcgcaagaag

SEQ ID NO: 21709 - RNA, 63 nt, Artificial Sequence
  derived and/or modified sequence opt2 from anti-HIV_CDR
gucaucaagaucgagccccucaucgucgcccccaccaaggccaagcgcguccagcgcgagaag

SEQ ID NO: 21710 - RNA, 63 nt, Artificial Sequence
  derived and/or modified sequence opt2 from anti-HIV_CDR
gucgucaagaucgagccccucggcgucgcccccaccaaggcccgccgcguccagcgcgagaag

SEQ ID NO: 21711 - RNA, 63 nt, Artificial Sequence
  derived and/or modified sequence opt2 from anti-HIV_CDR
gucgucaagaucgagcuccucggcgucgcccccaccaaggccaagcgcguccagcgcgagaag

SEQ ID NO: 21712 - RNA, 63 nt, Artificial Sequence
  derived and/or modified sequence opt2 from anti-HIV_CDR
gucgucaccaucgagccccucggcgucgcccccaccaaggccaagcgcguccagcgcgagaag

SEQ ID NO: 21713 - RNA, 63 nt, Artificial Sequence
  derived and/or modified sequence opt2 from anti-HIV_CDR
gucgucaagaucgagccccucggcgucgcccccaccaaggccaagcgcguccagcgcgagaag

SEQ ID NO: 21714 - RNA, 63 nt, Artificial Sequence
  derived and/or modified sequence opt2 from anti-HIV_CDR
gaccucgucuccgucuccccccccuacggcaacuacggccccgacaacaacugguucgacuuc

SEQ ID NO: 21715 - RNA, 63 nt, Artificial Sequence
  derived and/or modified sequence opt2 from anti-HIV_CDR
augaacccccccugguuccgcggcggcuccaacaaccccuacuccuacuacuacauggacguc

SEQ ID NO: 21716 - RNA, 63 nt, Artificial Sequence
  derived and/or modified sequence opt2 from anti-HIV_CDR
gacuggaucggcuacgacuacgacggcuccggcucccaccuccgcgacgaguccuucgacauc

SEQ ID NO: 21717 - RNA, 63 nt, Artificial Sequence
  derived and/or modified sequence opt2 from anti-HIV_CDR
ugcuccaucgucggcaacggcgacuuccucgaggaggacucccacuaccccgccauggacguc

SEQ ID NO: 21718 - RNA, 63 nt, Artificial Sequence
  derived and/or modified sequence opt2 from anti-HIV_CDR
gacuucgucuccaucuacggcgucgccuacuucaccggcggcggccccuccucccccgacauc

SEQ ID NO: 21719 - RNA, 66 nt, Artificial Sequence
  derived and/or modified sequence opt2 from anti-HIV_CDR
aaggccaaggacuacuacuacgaguccuccgacuacucccccuacuacuacuacuacauggacguc

SEQ ID NO: 21720 - RNA, 66 nt, Artificial Sequence
  derived and/or modified sequence opt2 from anti-HIV_CDR
gaccacggcaucaagcccgacaacuacuacgacaucuccggcuacaaccucgacuacuucgacuac

SEQ ID NO: 21721 - RNA, 66 nt, Artificial Sequence
  derived and/or modified sequence opt2 from anti-HIV_CDR
ggcucccucuacgacuaccgcgacaacgccgaccucaagcccuccuacuacuacgccauggacguc

SEQ ID NO: 21722 - RNA, 66 nt, Artificial Sequence
  derived and/or modified sequence opt2 from anti-HIV_CDR
gacgaggccuccugggucgaggccgccgacgagugggacgagcaccucuuccgcgagauggccguc

SEQ ID NO: 21723 - RNA, 66 nt, Artificial Sequence
  derived and/or modified sequence opt2 from anti-HIV_CDR
gacgaggucuccugggucgaggccgccgacgagugggacgagcaccucuuccgcgagauggccguc

SEQ ID NO: 21724 - RNA, 66 nt, Artificial Sequence
  derived and/or modified sequence opt2 from anti-HIV_CDR
gacgagggcuccugggucgaggccgccgacgagugggacgagcaccucuuccgcgagauggccguc

SEQ ID NO: 21725 - RNA, 66 nt, Artificial Sequence
  derived and/or modified sequence opt2 from anti-HIV_CDR
gaccagcgcggccgcuacuccuucggcuucgucaccggccagaccaaggucuccgccaucuccgac

SEQ ID NO: 21726 - RNA, 66 nt, Artificial Sequence
  derived and/or modified sequence opt2 from anti-HIV_CDR
gaccagcucggccgcuacuccuucggcuucgucaccggccagaacaaggucuccgccaucuccgac

SEQ ID NO: 21727 - RNA, 66 nt, Artificial Sequence
  derived and/or modified sequence opt2 from anti-HIV_CDR
gaccaggucggccgcuacuccuucggcuucgccaccggccagcagcgcgucuccgccaucuccgac

SEQ ID NO: 21728 - RNA, 69 nt, Artificial Sequence
  derived and/or modified sequence opt2 from anti-HIV_CDR
gucgucaagaucgagccccucggcgucgcccccaccaaggccaagcgccgcgucguccagcgcgagaag

SEQ ID NO: 21729 - RNA, 69 nt, Artificial Sequence
  derived and/or modified sequence opt2 from anti-HIV_CDR
cgcaucuccuccuccuccugguacauggucgacaacucccacacccuccacuucuacuacauggacguc

SEQ ID NO: 21730 - RNA, 69 nt, Artificial Sequence
  derived and/or modified sequence opt2 from anti-HIV_CDR
gacaagcccgccuacgacgaguacgccgaggagaccaucgccccccacaacuaccacgccauggaccuc

SEQ ID NO: 21731 - RNA, 69 nt, Artificial Sequence
  derived and/or modified sequence opt2 from anti-HIV_CDR
cagaacaucgccgcccgcgccgccgagaagcucuacgagaacgacuacuacuucuacggcauggacguc

SEQ ID NO: 21732 - RNA, 69 nt, Artificial Sequence
  derived and/or modified sequence opt2 from anti-HIV_CDR
cagaacaucgccgcccgcaccgccgagcgccucuacgagaacgacuacuacuucuacggcauggacguc

SEQ ID NO: 21733 - RNA, 72 nt, Artificial Sequence
  derived and/or modified sequence opt2 from anti-HIV_CDR
gcccagcagggcaagcgcaucuacggcaucgucuccuucggcgaguucuucuacuacuacuacauggacgcc

SEQ ID NO: 21734 - RNA, 72 nt, Artificial Sequence
  derived and/or modified sequence opt2 from anti-HIV_CDR
acccagcagggcaagcgcaucuacggcgucgucuccuucggcgaguucuuccacuacuacuacauggacgcc

SEQ ID NO: 21735 - RNA, 72 nt, Artificial Sequence
  derived and/or modified sequence opt2 from anti-HIV_CDR
gcccgccgcggccagcgcaucuacggcgucgucuccuucggcgaguucuucuacuacuacuccauggacguc

SEQ ID NO: 21736 - RNA, 72 nt, Artificial Sequence
  derived and/or modified sequence opt2 from anti-HIV_CDR
acccuccacggccgccgcaucuacggcaucgucgccuucaacgagugguucaccuacuucuacauggacguc

SEQ ID NO: 21737 - RNA, 72 nt, Artificial Sequence
  derived and/or modified sequence opt2 from anti-HIV_CDR
accaagcacggccgccgcaucuacggcaucgucgccuucaacgagugguucaccuacuucuacauggacguc

SEQ ID NO: 21738 - RNA, 72 nt, Artificial Sequence
  derived and/or modified sequence opt2 from anti-HIV_CDR
gcccgccacggccagcgcaucuacggcgucgucuccuucggcgaguucuucaccuacuacuccauggacguc

SEQ ID NO: 21739 - RNA, 72 nt, Artificial Sequence
  derived and/or modified sequence opt2 from anti-HIV_CDR
acccagcagggcaagcgcaucuacggcgucgucuccuucggcgacuacuacuacuacuacuacauggacguc

SEQ ID NO: 21740 - RNA, 72 nt, Artificial Sequence
  derived and/or modified sequence opt2 from anti-HIV_CDR
accaagcacggccgccgcaucuacggcgucgucgccuucggcgagugguucaccuacuucuacauggacguc

SEQ ID NO: 21741 - RNA, 72 nt, Artificial Sequence
  derived and/or modified sequence opt2 from anti-HIV_CDR
gccgucaucaccgaccuccacaccuucggcgacuacgagcucgaggaccccuccuacuacuacauggacguc

SEQ ID NO: 21742 - RNA, 72 nt, Artificial Sequence
  derived and/or modified sequence opt2 from anti-HIV_CDR
gaccgcggcgacacccgccuccucgacuacggcgacuacgaggacgagcgcuacuacuacggcauggacguc

SEQ ID NO: 21743 - RNA, 72 nt, Artificial Sequence
  derived and/or modified sequence opt2 from anti-HIV_CDR
ggcacccgcuacgacuucugguccggcuucuccaaccgcgacggccgcgcccucgccggcuacuucgacuac

SEQ ID NO: 21744 - RNA, 72 nt, Artificial Sequence
  derived and/or modified sequence opt2 from anti-HIV_CDR
gacggcaagggcaaggccuacuacgacuucugguccggcuaccgcaaccagaaguacuacggccucgacguc

SEQ ID NO: 21745 - RNA, 72 nt, Artificial Sequence
  derived and/or modified sequence opt2 from anti-HIV_CDR
gccgucaucaccgaccuccacaccuucgccgacuacgagcucggcgaccccuccuacuucuacauggacguc

SEQ ID NO: 21746 - RNA, 72 nt, Artificial Sequence
  derived and/or modified sequence opt2 from anti-HIV_CDR
uccgucaucaccgaccuccacaccuucggcgacuacgaguccggcgaccccuccuacuacuacauggacguc

SEQ ID NO: 21747 - RNA, 81 nt, Artificial Sequence
  derived and/or modified sequence opt2 from anti-HIV_CDR
gacuucccccgcuuccaccgccucgucggcaacuacgacuucuggcgcggcacccucgaccgcuucuccuacauggaccuc

SEQ ID NO: 21748 - RNA, 105 nt, Artificial Sequence
  derived and/or modified sequence opt2 from anti-HIV_CDR
cgcauccucgccgucgagcgcuaccucaaggaccagcagcuccucggcaucuggggcugcuccggcaagaucaucugccccaccaugguccccuggaacuccucc

SEQ ID NO: 21749 - RNA, 105 nt, Artificial Sequence
  derived and/or modified sequence opt2 from anti-HIV_CDR
cgcguccucgccgucgagcgcuaccuccaggaccagcgccuccucggcauguggggcugcuccggcaagcacaucugcaccaccuucguccccuggaacuccucc

SEQ ID NO: 21750 - RNA, 105 nt, Artificial Sequence
  derived and/or modified sequence opt2 from anti-HIV_CDR
cgcguccucgccgucgaguccuaccucaaggaccagcagcuccucggcaucuggggcugcuccggcaagcacaucugcaccaccaccguccccuggaacuccucc

SEQ ID NO: 21751 - RNA, 105 nt, Artificial Sequence
  derived and/or modified sequence opt2 from anti-HIV_CDR
cgcguccucgccgucgagcgcuaccuccgcgaccagcagcuccucggcaucuggggcugcuccggccgccacaucugcaccaccaacguccccuggaacuccucc

SEQ ID NO: 21752 - RNA, 105 nt, Artificial Sequence
  derived and/or modified sequence opt2 from anti-HIV_CDR
cgcauccucgccgucgagcgcuaccucaaggaccagcagcuccucggcaucuggggcugcuccggcaagcucaucugcaccaccaccguccccuggaacuccucc

SEQ ID NO: 21753 - RNA, 105 nt, Artificial Sequence
  derived and/or modified sequence opt2 from anti-HIV_CDR
cgcauccucgccgucgagcgcuaccucaaggaccagcagcuccucggcaucuggggcugcuccggcaagcacaucugcaccaccaacguccccuggaacuccucc

SEQ ID NO: 21754 - RNA, 105 nt, Artificial Sequence
  derived and/or modified sequence opt2 from anti-HIV_CDR
cgcguccucgccgucgagcgcuaccuccgcgaccagcagcuccucggcaucuggggcugcuccggcaagcucaucugcaccaccaccguccccuggaacgccucc

SEQ ID NO: 21755 - RNA, 105 nt, Artificial Sequence
  derived and/or modified sequence opt2 from anti-HIV_CDR
cgcguccucgccgucgagcgcuaccuccgcgaccagcagcuccucggcaucuggggcugcuccggcaagcucaucugcaccaccgccguccccuggaacgccucc

SEQ ID NO: 21756 - RNA, 105 nt, Artificial Sequence
  derived and/or modified sequence opt2 from anti-HIV_CDR
cgcguccucgccgucgagcgcuaccucaaggaccagcagcuccucggcaucuggggcugcuccggcaagcucaucugcaccaccaccguccccuggaacgccucc

SEQ ID NO: 21757 - RNA, 105 nt, Artificial Sequence
  derived and/or modified sequence opt2 from anti-HIV_CDR
cgcauccucgccgucgagcgcuaccucaaggaccagcagcuccucggcuucuggggcugcuccggcaagcucaucugcaccaccgccguccccuggaacgccucc

SEQ ID NO: 21758 - RNA, 105 nt, Artificial Sequence
  derived and/or modified sequence opt2 from anti-HIV_CDR
cgcguccucgccgucgagcgcuaccuccgcgaccagcagcuccucggcaucuggggcugcuccggcaagcucaucugcaccaccaccguccccuggaacaccucc

SEQ ID NO: 21759 - RNA, 105 nt, Artificial Sequence
  derived and/or modified sequence opt2 from anti-HIV_CDR
cgcguccucgccgucgagcgcuaccucaaggaccagcagcuccucggcaucuggggcugcuccggcaagcucaucugcaccaccgccguccccuggaacgccucc

SEQ ID NO: 21760 - RNA, 105 nt, Artificial Sequence
  derived and/or modified sequence opt2 from anti-HIV_CDR
cgcguccucgccgucgagcgcuaccucaaggaccagcagcuccucggcuucuggggcugcuccggcaagcucaucugcaccaccaccguccccuggaacgccucc

SEQ ID NO: 21761 - RNA, 105 nt, Artificial Sequence
  derived and/or modified sequence opt2 from anti-HIV_CDR
cgcauccucgccgucgagcgcuaccucaaggaccagcagcuccucggcaucuggggcugcuccggcaagcucaucugcaccaccgccguccccuggaacgccucc

SEQ ID NO: 21762-21787 - skipped (26 entries)

SEQ ID NO: 21788 - RNA, 12 nt, Artificial Sequence
  derived and/or modified sequence opt2 from anti-influenza_CDR
gacguccccgac

SEQ ID NO: 21789 - RNA, 12 nt, Artificial Sequence
  derived and/or modified sequence opt2 from anti-influenza_CDR
cgccucuccggc

SEQ ID NO: 21790 - RNA, 12 nt, Artificial Sequence
  derived and/or modified sequence opt2 from anti-influenza_CDR
uucugggaccuc

SEQ ID NO: 21791 - RNA, 15 nt, Artificial Sequence
  derived and/or modified sequence opt2 from anti-influenza_CDR
accggccuccgcaac

SEQ ID NO: 21792 - RNA, 15 nt, Artificial Sequence
  derived and/or modified sequence opt2 from anti-influenza_CDR
cagcagucccgcacc

SEQ ID NO: 21793 - RNA, 15 nt, Artificial Sequence
  derived and/or modified sequence opt2 from anti-influenza_CDR
cagcucucccgcacc

SEQ ID NO: 21794 - RNA, 15 nt, Artificial Sequence
  derived and/or modified sequence opt2 from anti-influenza_CDR
uccaacuacaucacc

SEQ ID NO: 21795 - RNA, 15 nt, Artificial Sequence
  derived and/or modified sequence opt2 from anti-influenza_CDR
gacuacuccuggaac

SEQ ID NO: 21796 - RNA, 15 nt, Artificial Sequence
  derived and/or modified sequence opt2 from anti-influenza_CDR
aacuacgccuucucc

SEQ ID NO: 21797 - RNA, 15 nt, Artificial Sequence
  derived and/or modified sequence opt2 from anti-influenza_CDR
aagaacgccaucucc

SEQ ID NO: 21798 - RNA, 15 nt, Artificial Sequence
  derived and/or modified sequence opt2 from anti-influenza_CDR
ucccacuggaugacc

SEQ ID NO: 21799 - RNA, 15 nt, Artificial Sequence
  derived and/or modified sequence opt2 from anti-influenza_CDR
aacuacgacaucaac

SEQ ID NO: 21800 - RNA, 15 nt, Artificial Sequence
  derived and/or modified sequence opt2 from anti-influenza_CDR
gacuacggcgucacc

SEQ ID NO: 21801 - RNA, 15 nt, Artificial Sequence
  derived and/or modified sequence opt2 from anti-influenza_CDR
aacuacggcaucaac

SEQ ID NO: 21802 - RNA, 15 nt, Artificial Sequence
  derived and/or modified sequence opt2 from anti-influenza_CDR
ggcuacaccaucacc

SEQ ID NO: 21803 - RNA, 15 nt, Artificial Sequence
  derived and/or modified sequence opt2 from anti-influenza_CDR
aacuacggcaucucc

SEQ ID NO: 21804 - RNA, 15 nt, Artificial Sequence
  derived and/or modified sequence opt2 from anti-influenza_CDR
gacgacuacuggacc

SEQ ID NO: 21805 - RNA, 15 nt, Artificial Sequence
  derived and/or modified sequence opt2 from anti-influenza_CDR
accuacgccaugcac

SEQ ID NO: 21806 - RNA, 15 nt, Artificial Sequence
  derived and/or modified sequence opt2 from anti-influenza_CDR
uccuacgccaugcac

SEQ ID NO: 21807 - RNA, 15 nt, Artificial Sequence
  derived and/or modified sequence opt2 from anti-influenza_CDR
uccuacuacuggaac

SEQ ID NO: 21808 - RNA, 15 nt, Artificial Sequence
  derived and/or modified sequence opt2 from anti-influenza_CDR
accuaccccgucgcc

SEQ ID NO: 21809 - RNA, 15 nt, Artificial Sequence
  derived and/or modified sequence opt2 from anti-influenza_CDR
cacuacuucuggucc

SEQ ID NO: 21810 - RNA, 15 nt, Artificial Sequence
  derived and/or modified sequence opt2 from anti-influenza_CDR
gacuacuacuggacc

SEQ ID NO: 21811 - RNA, 15 nt, Artificial Sequence
  derived and/or modified sequence opt2 from anti-influenza_CDR
gacuacuacuggucc

SEQ ID NO: 21812 - RNA, 15 nt, Artificial Sequence
  derived and/or modified sequence opt2 from anti-influenza_CDR
ggcuacuacaugcac

SEQ ID NO: 21813 - RNA, 15 nt, Artificial Sequence
  derived and/or modified sequence opt2 from anti-influenza_CDR
ucccacuacuggucc

SEQ ID NO: 21814 - RNA, 15 nt, Artificial Sequence
  derived and/or modified sequence opt2 from anti-influenza_CDR
aacuacuggaucggc

SEQ ID NO: 21815 - RNA, 15 nt, Artificial Sequence
  derived and/or modified sequence opt2 from anti-influenza_CDR
aacuacgccaucauc

SEQ ID NO: 21816 - RNA, 15 nt, Artificial Sequence
  derived and/or modified sequence opt2 from anti-influenza_CDR
gacuacuacauccac

SEQ ID NO: 21817 - RNA, 15 nt, Artificial Sequence
  derived and/or modified sequence opt2 from anti-influenza_CDR
ggcuacgacaugcac

SEQ ID NO: 21818 - RNA, 15 nt, Artificial Sequence
  derived and/or modified sequence opt2 from anti-influenza_CDR
ggcuacuacauccac

SEQ ID NO: 21819 - RNA, 15 nt, Artificial Sequence
  derived and/or modified sequence opt2 from anti-influenza_CDR
ggcuacuacguccac

SEQ ID NO: 21820 - RNA, 15 nt, Artificial Sequence
  derived and/or modified sequence opt2 from anti-influenza_CDR
aacuacuggaugucc

SEQ ID NO: 21821 - RNA, 15 nt, Artificial Sequence
  derived and/or modified sequence opt2 from anti-influenza_CDR
ggcgaguccacccuc

SEQ ID NO: 21822 - RNA, 15 nt, Artificial Sequence
  derived and/or modified sequence opt2 from anti-influenza_CDR
aacuacuacuggucc

SEQ ID NO: 21823 - RNA, 15 nt, Artificial Sequence
  derived and/or modified sequence opt2 from anti-influenza_CDR
uccaacuacaugucc

SEQ ID NO: 21824 - RNA, 15 nt, Artificial Sequence
  derived and/or modified sequence opt2 from anti-influenza_CDR
uccgacuacuggucc

SEQ ID NO: 21825 - RNA, 15 nt, Artificial Sequence
  derived and/or modified sequence opt2 from anti-influenza_CDR
uccuacaacuggauc

SEQ ID NO: 21826 - RNA, 15 nt, Artificial Sequence
  derived and/or modified sequence opt2 from anti-influenza_CDR
uccaccuacaugaac

SEQ ID NO: 21827 - RNA, 15 nt, Artificial Sequence
  derived and/or modified sequence opt2 from anti-influenza_CDR
aacuacgccaugucc

SEQ ID NO: 21828 - RNA, 15 nt, Artificial Sequence
  derived and/or modified sequence opt2 from anti-influenza_CDR
uccgacuucuggucc

SEQ ID NO: 21829 - RNA, 15 nt, Artificial Sequence
  derived and/or modified sequence opt2 from anti-influenza_CDR
uacuacgccaugucc

SEQ ID NO: 21830 - RNA, 15 nt, Artificial Sequence
  derived and/or modified sequence opt2 from anti-influenza_CDR
ggcuacuacgucuac

SEQ ID NO: 21831 - RNA, 15 nt, Artificial Sequence
  derived and/or modified sequence opt2 from anti-influenza_CDR
uccuacgccaucucc

SEQ ID NO: 21832 - RNA, 15 nt, Artificial Sequence
  derived and/or modified sequence opt2 from anti-influenza_CDR
uccuacuccuggucc

SEQ ID NO: 21833 - RNA, 15 nt, Artificial Sequence
  derived and/or modified sequence opt2 from anti-influenza_CDR
aacuccuucuggggc

SEQ ID NO: 21834 - RNA, 15 nt, Artificial Sequence
  derived and/or modified sequence opt2 from anti-influenza_CDR
gccuaccacuggucc

SEQ ID NO: 21835 - RNA, 15 nt, Artificial Sequence
  derived and/or modified sequence opt2 from anti-influenza_CDR
gacaacuacaucaac

SEQ ID NO: 21836 - RNA, 15 nt, Artificial Sequence
  derived and/or modified sequence opt2 from anti-influenza_CDR
uccggcuucuccguc

SEQ ID NO: 21837 - RNA, 15 nt, Artificial Sequence
  derived and/or modified sequence opt2 from anti-influenza_CDR
gccuacgccuucacc

SEQ ID NO: 21838 - RNA, 15 nt, Artificial Sequence
  derived and/or modified sequence opt2 from anti-influenza_CDR
ggcuccgccaucucc

SEQ ID NO: 21839 - RNA, 15 nt, Artificial Sequence
  derived and/or modified sequence opt2 from anti-influenza_CDR
uccuacgccaucacc

SEQ ID NO: 21840 - RNA, 15 nt, Artificial Sequence
  derived and/or modified sequence opt2 from anti-influenza_CDR
uccuacuacaugcac

SEQ ID NO: 21841 - RNA, 15 nt, Artificial Sequence
  derived and/or modified sequence opt2 from anti-influenza_CDR
aucuacgccaugucc

SEQ ID NO: 21842 - RNA, 15 nt, Artificial Sequence
  derived and/or modified sequence opt2 from anti-influenza_CDR
uccuacuccaugaac

SEQ ID NO: 21843 - RNA, 15 nt, Artificial Sequence
  derived and/or modified sequence opt2 from anti-influenza_CDR
uccuacggcaucucc

SEQ ID NO: 21844 - RNA, 15 nt, Artificial Sequence
  derived and/or modified sequence opt2 from anti-influenza_CDR
uucuacuccaugucc

SEQ ID NO: 21845 - RNA, 15 nt, Artificial Sequence
  derived and/or modified sequence opt2 from anti-influenza_CDR
acccacgccaucucc

SEQ ID NO: 21846 - RNA, 15 nt, Artificial Sequence
  derived and/or modified sequence opt2 from anti-influenza_CDR
ggcuacgccaucucc

SEQ ID NO: 21847 - RNA, 15 nt, Artificial Sequence
  derived and/or modified sequence opt2 from anti-influenza_CDR
uccaacuccaucucc

SEQ ID NO: 21848 - RNA, 15 nt, Artificial Sequence
  derived and/or modified sequence opt2 from anti-influenza_CDR
aacuucgccaucaac

SEQ ID NO: 21849 - RNA, 15 nt, Artificial Sequence
  derived and/or modified sequence opt2 from anti-influenza_CDR
uccaacgccgucucc

SEQ ID NO: 21850 - RNA, 15 nt, Artificial Sequence
  derived and/or modified sequence opt2 from anti-influenza_CDR
gacaacgccaucucc

SEQ ID NO: 21851 - RNA, 15 nt, Artificial Sequence
  derived and/or modified sequence opt2 from anti-influenza_CDR
uucuccgaggucgag

SEQ ID NO: 21852 - RNA, 15 nt, Artificial Sequence
  derived and/or modified sequence opt2 from anti-influenza_CDR
gcccaccacaugcac

SEQ ID NO: 21853 - RNA, 15 nt, Artificial Sequence
  derived and/or modified sequence opt2 from anti-influenza_CDR
ucccaguggaucggc

SEQ ID NO: 21854 - RNA, 15 nt, Artificial Sequence
  derived and/or modified sequence opt2 from anti-influenza_CDR
gacuacgccaugaac

SEQ ID NO: 21855 - RNA, 15 nt, Artificial Sequence
  derived and/or modified sequence opt2 from anti-influenza_CDR
aacgccuggaugucc

SEQ ID NO: 21856 - RNA, 15 nt, Artificial Sequence
  derived and/or modified sequence opt2 from anti-influenza_CDR
gacuacgccaucaac

SEQ ID NO: 21857 - RNA, 15 nt, Artificial Sequence
  derived and/or modified sequence opt2 from anti-influenza_CDR
cgccacggcaucucc

SEQ ID NO: 21858 - RNA, 15 nt, Artificial Sequence
  derived and/or modified sequence opt2 from anti-influenza_CDR
gagcucuccauccac

SEQ ID NO: 21859 - RNA, 15 nt, Artificial Sequence
  derived and/or modified sequence opt2 from anti-influenza_CDR
uccuccaacuacuac

SEQ ID NO: 21860 - RNA, 15 nt, Artificial Sequence
  derived and/or modified sequence opt2 from anti-influenza_CDR
accuacgccaugucc

SEQ ID NO: 21861 - RNA, 15 nt, Artificial Sequence
  derived and/or modified sequence opt2 from anti-influenza_CDR
aacuacgccaucucc

SEQ ID NO: 21862 - RNA, 18 nt, Artificial Sequence
  derived and/or modified sequence opt2 from anti-influenza_CDR
uucggcgccaucgccggc

SEQ ID NO: 21863 - RNA, 18 nt, Artificial Sequence
  derived and/or modified sequence opt2 from anti-influenza_CDR
caggacaucucccgcuac

SEQ ID NO: 21864 - RNA, 18 nt, Artificial Sequence
  derived and/or modified sequence opt2 from anti-influenza_CDR
cagaacaucggccccugg

SEQ ID NO: 21865 - RNA, 18 nt, Artificial Sequence
  derived and/or modified sequence opt2 from anti-influenza_CDR
caguccgucaaccgccgc

SEQ ID NO: 21866 - RNA, 18 nt, Artificial Sequence
  derived and/or modified sequence opt2 from anti-influenza_CDR
caguccaucuccaccuac

SEQ ID NO: 21867 - RNA, 18 nt, Artificial Sequence
  derived and/or modified sequence opt2 from anti-influenza_CDR
cagggcaucaucaccuac

SEQ ID NO: 21868 - RNA, 18 nt, Artificial Sequence
  derived and/or modified sequence opt2 from anti-influenza_CDR
cagggcaucuccuccuac

SEQ ID NO: 21869 - RNA, 18 nt, Artificial Sequence
  derived and/or modified sequence opt2 from anti-influenza_CDR
caggacgucuccaccugg

SEQ ID NO: 21870 - RNA, 18 nt, Artificial Sequence
  derived and/or modified sequence opt2 from anti-influenza_CDR
caggacaucuacaucuac

SEQ ID NO: 21871 - RNA, 18 nt, Artificial Sequence
  derived and/or modified sequence opt2 from anti-influenza_CDR
gagaacaucuggaacaac

SEQ ID NO: 21872 - RNA, 18 nt, Artificial Sequence
  derived and/or modified sequence opt2 from anti-influenza_CDR
ggcuucaccgucaccucc

SEQ ID NO: 21873 - RNA, 18 nt, Artificial Sequence
  derived and/or modified sequence opt2 from anti-influenza_CDR
caggacaucuccggccac

SEQ ID NO: 21874 - RNA, 18 nt, Artificial Sequence
  derived and/or modified sequence opt2 from anti-influenza_CDR
ucccuccucaccgagguc

SEQ ID NO: 21875 - RNA, 18 nt, Artificial Sequence
  derived and/or modified sequence opt2 from anti-influenza_CDR
ggcuccuccaucuccaac

SEQ ID NO: 21876 - RNA, 18 nt, Artificial Sequence
  derived and/or modified sequence opt2 from anti-influenza_CDR
ggcggcuccaucaccucc

SEQ ID NO: 21877 - RNA, 18 nt, Artificial Sequence
  derived and/or modified sequence opt2 from anti-influenza_CDR
ggcggcuccaucuccucc

SEQ ID NO: 21878 - RNA, 18 nt, Artificial Sequence
  derived and/or modified sequence opt2 from anti-influenza_CDR
ggccucuccgucuccucc

SEQ ID NO: 21879 - RNA, 18 nt, Artificial Sequence
  derived and/or modified sequence opt2 from anti-influenza_CDR
ggcgccuccaucuccucc

SEQ ID NO: 21880 - RNA, 18 nt, Artificial Sequence
  derived and/or modified sequence opt2 from anti-influenza_CDR
ggcgacuccaucuccucc

SEQ ID NO: 21881 - RNA, 18 nt, Artificial Sequence
  derived and/or modified sequence opt2 from anti-influenza_CDR
ggcggcuccaucuccaac

SEQ ID NO: 21882 - RNA, 18 nt, Artificial Sequence
  derived and/or modified sequence opt2 from anti-influenza_CDR
ggcggcuccaucuccgcc

SEQ ID NO: 21883 - RNA, 18 nt, Artificial Sequence
  derived and/or modified sequence opt2 from anti-influenza_CDR
ggcuucuccgucuccgac

SEQ ID NO: 21884 - RNA, 18 nt, Artificial Sequence
  derived and/or modified sequence opt2 from anti-influenza_CDR
ucccgcucccucgacguc

SEQ ID NO: 21885 - RNA, 18 nt, Artificial Sequence
  derived and/or modified sequence opt2 from anti-influenza_CDR
cgcucccagcagaccguc

SEQ ID NO: 21886 - RNA, 18 nt, Artificial Sequence
  derived and/or modified sequence opt2 from anti-influenza_CDR
cagaccaucaacaacuac

SEQ ID NO: 21887 - RNA, 18 nt, Artificial Sequence
  derived and/or modified sequence opt2 from anti-influenza_CDR
aacaugggccccaccucc

SEQ ID NO: 21888 - RNA, 18 nt, Artificial Sequence
  derived and/or modified sequence opt2 from anti-influenza_CDR
caggucgucggcaccaac

SEQ ID NO: 21889 - RNA, 18 nt, Artificial Sequence
  derived and/or modified sequence opt2 from anti-influenza_CDR
cagggcaucaacacccac

SEQ ID NO: 21890 - RNA, 18 nt, Artificial Sequence
  derived and/or modified sequence opt2 from anti-influenza_CDR
caggacauccgcaaccgc

SEQ ID NO: 21891 - RNA, 18 nt, Artificial Sequence
  derived and/or modified sequence opt2 from anti-influenza_CDR
cagggcaucggcuccaac

SEQ ID NO: 21892 - RNA, 18 nt, Artificial Sequence
  derived and/or modified sequence opt2 from anti-influenza_CDR
cagaccaucuaccgcugg

SEQ ID NO: 21893 - RNA, 18 nt, Artificial Sequence
  derived and/or modified sequence opt2 from anti-influenza_CDR
cagaccaucacccgcuuc

SEQ ID NO: 21894 - RNA, 18 nt, Artificial Sequence
  derived and/or modified sequence opt2 from anti-influenza_CDR
cgccucggcgagaaguuc

SEQ ID NO: 21895 - RNA, 18 nt, Artificial Sequence
  derived and/or modified sequence opt2 from anti-influenza_CDR
aagcucggcgacaaguuc

SEQ ID NO: 21896 - RNA, 18 nt, Artificial Sequence
  derived and/or modified sequence opt2 from anti-influenza_CDR
cagggccucggcuccaac

SEQ ID NO: 21897 - RNA, 18 nt, Artificial Sequence
  derived and/or modified sequence opt2 from anti-influenza_CDR
uacaucggcuccaagucc

SEQ ID NO: 21898 - RNA, 18 nt, Artificial Sequence
  derived and/or modified sequence opt2 from anti-influenza_CDR
cagcucaucuccuccuac

SEQ ID NO: 21899 - RNA, 18 nt, Artificial Sequence
  derived and/or modified sequence opt2 from anti-influenza_CDR
caguccgucuccuccaac

SEQ ID NO: 21900 - RNA, 18 nt, Artificial Sequence
  derived and/or modified sequence opt2 from anti-influenza_CDR
caggucaucuccuccuac

SEQ ID NO: 21901 - RNA, 18 nt, Artificial Sequence
  derived and/or modified sequence opt2 from anti-influenza_CDR
caguccgucaaccgcaac

SEQ ID NO: 21902 - RNA, 18 nt, Artificial Sequence
  derived and/or modified sequence opt2 from anti-influenza_CDR
gacaucggcuccaagucc

SEQ ID NO: 21903 - RNA, 18 nt, Artificial Sequence
  derived and/or modified sequence opt2 from anti-influenza_CDR
caguccgucuccaccaac

SEQ ID NO: 21904 - RNA, 18 nt, Artificial Sequence
  derived and/or modified sequence opt2 from anti-influenza_CDR
augaucgccggcuggcac

SEQ ID NO: 21905 - RNA, 18 nt, Artificial Sequence
  derived and/or modified sequence opt2 from anti-influenza_CDR
caggacaucuccaccugg

SEQ ID NO: 21906 - RNA, 18 nt, Artificial Sequence
  derived and/or modified sequence opt2 from anti-influenza_CDR
gagaagaucuacuccaac

SEQ ID NO: 21907 - RNA, 21 nt, Artificial Sequence
  derived and/or modified sequence opt2 from anti-influenza_CDR
aucuacuacaacuacaacauc

SEQ ID NO: 21908 - RNA, 21 nt, Artificial Sequence
  derived and/or modified sequence opt2 from anti-influenza_CDR
caguccaucuccuccggcuac

SEQ ID NO: 21909 - RNA, 21 nt, Artificial Sequence
  derived and/or modified sequence opt2 from anti-influenza_CDR
caguccgucuccuccuccuac

SEQ ID NO: 21910 - RNA, 21 nt, Artificial Sequence
  derived and/or modified sequence opt2 from anti-influenza_CDR
cagaccgucuccuccuccuac

SEQ ID NO: 21911 - RNA, 21 nt, Artificial Sequence
  derived and/or modified sequence opt2 from anti-influenza_CDR
uccaacaacgccgucuggaac

SEQ ID NO: 21912 - RNA, 21 nt, Artificial Sequence
  derived and/or modified sequence opt2 from anti-influenza_CDR
uccaacuccgccgucuggaac

SEQ ID NO: 21913 - RNA, 21 nt, Artificial Sequence
  derived and/or modified sequence opt2 from anti-influenza_CDR
gccgccaccacccuccagucc

SEQ ID NO: 21914 - RNA, 21 nt, Artificial Sequence
  derived and/or modified sequence opt2 from anti-influenza_CDR
uccaaccgcgccaccuggaac

SEQ ID NO: 21915 - RNA, 21 nt, Artificial Sequence
  derived and/or modified sequence opt2 from anti-influenza_CDR
gccaccuccacccuccagucc

SEQ ID NO: 21916 - RNA, 21 nt, Artificial Sequence
  derived and/or modified sequence opt2 from anti-influenza_CDR
uccaacuccgccaccuggaac

SEQ ID NO: 21917 - RNA, 21 nt, Artificial Sequence
  derived and/or modified sequence opt2 from anti-influenza_CDR
gccuccuccacccuccagucc

SEQ ID NO: 21918 - RNA, 21 nt, Artificial Sequence
  derived and/or modified sequence opt2 from anti-influenza_CDR
uccuacaacgccgucuggaac

SEQ ID NO: 21919 - RNA, 21 nt, Artificial Sequence
  derived and/or modified sequence opt2 from anti-influenza_CDR
gccgccuccucccgccucucc

SEQ ID NO: 21920 - RNA, 21 nt, Artificial Sequence
  derived and/or modified sequence opt2 from anti-influenza_CDR
gccgccuccucccgcggcucc

SEQ ID NO: 21921 - RNA, 21 nt, Artificial Sequence
  derived and/or modified sequence opt2 from anti-influenza_CDR
aucuaccacuccggcuccgcc

SEQ ID NO: 21922 - RNA, 21 nt, Artificial Sequence
  derived and/or modified sequence opt2 from anti-influenza_CDR
aucuacuacuccggcgucacc

SEQ ID NO: 21923 - RNA, 21 nt, Artificial Sequence
  derived and/or modified sequence opt2 from anti-influenza_CDR
uccuccuaccucgccugguac

SEQ ID NO: 21924 - RNA, 21 nt, Artificial Sequence
  derived and/or modified sequence opt2 from anti-influenza_CDR
cagucccucuccuccuccucc

SEQ ID NO: 21925 - RNA, 21 nt, Artificial Sequence
  derived and/or modified sequence opt2 from anti-influenza_CDR
caguccgucuccaucuccuac

SEQ ID NO: 21926 - RNA, 21 nt, Artificial Sequence
  derived and/or modified sequence opt2 from anti-influenza_CDR
gacgucaccgagcgccccucc

SEQ ID NO: 21927 - RNA, 21 nt, Artificial Sequence
  derived and/or modified sequence opt2 from anti-influenza_CDR
gccgccuccacccuccucgac

SEQ ID NO: 21928 - RNA, 21 nt, Artificial Sequence
  derived and/or modified sequence opt2 from anti-influenza_CDR
gccgccuccacccuccacucc

SEQ ID NO: 21929 - RNA, 21 nt, Artificial Sequence
  derived and/or modified sequence opt2 from anti-influenza_CDR
ggcgccuccucccuccagggc

SEQ ID NO: 21930 - RNA, 21 nt, Artificial Sequence
  derived and/or modified sequence opt2 from anti-influenza_CDR
accaacggcgucaacgucggc

SEQ ID NO: 21931 - RNA, 21 nt, Artificial Sequence
  derived and/or modified sequence opt2 from anti-influenza_CDR
gacgccuccacccgcgccacc

SEQ ID NO: 21932 - RNA, 21 nt, Artificial Sequence
  derived and/or modified sequence opt2 from anti-influenza_CDR
uccgagaccuacuacuggucc

SEQ ID NO: 21933 - RNA, 21 nt, Artificial Sequence
  derived and/or modified sequence opt2 from anti-influenza_CDR
gaggccgucaaccucgagucc

SEQ ID NO: 21934 - RNA, 21 nt, Artificial Sequence
  derived and/or modified sequence opt2 from anti-influenza_CDR
ggcgccuccacccgcgccacc

SEQ ID NO: 21935 - RNA, 21 nt, Artificial Sequence
  derived and/or modified sequence opt2 from anti-influenza_CDR
gucuccggcuacuacuggucc

SEQ ID NO: 21936 - RNA, 21 nt, Artificial Sequence
  derived and/or modified sequence opt2 from anti-influenza_CDR
aucaccggcguccgcgucggc

SEQ ID NO: 21937 - RNA, 21 nt, Artificial Sequence
  derived and/or modified sequence opt2 from anti-influenza_CDR
gacgccuccaaccgcgccacc

SEQ ID NO: 21938 - RNA, 21 nt, Artificial Sequence
  derived and/or modified sequence opt2 from anti-influenza_CDR
gaggucaccaacuggcccucc

SEQ ID NO: 21939 - RNA, 21 nt, Artificial Sequence
  derived and/or modified sequence opt2 from anti-influenza_CDR
aaggacuccgagcgccccucc

SEQ ID NO: 21940 - RNA, 21 nt, Artificial Sequence
  derived and/or modified sequence opt2 from anti-influenza_CDR
uccggcaacuacuacuggaac

SEQ ID NO: 21941 - RNA, 21 nt, Artificial Sequence
  derived and/or modified sequence opt2 from anti-influenza_CDR
uccaccaccauccgccacucc

SEQ ID NO: 21942 - RNA, 21 nt, Artificial Sequence
  derived and/or modified sequence opt2 from anti-influenza_CDR
gacgacuccggccgccccucc

SEQ ID NO: 21943 - RNA, 21 nt, Artificial Sequence
  derived and/or modified sequence opt2 from anti-influenza_CDR
cgcaacgaccuccgccccucc

SEQ ID NO: 21944 - RNA, 21 nt, Artificial Sequence
  derived and/or modified sequence opt2 from anti-influenza_CDR
uccgucgaccacuacuggucc

SEQ ID NO: 21945 - RNA, 21 nt, Artificial Sequence
  derived and/or modified sequence opt2 from anti-influenza_CDR
gccgucuccauccuccagucc

SEQ ID NO: 21946 - RNA, 21 nt, Artificial Sequence
  derived and/or modified sequence opt2 from anti-influenza_CDR
gacgacaccgaccgccccucc

SEQ ID NO: 21947 - RNA, 21 nt, Artificial Sequence
  derived and/or modified sequence opt2 from anti-influenza_CDR
gagaacaacaagcgccccucc

SEQ ID NO: 21948 - RNA, 21 nt, Artificial Sequence
  derived and/or modified sequence opt2 from anti-influenza_CDR
gacuccuccaaccgcgccccc

SEQ ID NO: 21949 - RNA, 21 nt, Artificial Sequence
  derived and/or modified sequence opt2 from anti-influenza_CDR
gaggucaccaagcgccccucc

SEQ ID NO: 21950 - RNA, 21 nt, Artificial Sequence
  derived and/or modified sequence opt2 from anti-influenza_CDR
gccaccuccaacacccacucc

SEQ ID NO: 21951 - RNA, 21 nt, Artificial Sequence
  derived and/or modified sequence opt2 from anti-influenza_CDR
gccgccuccaaccucgagaac

SEQ ID NO: 21952 - RNA, 21 nt, Artificial Sequence
  derived and/or modified sequence opt2 from anti-influenza_CDR
gccgccuccggccuccagucc

SEQ ID NO: 21953 - RNA, 21 nt, Artificial Sequence
  derived and/or modified sequence opt2 from anti-influenza_CDR
ggcuucaccgucuccuccaac

SEQ ID NO: 21954 - RNA, 21 nt, Artificial Sequence
  derived and/or modified sequence opt2 from anti-influenza_CDR
ggcggcggcuacuccuggaac

SEQ ID NO: 21955 - RNA, 21 nt, Artificial Sequence
  derived and/or modified sequence opt2 from anti-influenza_CDR
ggcgccuccaaccuccagucc

SEQ ID NO: 21956 - RNA, 21 nt, Artificial Sequence
  derived and/or modified sequence opt2 from anti-influenza_CDR
ggcgccaccaaccuccagucc

SEQ ID NO: 21957 - RNA, 21 nt, Artificial Sequence
  derived and/or modified sequence opt2 from anti-influenza_CDR
ggcgccuccaaccuccacucc

SEQ ID NO: 21958 - RNA, 21 nt, Artificial Sequence
  derived and/or modified sequence opt2 from anti-influenza_CDR
ggcgccuccacccuccagucc

SEQ ID NO: 21959 - RNA, 21 nt, Artificial Sequence
  derived and/or modified sequence opt2 from anti-influenza_CDR
gacaacuccgaccgccccucc

SEQ ID NO: 21960 - RNA, 21 nt, Artificial Sequence
  derived and/or modified sequence opt2 from anti-influenza_CDR
ggcgccuccucccuccagucc

SEQ ID NO: 21961 - RNA, 21 nt, Artificial Sequence
  derived and/or modified sequence opt2 from anti-influenza_CDR
ggcaacuccaaccgccccucc

SEQ ID NO: 21962 - RNA, 21 nt, Artificial Sequence
  derived and/or modified sequence opt2 from anti-influenza_CDR
gccgccuccucccuccagucc

SEQ ID NO: 21963 - RNA, 21 nt, Artificial Sequence
  derived and/or modified sequence opt2 from anti-influenza_CDR
gccgccuccucccuccacucc

SEQ ID NO: 21964 - RNA, 21 nt, Artificial Sequence
  derived and/or modified sequence opt2 from anti-influenza_CDR
ggcgccuccacccuccagaac

SEQ ID NO: 21965 - RNA, 21 nt, Artificial Sequence
  derived and/or modified sequence opt2 from anti-influenza_CDR
ggcgccaccgaccuccagucc

SEQ ID NO: 21966 - RNA, 21 nt, Artificial Sequence
  derived and/or modified sequence opt2 from anti-influenza_CDR
uccggcgccuacuacuggacc

SEQ ID NO: 21967 - RNA, 21 nt, Artificial Sequence
  derived and/or modified sequence opt2 from anti-influenza_CDR
gucuccgacaacuacaucaac

SEQ ID NO: 21968 - RNA, 21 nt, Artificial Sequence
  derived and/or modified sequence opt2 from anti-influenza_CDR
ugggccuccacccgcgagucc

SEQ ID NO: 21969 - RNA, 21 nt, Artificial Sequence
  derived and/or modified sequence opt2 from anti-influenza_CDR
uccaacaaccagcgccccucc

SEQ ID NO: 21970 - RNA, 21 nt, Artificial Sequence
  derived and/or modified sequence opt2 from anti-influenza_CDR
gaggucuccaaccgccccucc

SEQ ID NO: 21971 - RNA, 21 nt, Artificial Sequence
  derived and/or modified sequence opt2 from anti-influenza_CDR
aagaacacccagcgccccucc

SEQ ID NO: 21972 - RNA, 21 nt, Artificial Sequence
  derived and/or modified sequence opt2 from anti-influenza_CDR
gacaacaacaagcgccccucc

SEQ ID NO: 21973 - RNA, 21 nt, Artificial Sequence
  derived and/or modified sequence opt2 from anti-influenza_CDR
gacgccuccacccuccgcucc

SEQ ID NO: 21974 - RNA, 21 nt, Artificial Sequence
  derived and/or modified sequence opt2 from anti-influenza_CDR
caggacaaccgccgccccucc

SEQ ID NO: 21975 - RNA, 21 nt, Artificial Sequence
  derived and/or modified sequence opt2 from anti-influenza_CDR
gacgucuccaagcgccccucc

SEQ ID NO: 21976 - RNA, 21 nt, Artificial Sequence
  derived and/or modified sequence opt2 from anti-influenza_CDR
gacgccuccucccgcgccacc

SEQ ID NO: 21977 - RNA, 21 nt, Artificial Sequence
  derived and/or modified sequence opt2 from anti-influenza_CDR
cucggcuccaaccgcgccucc

SEQ ID NO: 21978 - RNA, 21 nt, Artificial Sequence
  derived and/or modified sequence opt2 from anti-influenza_CDR
ggcgccuccacccgcgccgcc

SEQ ID NO: 21979 - RNA, 21 nt, Artificial Sequence
  derived and/or modified sequence opt2 from anti-influenza_CDR
gacgacuccgaccgccccucc

SEQ ID NO: 21980 - RNA, 21 nt, Artificial Sequence
  derived and/or modified sequence opt2 from anti-influenza_CDR
cgcgacggccagcgccccucc

SEQ ID NO: 21981 - RNA, 21 nt, Artificial Sequence
  derived and/or modified sequence opt2 from anti-influenza_CDR
ggcgccuccucccgcgccacc

SEQ ID NO: 21982 - RNA, 21 nt, Artificial Sequence
  derived and/or modified sequence opt2 from anti-influenza_CDR
ggcgccuccucccgcgccucc

SEQ ID NO: 21983 - RNA, 21 nt, Artificial Sequence
  derived and/or modified sequence opt2 from anti-influenza_CDR
gccgccuccacccuccagucc

SEQ ID NO: 21984 - RNA, 21 nt, Artificial Sequence
  derived and/or modified sequence opt2 from anti-influenza_CDR
cucgucuccaagcgcgccucc

SEQ ID NO: 21985 - RNA, 21 nt, Artificial Sequence
  derived and/or modified sequence opt2 from anti-influenza_CDR
gacgucaccuaccgccccucc

SEQ ID NO: 21986 - RNA, 21 nt, Artificial Sequence
  derived and/or modified sequence opt2 from anti-influenza_CDR
augcaggcccucgagaccccc

SEQ ID NO: 21987 - RNA, 21 nt, Artificial Sequence
  derived and/or modified sequence opt2 from anti-influenza_CDR
cagaacuacggcucccccuuc

SEQ ID NO: 21988 - RNA, 21 nt, Artificial Sequence
  derived and/or modified sequence opt2 from anti-influenza_CDR
cagcaguacggcucccucccc

SEQ ID NO: 21989 - RNA, 21 nt, Artificial Sequence
  derived and/or modified sequence opt2 from anti-influenza_CDR
uggggcuccuaccucgagucc

SEQ ID NO: 21990 - RNA, 21 nt, Artificial Sequence
  derived and/or modified sequence opt2 from anti-influenza_CDR
uccgccuccacccgcgccacc

SEQ ID NO: 21991 - RNA, 21 nt, Artificial Sequence
  derived and/or modified sequence opt2 from anti-influenza_CDR
ggcgccuccacccgcgccucc

SEQ ID NO: 21992 - RNA, 21 nt, Artificial Sequence
  derived and/or modified sequence opt2 from anti-influenza_CDR
ggcgccuccacccgcgacacc

SEQ ID NO: 21993 - RNA, 21 nt, Artificial Sequence
  derived and/or modified sequence opt2 from anti-influenza_CDR
aaggucuccacccucgagucc

SEQ ID NO: 21994 - RNA, 21 nt, Artificial Sequence
  derived and/or modified sequence opt2 from anti-influenza_CDR
uccaacaccgagcgccccucc

SEQ ID NO: 21995 - RNA, 21 nt, Artificial Sequence
  derived and/or modified sequence opt2 from anti-influenza_CDR
aagaucuccaaccgcgacucc

SEQ ID NO: 21996 - RNA, 21 nt, Artificial Sequence
  derived and/or modified sequence opt2 from anti-influenza_CDR
uccgccucccaccgcuacucc

SEQ ID NO: 21997 - RNA, 21 nt, Artificial Sequence
  derived and/or modified sequence opt2 from anti-influenza_CDR
caguccguccgcuccaacaac

SEQ ID NO: 21998 - RNA, 21 nt, Artificial Sequence
  derived and/or modified sequence opt2 from anti-influenza_CDR
caguccguccgcuccggcuac

SEQ ID NO: 21999 - RNA, 21 nt, Artificial Sequence
  derived and/or modified sequence opt2 from anti-influenza_CDR
aucuacuaccgcggcuccacc

SEQ ID NO: 22000 - RNA, 21 nt, Artificial Sequence
  derived and/or modified sequence opt2 from anti-influenza_CDR
gucuacuacuccggcaucacc

SEQ ID NO: 22001 - RNA, 21 nt, Artificial Sequence
  derived and/or modified sequence opt2 from anti-influenza_CDR
ucccacuucgccaaccucaag

SEQ ID NO: 22002 - RNA, 21 nt, Artificial Sequence
  derived and/or modified sequence opt2 from anti-influenza_CDR
cucaacaaguccaagcccuac

SEQ ID NO: 22003 - RNA, 21 nt, Artificial Sequence
  derived and/or modified sequence opt2 from anti-influenza_CDR
aagcucgccaacaccggcacc

SEQ ID NO: 22004 - RNA, 21 nt, Artificial Sequence
  derived and/or modified sequence opt2 from anti-influenza_CDR
gccgccuccacccucaccucc

SEQ ID NO: 22005 - RNA, 21 nt, Artificial Sequence
  derived and/or modified sequence opt2 from anti-influenza_CDR
gacgccuccaagcucgccucc

SEQ ID NO: 22006 - RNA, 21 nt, Artificial Sequence
  derived and/or modified sequence opt2 from anti-influenza_CDR
uucgccucccgccucgccucc

SEQ ID NO: 22007 - RNA, 21 nt, Artificial Sequence
  derived and/or modified sequence opt2 from anti-influenza_CDR
uccgccuccacccucgccucc

SEQ ID NO: 22008 - RNA, 21 nt, Artificial Sequence
  derived and/or modified sequence opt2 from anti-influenza_CDR
gaggucucccagcgccccucc

SEQ ID NO: 22009 - RNA, 21 nt, Artificial Sequence
  derived and/or modified sequence opt2 from anti-influenza_CDR
ggcggcacccucaacaacuac

SEQ ID NO: 22010 - RNA, 21 nt, Artificial Sequence
  derived and/or modified sequence opt2 from anti-influenza_CDR
gacaucgucaugacccagucc

SEQ ID NO: 22011 - RNA, 24 nt, Artificial Sequence
  derived and/or modified sequence opt2 from anti-influenza_CDR
ggcuucaccuucuccaacuacgcc

SEQ ID NO: 22012 - RNA, 24 nt, Artificial Sequence
  derived and/or modified sequence opt2 from anti-influenza_CDR
ggcuucaccuucuccaacuacggc

SEQ ID NO: 22013 - RNA, 24 nt, Artificial Sequence
  derived and/or modified sequence opt2 from anti-influenza_CDR
ggcuucaccuucuccuccuacgcc

SEQ ID NO: 22014 - RNA, 24 nt, Artificial Sequence
  derived and/or modified sequence opt2 from anti-influenza_CDR
ggcuucaccuucuccaccuacgcc

SEQ ID NO: 22015 - RNA, 24 nt, Artificial Sequence
  derived and/or modified sequence opt2 from anti-influenza_CDR
ggcggcaucuucaucucccaggcc

SEQ ID NO: 22016 - RNA, 24 nt, Artificial Sequence
  derived and/or modified sequence opt2 from anti-influenza_CDR
ggcggcaucuucucccccuacgcc

SEQ ID NO: 22017 - RNA, 24 nt, Artificial Sequence
  derived and/or modified sequence opt2 from anti-influenza_CDR
ggcggccccuucuccggcuucgcc

SEQ ID NO: 22018 - RNA, 24 nt, Artificial Sequence
  derived and/or modified sequence opt2 from anti-influenza_CDR
ggcggcaccuucaacucccacgcc

SEQ ID NO: 22019 - RNA, 24 nt, Artificial Sequence
  derived and/or modified sequence opt2 from anti-influenza_CDR
ggcuccaacaucggcuccaacacc

SEQ ID NO: 22020 - RNA, 24 nt, Artificial Sequence
  derived and/or modified sequence opt2 from anti-influenza_CDR
ggcgucaccuucuccauguacgcc

SEQ ID NO: 22021 - RNA, 24 nt, Artificial Sequence
  derived and/or modified sequence opt2 from anti-influenza_CDR
ggcgucaccuucuccauguacacc

SEQ ID NO: 22022 - RNA, 24 nt, Artificial Sequence
  derived and/or modified sequence opt2 from anti-influenza_CDR
ggcgucaccuccuccaacuacccc

SEQ ID NO: 22023 - RNA, 24 nt, Artificial Sequence
  derived and/or modified sequence opt2 from anti-influenza_CDR
aucaucgccaucuucggcaccacc

SEQ ID NO: 22024 - RNA, 24 nt, Artificial Sequence
  derived and/or modified sequence opt2 from anti-influenza_CDR
aucaucccccucuucggcaccgcc

SEQ ID NO: 22025 - RNA, 24 nt, Artificial Sequence
  derived and/or modified sequence opt2 from anti-influenza_CDR
aucaucccccucuucggcaccacc

SEQ ID NO: 22026 - RNA, 24 nt, Artificial Sequence
  derived and/or modified sequence opt2 from anti-influenza_CDR
aucauccccauguucggcgccacc

SEQ ID NO: 22027 - RNA, 24 nt, Artificial Sequence
  derived and/or modified sequence opt2 from anti-influenza_CDR
aucauccccauguucggcaccacc

SEQ ID NO: 22028 - RNA, 24 nt, Artificial Sequence
  derived and/or modified sequence opt2 from anti-influenza_CDR
aucaacuccggcggcggcgccacc

SEQ ID NO: 22029 - RNA, 24 nt, Artificial Sequence
  derived and/or modified sequence opt2 from anti-influenza_CDR
aucuccgccgucuucggcaccgcc

SEQ ID NO: 22030 - RNA, 24 nt, Artificial Sequence
  derived and/or modified sequence opt2 from anti-influenza_CDR
aucuccuacgacgccaacuacaag

SEQ ID NO: 22031 - RNA, 24 nt, Artificial Sequence
  derived and/or modified sequence opt2 from anti-influenza_CDR
aucuccuacgacggcaacuacaag

SEQ ID NO: 22032 - RNA, 24 nt, Artificial Sequence
  derived and/or modified sequence opt2 from anti-influenza_CDR
aucuccuacgacggcuccaacaag

SEQ ID NO: 22033 - RNA, 24 nt, Artificial Sequence
  derived and/or modified sequence opt2 from anti-influenza_CDR
aucuccuacgacggcuccaaccag

SEQ ID NO: 22034 - RNA, 24 nt, Artificial Sequence
  derived and/or modified sequence opt2 from anti-influenza_CDR
cagcaguacuaccgcucccccucc

SEQ ID NO: 22035 - RNA, 24 nt, Artificial Sequence
  derived and/or modified sequence opt2 from anti-influenza_CDR
guccucccccucuucggcgucacc

SEQ ID NO: 22036 - RNA, 24 nt, Artificial Sequence
  derived and/or modified sequence opt2 from anti-influenza_CDR
ggcggcaccuucuccuccgacgcc

SEQ ID NO: 22037 - RNA, 24 nt, Artificial Sequence
  derived and/or modified sequence opt2 from anti-influenza_CDR
aucauccccgucuuccagaccgcc

SEQ ID NO: 22038 - RNA, 24 nt, Artificial Sequence
  derived and/or modified sequence opt2 from anti-influenza_CDR
accuccaacaucggcuccaacgcc

SEQ ID NO: 22039 - RNA, 24 nt, Artificial Sequence
  derived and/or modified sequence opt2 from anti-influenza_CDR
ggcuacuccuucaccucccgcugg

SEQ ID NO: 22040 - RNA, 24 nt, Artificial Sequence
  derived and/or modified sequence opt2 from anti-influenza_CDR
aucuaccccuccgacuccgacguc

SEQ ID NO: 22041 - RNA, 24 nt, Artificial Sequence
  derived and/or modified sequence opt2 from anti-influenza_CDR
cagcaguacgacaacuggcucucc

SEQ ID NO: 22042 - RNA, 24 nt, Artificial Sequence
  derived and/or modified sequence opt2 from anti-influenza_CDR
ggcggcaccuucuccaacuacggc

SEQ ID NO: 22043 - RNA, 24 nt, Artificial Sequence
  derived and/or modified sequence opt2 from anti-influenza_CDR
ggcgccuccaucuccuccuccuac

SEQ ID NO: 22044 - RNA, 24 nt, Artificial Sequence
  derived and/or modified sequence opt2 from anti-influenza_CDR
ggcggcaccuucuccuccuacgac

SEQ ID NO: 22045 - RNA, 24 nt, Artificial Sequence
  derived and/or modified sequence opt2 from anti-influenza_CDR
aucauccccaucuacggcaccgcc

SEQ ID NO: 22046 - RNA, 24 nt, Artificial Sequence
  derived and/or modified sequence opt2 from anti-influenza_CDR
ggcuacaccuccaccaccuacggc

SEQ ID NO: 22047 - RNA, 24 nt, Artificial Sequence
  derived and/or modified sequence opt2 from anti-influenza_CDR
aucaaccccuacaacggcaacccc

SEQ ID NO: 22048 - RNA, 24 nt, Artificial Sequence
  derived and/or modified sequence opt2 from anti-influenza_CDR
aucugguacgacggcgacaacaag

SEQ ID NO: 22049 - RNA, 24 nt, Artificial Sequence
  derived and/or modified sequence opt2 from anti-influenza_CDR
ggcuucaccuucuccgacuucugg

SEQ ID NO: 22050 - RNA, 24 nt, Artificial Sequence
  derived and/or modified sequence opt2 from anti-influenza_CDR
aucgaccaggacggcaacgagcgc

SEQ ID NO: 22051 - RNA, 24 nt, Artificial Sequence
  derived and/or modified sequence opt2 from anti-influenza_CDR
uccuccaacaucggcaagaacuac

SEQ ID NO: 22052 - RNA, 24 nt, Artificial Sequence
  derived and/or modified sequence opt2 from anti-influenza_CDR
ggcuacaccuucaccaacuacugg

SEQ ID NO: 22053 - RNA, 24 nt, Artificial Sequence
  derived and/or modified sequence opt2 from anti-influenza_CDR
aucuucccccccgacucccagacc

SEQ ID NO: 22054 - RNA, 24 nt, Artificial Sequence
  derived and/or modified sequence opt2 from anti-influenza_CDR
ggcuacuccuucuccgacuacugg

SEQ ID NO: 22055 - RNA, 24 nt, Artificial Sequence
  derived and/or modified sequence opt2 from anti-influenza_CDR
aucuaccccgccuccuccgagauc

SEQ ID NO: 22056 - RNA, 24 nt, Artificial Sequence
  derived and/or modified sequence opt2 from anti-influenza_CDR
uccggcgacuccggcaccuggaac

SEQ ID NO: 22057 - RNA, 24 nt, Artificial Sequence
  derived and/or modified sequence opt2 from anti-influenza_CDR
ggcggcacccucaacaacuacgcc

SEQ ID NO: 22058 - RNA, 24 nt, Artificial Sequence
  derived and/or modified sequence opt2 from anti-influenza_CDR
aucucccccaucuucggcacccuc

SEQ ID NO: 22059 - RNA, 24 nt, Artificial Sequence
  derived and/or modified sequence opt2 from anti-influenza_CDR
ggcgucuucuucuccucccacgcc

SEQ ID NO: 22060 - RNA, 24 nt, Artificial Sequence
  derived and/or modified sequence opt2 from anti-influenza_CDR
aucucccccauguucggcaccacc

SEQ ID NO: 22061 - RNA, 24 nt, Artificial Sequence
  derived and/or modified sequence opt2 from anti-influenza_CDR
ggcuucaccuucucccgcuucggc

SEQ ID NO: 22062 - RNA, 24 nt, Artificial Sequence
  derived and/or modified sequence opt2 from anti-influenza_CDR
aucugguacgacggcuccaacaag

SEQ ID NO: 22063 - RNA, 24 nt, Artificial Sequence
  derived and/or modified sequence opt2 from anti-influenza_CDR
cagaccuacggcggcgucuccacc

SEQ ID NO: 22064 - RNA, 24 nt, Artificial Sequence
  derived and/or modified sequence opt2 from anti-influenza_CDR
gacuccgccggcaaccgccacucc

SEQ ID NO: 22065 - RNA, 24 nt, Artificial Sequence
  derived and/or modified sequence opt2 from anti-influenza_CDR
uuccgcggcggcaacucccucucc

SEQ ID NO: 22066 - RNA, 24 nt, Artificial Sequence
  derived and/or modified sequence opt2 from anti-influenza_CDR
ggcuacaccuucaccaccuacugg

SEQ ID NO: 22067 - RNA, 24 nt, Artificial Sequence
  derived and/or modified sequence opt2 from anti-influenza_CDR
aucgaccccuacgacuccgagacc

SEQ ID NO: 22068 - RNA, 24 nt, Artificial Sequence
  derived and/or modified sequence opt2 from anti-influenza_CDR
auccgcaaguuccucaacugguac

SEQ ID NO: 22069 - RNA, 24 nt, Artificial Sequence
  derived and/or modified sequence opt2 from anti-influenza_CDR
cagcaguacgacggccuccccuuc

SEQ ID NO: 22070 - RNA, 24 nt, Artificial Sequence
  derived and/or modified sequence opt2 from anti-influenza_CDR
auccgcaacucccucaacugguac

SEQ ID NO: 22071 - RNA, 24 nt, Artificial Sequence
  derived and/or modified sequence opt2 from anti-influenza_CDR
cagcaggccaacuccuucccccuc

SEQ ID NO: 22072 - RNA, 24 nt, Artificial Sequence
  derived and/or modified sequence opt2 from anti-influenza_CDR
ucccuccucaccgaggucgagacc

SEQ ID NO: 22073 - RNA, 24 nt, Artificial Sequence
  derived and/or modified sequence opt2 from anti-influenza_CDR
cagcaguccuacuccaugcccgcc

SEQ ID NO: 22074 - RNA, 24 nt, Artificial Sequence
  derived and/or modified sequence opt2 from anti-influenza_CDR
ggcggccccgucuccggcggcggc

SEQ ID NO: 22075 - RNA, 24 nt, Artificial Sequence
  derived and/or modified sequence opt2 from anti-influenza_CDR
cagcaguccuucuccguccccgcc

SEQ ID NO: 22076 - RNA, 24 nt, Artificial Sequence
  derived and/or modified sequence opt2 from anti-influenza_CDR
cagcagaccuacuccaucccccuc

SEQ ID NO: 22077 - RNA, 24 nt, Artificial Sequence
  derived and/or modified sequence opt2 from anti-influenza_CDR
cagcaguccuacuccguccccgcc

SEQ ID NO: 22078 - RNA, 24 nt, Artificial Sequence
  derived and/or modified sequence opt2 from anti-influenza_CDR
cagcagaccuucuccaucccccuc

SEQ ID NO: 22079 - RNA, 24 nt, Artificial Sequence
  derived and/or modified sequence opt2 from anti-influenza_CDR
ggcgacuccaucaccuccggcgcc

SEQ ID NO: 22080 - RNA, 24 nt, Artificial Sequence
  derived and/or modified sequence opt2 from anti-influenza_CDR
caggccugggacuccuccaccgcc

SEQ ID NO: 22081 - RNA, 24 nt, Artificial Sequence
  derived and/or modified sequence opt2 from anti-influenza_CDR
cagcaguacggcuccucccucugg

SEQ ID NO: 22082 - RNA, 24 nt, Artificial Sequence
  derived and/or modified sequence opt2 from anti-influenza_CDR
gccuacggcuacaccuucgacccc

SEQ ID NO: 22083 - RNA, 24 nt, Artificial Sequence
  derived and/or modified sequence opt2 from anti-influenza_CDR
augcaggcccuccagaccccccuc

SEQ ID NO: 22084 - RNA, 24 nt, Artificial Sequence
  derived and/or modified sequence opt2 from anti-influenza_CDR
cagcaguacggcuccucccucacc

SEQ ID NO: 22085 - RNA, 24 nt, Artificial Sequence
  derived and/or modified sequence opt2 from anti-influenza_CDR
cagaaguacaacuccgcccccucc

SEQ ID NO: 22086 - RNA, 24 nt, Artificial Sequence
  derived and/or modified sequence opt2 from anti-influenza_CDR
cagcagcgcuccaacuggcucaag

SEQ ID NO: 22087 - RNA, 24 nt, Artificial Sequence
  derived and/or modified sequence opt2 from anti-influenza_CDR
uccucccagucccgcuccuccacc

SEQ ID NO: 22088 - RNA, 24 nt, Artificial Sequence
  derived and/or modified sequence opt2 from anti-influenza_CDR
cccuacgacguccccgacuacgag

SEQ ID NO: 22089 - RNA, 24 nt, Artificial Sequence
  derived and/or modified sequence opt2 from anti-influenza_CDR
cccuacgacguccccgacuacgcc

SEQ ID NO: 22090 - RNA, 24 nt, Artificial Sequence
  derived and/or modified sequence opt2 from anti-influenza_CDR
cccggcgacuucaacgacuacgag

SEQ ID NO: 22091 - RNA, 24 nt, Artificial Sequence
  derived and/or modified sequence opt2 from anti-influenza_CDR
cccaagguccgcgaccaggagucc

SEQ ID NO: 22092 - RNA, 24 nt, Artificial Sequence
  derived and/or modified sequence opt2 from anti-influenza_CDR
accuccuacaccuccuccaacacc

SEQ ID NO: 22093 - RNA, 24 nt, Artificial Sequence
  derived and/or modified sequence opt2 from anti-influenza_CDR
ggcggcaacuucaacaacuacgcc

SEQ ID NO: 22094 - RNA, 24 nt, Artificial Sequence
  derived and/or modified sequence opt2 from anti-influenza_CDR
aucucccccaucuucggcuccacc

SEQ ID NO: 22095 - RNA, 24 nt, Artificial Sequence
  derived and/or modified sequence opt2 from anti-influenza_CDR
uccuccuacaccuccuccaacacc

SEQ ID NO: 22096 - RNA, 24 nt, Artificial Sequence
  derived and/or modified sequence opt2 from anti-influenza_CDR
ggcggcaccuucaacaacuacgcc

SEQ ID NO: 22097 - RNA, 24 nt, Artificial Sequence
  derived and/or modified sequence opt2 from anti-influenza_CDR
aucucccccaucuucggcuccguc

SEQ ID NO: 22098 - RNA, 24 nt, Artificial Sequence
  derived and/or modified sequence opt2 from anti-influenza_CDR
uccuccaacaucggccacaacuuc

SEQ ID NO: 22099 - RNA, 24 nt, Artificial Sequence
  derived and/or modified sequence opt2 from anti-influenza_CDR
ggcaccugggacuccucccucucc

SEQ ID NO: 22100 - RNA, 24 nt, Artificial Sequence
  derived and/or modified sequence opt2 from anti-influenza_CDR
ggcggcaucauccgcaaguacgcc

SEQ ID NO: 22101 - RNA, 24 nt, Artificial Sequence
  derived and/or modified sequence opt2 from anti-influenza_CDR
aucaucgccaucuucaacaccgcc

SEQ ID NO: 22102 - RNA, 24 nt, Artificial Sequence
  derived and/or modified sequence opt2 from anti-influenza_CDR
ggcuacaccuucaccgccuacacc

SEQ ID NO: 22103 - RNA, 24 nt, Artificial Sequence
  derived and/or modified sequence opt2 from anti-influenza_CDR
aucaacgccggcaacggccacacc

SEQ ID NO: 22104 - RNA, 24 nt, Artificial Sequence
  derived and/or modified sequence opt2 from anti-influenza_CDR
ggcggcaccuucaucaacuacgcc

SEQ ID NO: 22105 - RNA, 24 nt, Artificial Sequence
  derived and/or modified sequence opt2 from anti-influenza_CDR
aucauccccgucuacggcaccucc

SEQ ID NO: 22106 - RNA, 24 nt, Artificial Sequence
  derived and/or modified sequence opt2 from anti-influenza_CDR
ggcuucaccuuccgcucccacgcc

SEQ ID NO: 22107 - RNA, 24 nt, Artificial Sequence
  derived and/or modified sequence opt2 from anti-influenza_CDR
aucuccuacgacgaggucaacaag

SEQ ID NO: 22108 - RNA, 24 nt, Artificial Sequence
  derived and/or modified sequence opt2 from anti-influenza_CDR
ggcuacaacuucgccgccuacuac

SEQ ID NO: 22109 - RNA, 24 nt, Artificial Sequence
  derived and/or modified sequence opt2 from anti-influenza_CDR
uccaaccccaacaccggcggcgcc

SEQ ID NO: 22110 - RNA, 24 nt, Artificial Sequence
  derived and/or modified sequence opt2 from anti-influenza_CDR
ggcuacacccucaucgacuacuac

SEQ ID NO: 22111 - RNA, 24 nt, Artificial Sequence
  derived and/or modified sequence opt2 from anti-influenza_CDR
aucaaccccaucaacggcggcacc

SEQ ID NO: 22112 - RNA, 24 nt, Artificial Sequence
  derived and/or modified sequence opt2 from anti-influenza_CDR
ggcuucaccuucuccgccuacgcc

SEQ ID NO: 22113 - RNA, 24 nt, Artificial Sequence
  derived and/or modified sequence opt2 from anti-influenza_CDR
accuccuacgacggccgcgacucc

SEQ ID NO: 22114 - RNA, 24 nt, Artificial Sequence
  derived and/or modified sequence opt2 from anti-influenza_CDR
ggcuucaccuucaccaacuacgcc

SEQ ID NO: 22115 - RNA, 24 nt, Artificial Sequence
  derived and/or modified sequence opt2 from anti-influenza_CDR
aucuccuucgacgaggacaacaag

SEQ ID NO: 22116 - RNA, 24 nt, Artificial Sequence
  derived and/or modified sequence opt2 from anti-influenza_CDR
ggcuucaacuucuccuccuacggc

SEQ ID NO: 22117 - RNA, 24 nt, Artificial Sequence
  derived and/or modified sequence opt2 from anti-influenza_CDR
aucugguccggcggcuccaacaag

SEQ ID NO: 22118 - RNA, 24 nt, Artificial Sequence
  derived and/or modified sequence opt2 from anti-influenza_CDR
ggcuucaucuucggcgacuucgcc

SEQ ID NO: 22119 - RNA, 24 nt, Artificial Sequence
  derived and/or modified sequence opt2 from anti-influenza_CDR
ggcuucaacuucgacgaguacguc

SEQ ID NO: 22120 - RNA, 24 nt, Artificial Sequence
  derived and/or modified sequence opt2 from anti-influenza_CDR
aucggcgccgacggccgcggcacc

SEQ ID NO: 22121 - RNA, 24 nt, Artificial Sequence
  derived and/or modified sequence opt2 from anti-influenza_CDR
ggcggcuccgucuccaacuacuac

SEQ ID NO: 22122 - RNA, 24 nt, Artificial Sequence
  derived and/or modified sequence opt2 from anti-influenza_CDR
ggcggcaccuucuccuacuacgcc

SEQ ID NO: 22123 - RNA, 24 nt, Artificial Sequence
  derived and/or modified sequence opt2 from anti-influenza_CDR
aucauccccaucgucggcaccgcc

SEQ ID NO: 22124 - RNA, 24 nt, Artificial Sequence
  derived and/or modified sequence opt2 from anti-influenza_CDR
accuccaacaucggcuccaacacc

SEQ ID NO: 22125 - RNA, 24 nt, Artificial Sequence
  derived and/or modified sequence opt2 from anti-influenza_CDR
ggcuacaacuuccccaaguacugg

SEQ ID NO: 22126 - RNA, 24 nt, Artificial Sequence
  derived and/or modified sequence opt2 from anti-influenza_CDR
aucuaccccggcgacuccgacguc

SEQ ID NO: 22127 - RNA, 24 nt, Artificial Sequence
  derived and/or modified sequence opt2 from anti-influenza_CDR
ggccacaccuucaucuccuacgcc

SEQ ID NO: 22128 - RNA, 24 nt, Artificial Sequence
  derived and/or modified sequence opt2 from anti-influenza_CDR
aucguccccaucuucggcaccguc

SEQ ID NO: 22129 - RNA, 24 nt, Artificial Sequence
  derived and/or modified sequence opt2 from anti-influenza_CDR
ggcuucaccuuccgcaccuacggc

SEQ ID NO: 22130 - RNA, 24 nt, Artificial Sequence
  derived and/or modified sequence opt2 from anti-influenza_CDR
aucuccuacgacggcaccaacaag

SEQ ID NO: 22131 - RNA, 24 nt, Artificial Sequence
  derived and/or modified sequence opt2 from anti-influenza_CDR
ggcuucaccuucuccuccuacggc

SEQ ID NO: 22132 - RNA, 24 nt, Artificial Sequence
  derived and/or modified sequence opt2 from anti-influenza_CDR
aucuccuacgacgagaucaacaag

SEQ ID NO: 22133 - RNA, 24 nt, Artificial Sequence
  derived and/or modified sequence opt2 from anti-influenza_CDR
ggcuucucccucuggaccuccggc

SEQ ID NO: 22134 - RNA, 24 nt, Artificial Sequence
  derived and/or modified sequence opt2 from anti-influenza_CDR
auguccuacgacgagaccaagaag

SEQ ID NO: 22135 - RNA, 24 nt, Artificial Sequence
  derived and/or modified sequence opt2 from anti-influenza_CDR
ggcuucaccuucucccgcuacucc

SEQ ID NO: 22136 - RNA, 24 nt, Artificial Sequence
  derived and/or modified sequence opt2 from anti-influenza_CDR
aucuccgacaccucccgcaccauc

SEQ ID NO: 22137 - RNA, 24 nt, Artificial Sequence
  derived and/or modified sequence opt2 from anti-influenza_CDR
ggcuucaccuucaacuccuacgcc

SEQ ID NO: 22138 - RNA, 24 nt, Artificial Sequence
  derived and/or modified sequence opt2 from anti-influenza_CDR
auccgcggcuccggcgagaacacc

SEQ ID NO: 22139 - RNA, 24 nt, Artificial Sequence
  derived and/or modified sequence opt2 from anti-influenza_CDR
ggcuucaccuucucccgcuucucc

SEQ ID NO: 22140 - RNA, 24 nt, Artificial Sequence
  derived and/or modified sequence opt2 from anti-influenza_CDR
aucuccgacaccggccgcaccauc

SEQ ID NO: 22141 - RNA, 24 nt, Artificial Sequence
  derived and/or modified sequence opt2 from anti-influenza_CDR
ggcgacuccuucaccuccuacugg

SEQ ID NO: 22142 - RNA, 24 nt, Artificial Sequence
  derived and/or modified sequence opt2 from anti-influenza_CDR
aucuacccccgcgacuccgagacc

SEQ ID NO: 22143 - RNA, 24 nt, Artificial Sequence
  derived and/or modified sequence opt2 from anti-influenza_CDR
ggcuacaccuucaccgccuaccac

SEQ ID NO: 22144 - RNA, 24 nt, Artificial Sequence
  derived and/or modified sequence opt2 from anti-influenza_CDR
aucaaccccaacuccggcgccacc

SEQ ID NO: 22145 - RNA, 24 nt, Artificial Sequence
  derived and/or modified sequence opt2 from anti-influenza_CDR
ggcuucaccuucuccgacuacugg

SEQ ID NO: 22146 - RNA, 24 nt, Artificial Sequence
  derived and/or modified sequence opt2 from anti-influenza_CDR
aucuccuccgacggcuccaccacc

SEQ ID NO: 22147 - RNA, 24 nt, Artificial Sequence
  derived and/or modified sequence opt2 from anti-influenza_CDR
ggcuucuccuucuccaacgccugg

SEQ ID NO: 22148 - RNA, 24 nt, Artificial Sequence
  derived and/or modified sequence opt2 from anti-influenza_CDR
ggccucaccuucuccaacgccugg

SEQ ID NO: 22149 - RNA, 24 nt, Artificial Sequence
  derived and/or modified sequence opt2 from anti-influenza_CDR
ggcuucaccuucuccaacgccugg

SEQ ID NO: 22150 - RNA, 24 nt, Artificial Sequence
  derived and/or modified sequence opt2 from anti-influenza_CDR
ggccucuccuuccucaacgccugg

SEQ ID NO: 22151 - RNA, 24 nt, Artificial Sequence
  derived and/or modified sequence opt2 from anti-influenza_CDR
ggcuucuccuuccucaacgccugg

SEQ ID NO: 22152 - RNA, 24 nt, Artificial Sequence
  derived and/or modified sequence opt2 from anti-influenza_CDR
ggccucaccuuccucaacgccugg

SEQ ID NO: 22153 - RNA, 24 nt, Artificial Sequence
  derived and/or modified sequence opt2 from anti-influenza_CDR
ggcuucaccuuccucaacgccugg

SEQ ID NO: 22154 - RNA, 24 nt, Artificial Sequence
  derived and/or modified sequence opt2 from anti-influenza_CDR
ggcuacaccuucaccgacuacuac

SEQ ID NO: 22155 - RNA, 24 nt, Artificial Sequence
  derived and/or modified sequence opt2 from anti-influenza_CDR
gucaaccccuacuccggcggcacc

SEQ ID NO: 22156 - RNA, 24 nt, Artificial Sequence
  derived and/or modified sequence opt2 from anti-influenza_CDR
ggcuacaccuucaccgacuacaac

SEQ ID NO: 22157 - RNA, 24 nt, Artificial Sequence
  derived and/or modified sequence opt2 from anti-influenza_CDR
aucuaccccaacaacggcggcacc

SEQ ID NO: 22158 - RNA, 24 nt, Artificial Sequence
  derived and/or modified sequence opt2 from anti-influenza_CDR
ggcuacaccuucaccggcuacaac

SEQ ID NO: 22159 - RNA, 24 nt, Artificial Sequence
  derived and/or modified sequence opt2 from anti-influenza_CDR
aucuaccccaacaacggcgucacc

SEQ ID NO: 22160 - RNA, 24 nt, Artificial Sequence
  derived and/or modified sequence opt2 from anti-influenza_CDR
auggagaccgacacccuccuccuc

SEQ ID NO: 22161 - RNA, 27 nt, Artificial Sequence
  derived and/or modified sequence opt2 from anti-influenza_CDR
gacggcgucaccaacaaggucaacucc

SEQ ID NO: 22162 - RNA, 27 nt, Artificial Sequence
  derived and/or modified sequence opt2 from anti-influenza_CDR
ggcuccgacgucggcuccuccaaccuc

SEQ ID NO: 22163 - RNA, 27 nt, Artificial Sequence
  derived and/or modified sequence opt2 from anti-influenza_CDR
augcagaacauccuccucccccucacc

SEQ ID NO: 22164 - RNA, 27 nt, Artificial Sequence
  derived and/or modified sequence opt2 from anti-influenza_CDR
augcagucccuccagcucccccucacc

SEQ ID NO: 22165 - RNA, 27 nt, Artificial Sequence
  derived and/or modified sequence opt2 from anti-influenza_CDR
cagcagcacuaccgcaccccccccacc

SEQ ID NO: 22166 - RNA, 27 nt, Artificial Sequence
  derived and/or modified sequence opt2 from anti-influenza_CDR
cagcaguacggcaacucccccuacacc

SEQ ID NO: 22167 - RNA, 27 nt, Artificial Sequence
  derived and/or modified sequence opt2 from anti-influenza_CDR
cagcaguacggcuccucccccuacacc

SEQ ID NO: 22168 - RNA, 27 nt, Artificial Sequence
  derived and/or modified sequence opt2 from anti-influenza_CDR
cagcaguacggcaccuccccccagacc

SEQ ID NO: 22169 - RNA, 27 nt, Artificial Sequence
  derived and/or modified sequence opt2 from anti-influenza_CDR
cagcaguacggcuaccucccccucacc

SEQ ID NO: 22170 - RNA, 27 nt, Artificial Sequence
  derived and/or modified sequence opt2 from anti-influenza_CDR
caggccugggacuccuccaccgccguc

SEQ ID NO: 22171 - RNA, 27 nt, Artificial Sequence
  derived and/or modified sequence opt2 from anti-influenza_CDR
cagcacuacaacgccuacuggggcacc

SEQ ID NO: 22172 - RNA, 27 nt, Artificial Sequence
  derived and/or modified sequence opt2 from anti-influenza_CDR
cagcagaccuacuccuccccccccacc

SEQ ID NO: 22173 - RNA, 27 nt, Artificial Sequence
  derived and/or modified sequence opt2 from anti-influenza_CDR
cagcaguacuacuccuuccccuacacc

SEQ ID NO: 22174 - RNA, 27 nt, Artificial Sequence
  derived and/or modified sequence opt2 from anti-influenza_CDR
augcaggcccuccagcucccccucgcc

SEQ ID NO: 22175 - RNA, 27 nt, Artificial Sequence
  derived and/or modified sequence opt2 from anti-influenza_CDR
cagcaggccaacuccuuccccuucacc

SEQ ID NO: 22176 - RNA, 27 nt, Artificial Sequence
  derived and/or modified sequence opt2 from anti-influenza_CDR
cagcagcucaacggcuacccccucacc

SEQ ID NO: 22177 - RNA, 27 nt, Artificial Sequence
  derived and/or modified sequence opt2 from anti-influenza_CDR
augcaggcccuccagaccccccucacc

SEQ ID NO: 22178 - RNA, 27 nt, Artificial Sequence
  derived and/or modified sequence opt2 from anti-influenza_CDR
cagcagaacuacaacuggccccucacc

SEQ ID NO: 22179 - RNA, 27 nt, Artificial Sequence
  derived and/or modified sequence opt2 from anti-influenza_CDR
cagcaguacgacaccuccuccggccuc

SEQ ID NO: 22180 - RNA, 27 nt, Artificial Sequence
  derived and/or modified sequence opt2 from anti-influenza_CDR
cagcaguacaacuccuggccccgcacc

SEQ ID NO: 22181 - RNA, 27 nt, Artificial Sequence
  derived and/or modified sequence opt2 from anti-influenza_CDR
gucaucuacucccacggccgcgccuac

SEQ ID NO: 22182 - RNA, 27 nt, Artificial Sequence
  derived and/or modified sequence opt2 from anti-influenza_CDR
cagcaguacggcgacucccgcuacacc

SEQ ID NO: 22183 - RNA, 27 nt, Artificial Sequence
  derived and/or modified sequence opt2 from anti-influenza_CDR
cuccagcacaacuccuaccccuacacc

SEQ ID NO: 22184 - RNA, 27 nt, Artificial Sequence
  derived and/or modified sequence opt2 from anti-influenza_CDR
cgcaagaugaccaccgccuucgacucc

SEQ ID NO: 22185 - RNA, 27 nt, Artificial Sequence
  derived and/or modified sequence opt2 from anti-influenza_CDR
cagcgcaaccacucccccuccuggacc

SEQ ID NO: 22186 - RNA, 27 nt, Artificial Sequence
  derived and/or modified sequence opt2 from anti-influenza_CDR
cagcaguccuacgacaacccccagacc

SEQ ID NO: 22187 - RNA, 27 nt, Artificial Sequence
  derived and/or modified sequence opt2 from anti-influenza_CDR
cagcagucccgccgccuccccuacacc

SEQ ID NO: 22188 - RNA, 27 nt, Artificial Sequence
  derived and/or modified sequence opt2 from anti-influenza_CDR
cgcaagaugaccaccgccaucgacuac

SEQ ID NO: 22189 - RNA, 27 nt, Artificial Sequence
  derived and/or modified sequence opt2 from anti-influenza_CDR
auccgcuacaccggccagcagcuccuc

SEQ ID NO: 22190 - RNA, 27 nt, Artificial Sequence
  derived and/or modified sequence opt2 from anti-influenza_CDR
cagcacuacggcaccaucucccagacc

SEQ ID NO: 22191 - RNA, 27 nt, Artificial Sequence
  derived and/or modified sequence opt2 from anti-influenza_CDR
cagcaguacuccaccuccccccccacc

SEQ ID NO: 22192 - RNA, 27 nt, Artificial Sequence
  derived and/or modified sequence opt2 from anti-influenza_CDR
cagcaguacggcaacucccccaucacc

SEQ ID NO: 22193 - RNA, 27 nt, Artificial Sequence
  derived and/or modified sequence opt2 from anti-influenza_CDR
cagcaguacuacucccgccccuacacc

SEQ ID NO: 22194 - RNA, 27 nt, Artificial Sequence
  derived and/or modified sequence opt2 from anti-influenza_CDR
caggucugggacaacuucggcggcguc

SEQ ID NO: 22195 - RNA, 27 nt, Artificial Sequence
  derived and/or modified sequence opt2 from anti-influenza_CDR
cagcaguccuacuccuccccccucacc

SEQ ID NO: 22196 - RNA, 27 nt, Artificial Sequence
  derived and/or modified sequence opt2 from anti-influenza_CDR
cagcaguacuucgccaccccccgcacc

SEQ ID NO: 22197 - RNA, 27 nt, Artificial Sequence
  derived and/or modified sequence opt2 from anti-influenza_CDR
cagcaguacuacuucuccccccucacc

SEQ ID NO: 22198 - RNA, 27 nt, Artificial Sequence
  derived and/or modified sequence opt2 from anti-influenza_CDR
cagcacuucggcaccuccgucuucacc

SEQ ID NO: 22199 - RNA, 27 nt, Artificial Sequence
  derived and/or modified sequence opt2 from anti-influenza_CDR
cagcaguacuacaacgccccccucacc

SEQ ID NO: 22200 - RNA, 27 nt, Artificial Sequence
  derived and/or modified sequence opt2 from anti-influenza_CDR
guccucuucaccucccccuucgacuuc

SEQ ID NO: 22201 - RNA, 27 nt, Artificial Sequence
  derived and/or modified sequence opt2 from anti-influenza_CDR
cuccucuccuacuccggcgucuggguc

SEQ ID NO: 22202 - RNA, 27 nt, Artificial Sequence
  derived and/or modified sequence opt2 from anti-influenza_CDR
uuccucuccuacuccggcgccuggguc

SEQ ID NO: 22203 - RNA, 27 nt, Artificial Sequence
  derived and/or modified sequence opt2 from anti-influenza_CDR
cagcaguccuucuccaaguccuggacc

SEQ ID NO: 22204 - RNA, 27 nt, Artificial Sequence
  derived and/or modified sequence opt2 from anti-influenza_CDR
guccaguacguccaguuccccuggacc

SEQ ID NO: 22205 - RNA, 27 nt, Artificial Sequence
  derived and/or modified sequence opt2 from anti-influenza_CDR
cagcaguccuacucccccccccucacc

SEQ ID NO: 22206 - RNA, 27 nt, Artificial Sequence
  derived and/or modified sequence opt2 from anti-influenza_CDR
uucaucuacuacggcggcaacaccaag

SEQ ID NO: 22207 - RNA, 27 nt, Artificial Sequence
  derived and/or modified sequence opt2 from anti-influenza_CDR
gucaucuacuccggcggcuccaccuac

SEQ ID NO: 22208 - RNA, 27 nt, Artificial Sequence
  derived and/or modified sequence opt2 from anti-influenza_CDR
uucauguuccacuccggcuccccccgc

SEQ ID NO: 22209 - RNA, 27 nt, Artificial Sequence
  derived and/or modified sequence opt2 from anti-influenza_CDR
cagcagaccuacuccacccccaucacc

SEQ ID NO: 22210 - RNA, 27 nt, Artificial Sequence
  derived and/or modified sequence opt2 from anti-influenza_CDR
uucuucuacaacggcggcuccaccaag

SEQ ID NO: 22211 - RNA, 27 nt, Artificial Sequence
  derived and/or modified sequence opt2 from anti-influenza_CDR
cagcaguccuacaacaccccccucauc

SEQ ID NO: 22212 - RNA, 27 nt, Artificial Sequence
  derived and/or modified sequence opt2 from anti-influenza_CDR
cacaucuacgacuacggccgcaccuuc

SEQ ID NO: 22213 - RNA, 27 nt, Artificial Sequence
  derived and/or modified sequence opt2 from anti-influenza_CDR
gucuucuacuccgagacccgcaccuac

SEQ ID NO: 22214 - RNA, 27 nt, Artificial Sequence
  derived and/or modified sequence opt2 from anti-influenza_CDR
caggucuggggcuccuccuccgaccac

SEQ ID NO: 22215 - RNA, 27 nt, Artificial Sequence
  derived and/or modified sequence opt2 from anti-influenza_CDR
uacgucuacaaccgcggcuccaccaag

SEQ ID NO: 22216 - RNA, 27 nt, Artificial Sequence
  derived and/or modified sequence opt2 from anti-influenza_CDR
uacaucuacaaccgcggcuccaccaag

SEQ ID NO: 22217 - RNA, 27 nt, Artificial Sequence
  derived and/or modified sequence opt2 from anti-influenza_CDR
cagcaguccuacaacacccccaucacc

SEQ ID NO: 22218 - RNA, 27 nt, Artificial Sequence
  derived and/or modified sequence opt2 from anti-influenza_CDR
cagcaguacuacuccuccccccccacc

SEQ ID NO: 22219 - RNA, 27 nt, Artificial Sequence
  derived and/or modified sequence opt2 from anti-influenza_CDR
uaccucuacuacuccggcuccaccaag

SEQ ID NO: 22220 - RNA, 27 nt, Artificial Sequence
  derived and/or modified sequence opt2 from anti-influenza_CDR
cagcaguccuacuccccccccaucacc

SEQ ID NO: 22221 - RNA, 27 nt, Artificial Sequence
  derived and/or modified sequence opt2 from anti-influenza_CDR
uacgucuacaacuccggcaacaccaag

SEQ ID NO: 22222 - RNA, 27 nt, Artificial Sequence
  derived and/or modified sequence opt2 from anti-influenza_CDR
cagcaguccuacaacaccccccucacc

SEQ ID NO: 22223 - RNA, 27 nt, Artificial Sequence
  derived and/or modified sequence opt2 from anti-influenza_CDR
cacaucuucgacuccggcuccaccuac

SEQ ID NO: 22224 - RNA, 27 nt, Artificial Sequence
  derived and/or modified sequence opt2 from anti-influenza_CDR
gucuucuacuccgccgaccgcaccucc

SEQ ID NO: 22225 - RNA, 27 nt, Artificial Sequence
  derived and/or modified sequence opt2 from anti-influenza_CDR
cagcaguacuacuccaccccccucacc

SEQ ID NO: 22226 - RNA, 27 nt, Artificial Sequence
  derived and/or modified sequence opt2 from anti-influenza_CDR
uacaucuacuacuccggcaacaccuac

SEQ ID NO: 22227 - RNA, 27 nt, Artificial Sequence
  derived and/or modified sequence opt2 from anti-influenza_CDR
cagcaguccuacuccaccccccucacc

SEQ ID NO: 22228 - RNA, 27 nt, Artificial Sequence
  derived and/or modified sequence opt2 from anti-influenza_CDR
cagcaguacggcuccuccucccucacc

SEQ ID NO: 22229 - RNA, 27 nt, Artificial Sequence
  derived and/or modified sequence opt2 from anti-influenza_CDR
uccuccuacaccuccuccuccaccuac

SEQ ID NO: 22230 - RNA, 27 nt, Artificial Sequence
  derived and/or modified sequence opt2 from anti-influenza_CDR
cagcgcuacaacuccgccccccccauc

SEQ ID NO: 22231 - RNA, 27 nt, Artificial Sequence
  derived and/or modified sequence opt2 from anti-influenza_CDR
cagcaguacggccgcaccccccucacc

SEQ ID NO: 22232 - RNA, 27 nt, Artificial Sequence
  derived and/or modified sequence opt2 from anti-influenza_CDR
cagcaguacggcuccuccccccgcacc

SEQ ID NO: 22233 - RNA, 27 nt, Artificial Sequence
  derived and/or modified sequence opt2 from anti-influenza_CDR
cagcaguacggcuccuccccccucacc

SEQ ID NO: 22234 - RNA, 27 nt, Artificial Sequence
  derived and/or modified sequence opt2 from anti-influenza_CDR
caggucugggacuccuccuccgaccac

SEQ ID NO: 22235 - RNA, 27 nt, Artificial Sequence
  derived and/or modified sequence opt2 from anti-influenza_CDR
aaggaguucuccgaggucgagggccgc

SEQ ID NO: 22236 - RNA, 27 nt, Artificial Sequence
  derived and/or modified sequence opt2 from anti-influenza_CDR
aaggaguucaacaaccucgagaagcgc

SEQ ID NO: 22237 - RNA, 27 nt, Artificial Sequence
  derived and/or modified sequence opt2 from anti-influenza_CDR
cagcagcacuaccgcaccccccccucc

SEQ ID NO: 22238 - RNA, 27 nt, Artificial Sequence
  derived and/or modified sequence opt2 from anti-influenza_CDR
augcaggccacccacuggccccucacc

SEQ ID NO: 22239 - RNA, 27 nt, Artificial Sequence
  derived and/or modified sequence opt2 from anti-influenza_CDR
cagcaguacuacuccuaccccuacacc

SEQ ID NO: 22240 - RNA, 27 nt, Artificial Sequence
  derived and/or modified sequence opt2 from anti-influenza_CDR
uccuccgacgucggcggcuacaacuac

SEQ ID NO: 22241 - RNA, 27 nt, Artificial Sequence
  derived and/or modified sequence opt2 from anti-influenza_CDR
uccuccgacgucggcgacuacaacuac

SEQ ID NO: 22242 - RNA, 27 nt, Artificial Sequence
  derived and/or modified sequence opt2 from anti-influenza_CDR
cagcaguacaacaacuggccccucucc

SEQ ID NO: 22243 - RNA, 27 nt, Artificial Sequence
  derived and/or modified sequence opt2 from anti-influenza_CDR
cagcaguccuacaacuacccccgcacc

SEQ ID NO: 22244 - RNA, 27 nt, Artificial Sequence
  derived and/or modified sequence opt2 from anti-influenza_CDR
augcagggccuccagacccccuacacc

SEQ ID NO: 22245 - RNA, 27 nt, Artificial Sequence
  derived and/or modified sequence opt2 from anti-influenza_CDR
cagcagcacuacuccaucccccucacc

SEQ ID NO: 22246 - RNA, 27 nt, Artificial Sequence
  derived and/or modified sequence opt2 from anti-influenza_CDR
cuccagcacaacuccuaccccuggacc

SEQ ID NO: 22247 - RNA, 27 nt, Artificial Sequence
  derived and/or modified sequence opt2 from anti-influenza_CDR
cagcaguacaacaccuggccccucacc

SEQ ID NO: 22248 - RNA, 27 nt, Artificial Sequence
  derived and/or modified sequence opt2 from anti-influenza_CDR
cagcaguacaacuccuuccccuaccgc

SEQ ID NO: 22249 - RNA, 27 nt, Artificial Sequence
  derived and/or modified sequence opt2 from anti-influenza_CDR
cagcaguccuacuccgcccccuucacc

SEQ ID NO: 22250 - RNA, 27 nt, Artificial Sequence
  derived and/or modified sequence opt2 from anti-influenza_CDR
caggccugggacuccuccaccgucguc

SEQ ID NO: 22251 - RNA, 27 nt, Artificial Sequence
  derived and/or modified sequence opt2 from anti-influenza_CDR
caggccugggacuccaccaccgucguc

SEQ ID NO: 22252 - RNA, 27 nt, Artificial Sequence
  derived and/or modified sequence opt2 from anti-influenza_CDR
cuccaguacggcuccuccccccgcacc

SEQ ID NO: 22253 - RNA, 27 nt, Artificial Sequence
  derived and/or modified sequence opt2 from anti-influenza_CDR
uccuccgacgucggcggcuacgacuac

SEQ ID NO: 22254 - RNA, 27 nt, Artificial Sequence
  derived and/or modified sequence opt2 from anti-influenza_CDR
cagcaguacaccuacuggccccucacc

SEQ ID NO: 22255 - RNA, 27 nt, Artificial Sequence
  derived and/or modified sequence opt2 from anti-influenza_CDR
cagcaguacgacaaguggccccccggc

SEQ ID NO: 22256 - RNA, 27 nt, Artificial Sequence
  derived and/or modified sequence opt2 from anti-influenza_CDR
augcagucccuccagaccuccaucacc

SEQ ID NO: 22257 - RNA, 27 nt, Artificial Sequence
  derived and/or modified sequence opt2 from anti-influenza_CDR
ucccagaucgagcucgccguccuccuc

SEQ ID NO: 22258 - RNA, 27 nt, Artificial Sequence
  derived and/or modified sequence opt2 from anti-influenza_CDR
augcaggcccuccagacccccuacacc

SEQ ID NO: 22259 - RNA, 27 nt, Artificial Sequence
  derived and/or modified sequence opt2 from anti-influenza_CDR
cagcagcgcucccacuggccccccauc

SEQ ID NO: 22260 - RNA, 27 nt, Artificial Sequence
  derived and/or modified sequence opt2 from anti-influenza_CDR
cagcacuucuggggcaccccccucacc

SEQ ID NO: 22261 - RNA, 27 nt, Artificial Sequence
  derived and/or modified sequence opt2 from anti-influenza_CDR
cagcagaacuacgaggaccccuggacc

SEQ ID NO: 22262 - RNA, 27 nt, Artificial Sequence
  derived and/or modified sequence opt2 from anti-influenza_CDR
cagcaggccaacuccuucccccccacc

SEQ ID NO: 22263 - RNA, 27 nt, Artificial Sequence
  derived and/or modified sequence opt2 from anti-influenza_CDR
cagcagcgcgaccacuggccccccauc

SEQ ID NO: 22264 - RNA, 27 nt, Artificial Sequence
  derived and/or modified sequence opt2 from anti-influenza_CDR
auggacucccgccucaaccucgucuuc

SEQ ID NO: 22265 - RNA, 27 nt, Artificial Sequence
  derived and/or modified sequence opt2 from anti-influenza_CDR
augaagcuccccguccgccuccucguc

SEQ ID NO: 22266 - RNA, 30 nt, Artificial Sequence
  derived and/or modified sequence opt2 from anti-influenza_CDR
ggcgacuccgucacccgcggcggcuucuac

SEQ ID NO: 22267 - RNA, 30 nt, Artificial Sequence
  derived and/or modified sequence opt2 from anti-influenza_CDR
caguccgucaccuucaacaacaagaacuac

SEQ ID NO: 22268 - RNA, 30 nt, Artificial Sequence
  derived and/or modified sequence opt2 from anti-influenza_CDR
caguccgucaccuucaacuacaagaacuac

SEQ ID NO: 22269 - RNA, 30 nt, Artificial Sequence
  derived and/or modified sequence opt2 from anti-influenza_CDR
cgcgcccagucccucuccuccuaccuccac

SEQ ID NO: 22270 - RNA, 30 nt, Artificial Sequence
  derived and/or modified sequence opt2 from anti-influenza_CDR
uccuccuacaccuccuccuccaccuacguc

SEQ ID NO: 22271 - RNA, 30 nt, Artificial Sequence
  derived and/or modified sequence opt2 from anti-influenza_CDR
cagcgcuacaacuccgccccccccaucacc

SEQ ID NO: 22272 - RNA, 30 nt, Artificial Sequence
  derived and/or modified sequence opt2 from anti-influenza_CDR
ggcggcuccaucuccuccggcaccuacuac

SEQ ID NO: 22273 - RNA, 30 nt, Artificial Sequence
  derived and/or modified sequence opt2 from anti-influenza_CDR
cagcaguccuacuccucccucauguucacc

SEQ ID NO: 22274 - RNA, 30 nt, Artificial Sequence
  derived and/or modified sequence opt2 from anti-influenza_CDR
cuccucaucuacggcgccuccacccgcgcc

SEQ ID NO: 22275 - RNA, 30 nt, Artificial Sequence
  derived and/or modified sequence opt2 from anti-influenza_CDR
ugcgccuacggcggcaaguaccucgucguc

SEQ ID NO: 22276 - RNA, 30 nt, Artificial Sequence; identical to SEQ ID NO: 14634
  derived and/or modified sequence opt2 from anti-influenza_CDR

SEQ ID NO: 22277 - RNA, 30 nt, Artificial Sequence
  derived and/or modified sequence opt2 from anti-influenza_CDR
cagcacuacggcuacuccccccgcuacgcc

SEQ ID NO: 22278 - RNA, 30 nt, Artificial Sequence
  derived and/or modified sequence opt2 from anti-influenza_CDR
cagcagcgcucccacuggccccccaucacc

SEQ ID NO: 22279 - RNA, 30 nt, Artificial Sequence
  derived and/or modified sequence opt2 from anti-influenza_CDR
uccuccuacgccggcuccuccaccuggguc

SEQ ID NO: 22280 - RNA, 30 nt, Artificial Sequence
  derived and/or modified sequence opt2 from anti-influenza_CDR
cuccucuacuccggcggcgaccccgucgcc

SEQ ID NO: 22281 - RNA, 30 nt, Artificial Sequence
  derived and/or modified sequence opt2 from anti-influenza_CDR
cagcaguacggcggcuccccccgcuacacc

SEQ ID NO: 22282 - RNA, 30 nt, Artificial Sequence
  derived and/or modified sequence opt2 from anti-influenza_CDR
cgcuacggcuccggcuacggcuucgacucc

SEQ ID NO: 22283 - RNA, 30 nt, Artificial Sequence
  derived and/or modified sequence opt2 from anti-influenza_CDR
uccuccuacgccggcaacuacaaccacguc

SEQ ID NO: 22284 - RNA, 30 nt, Artificial Sequence
  derived and/or modified sequence opt2 from anti-influenza_CDR
cagcaguacaucaacuggcgcccccucucc

SEQ ID NO: 22285 - RNA, 30 nt, Artificial Sequence
  derived and/or modified sequence opt2 from anti-influenza_CDR
aucggcgccggcuacgacguccacugguac

SEQ ID NO: 22286 - RNA, 30 nt, Artificial Sequence
  derived and/or modified sequence opt2 from anti-influenza_CDR
cuccucaucuacgacaacaacaaccgcccc

SEQ ID NO: 22287 - RNA, 30 nt, Artificial Sequence
  derived and/or modified sequence opt2 from anti-influenza_CDR
caguccuacgacaacucccucuccggcucc

SEQ ID NO: 22288 - RNA, 30 nt, Artificial Sequence
  derived and/or modified sequence opt2 from anti-influenza_CDR
cuccucaucuacgacgccuccaaccuccag

SEQ ID NO: 22289 - RNA, 30 nt, Artificial Sequence
  derived and/or modified sequence opt2 from anti-influenza_CDR
cuccucauccacgacgccuccaaccucgag

SEQ ID NO: 22290 - RNA, 30 nt, Artificial Sequence
  derived and/or modified sequence opt2 from anti-influenza_CDR
guccagcgccucuccuacggcauggacguc

SEQ ID NO: 22291 - RNA, 30 nt, Artificial Sequence
  derived and/or modified sequence opt2 from anti-influenza_CDR
guccagaaguccuacuacggcauggacguc

SEQ ID NO: 22292 - RNA, 30 nt, Artificial Sequence
  derived and/or modified sequence opt2 from anti-influenza_CDR
uccuccuacaccuccuccuccacccacguc

SEQ ID NO: 22293 - RNA, 30 nt, Artificial Sequence
  derived and/or modified sequence opt2 from anti-influenza_CDR
uccuccuacaccuccuccuccacccucguc

SEQ ID NO: 22294 - RNA, 30 nt, Artificial Sequence
  derived and/or modified sequence opt2 from anti-influenza_CDR
accaagcgcucccagcagaccgucaucccc

SEQ ID NO: 22295 - RNA, 30 nt, Artificial Sequence
  derived and/or modified sequence opt2 from anti-influenza_CDR
accucccgcucccagcagaccgucaucccc

SEQ ID NO: 22296 - RNA, 30 nt, Artificial Sequence
  derived and/or modified sequence opt2 from anti-influenza_CDR
uccuccaacuacaaccgccgcuucaccccc

SEQ ID NO: 22297 - RNA, 30 nt, Artificial Sequence
  derived and/or modified sequence opt2 from anti-influenza_CDR
cgccccaagguccgcgaccaggagucccgc

SEQ ID NO: 22298 - RNA, 30 nt, Artificial Sequence
  derived and/or modified sequence opt2 from anti-influenza_CDR
cgccccuggguccgcggcgucuccucccgc

SEQ ID NO: 22299 - RNA, 30 nt, Artificial Sequence
  derived and/or modified sequence opt2 from anti-influenza_CDR
cgccccuggguccgcggccucuccucccgc

SEQ ID NO: 22300 - RNA, 30 nt, Artificial Sequence
  derived and/or modified sequence opt2 from anti-influenza_CDR
cgccccaagguccgcggccaggccggccgc

SEQ ID NO: 22301 - RNA, 30 nt, Artificial Sequence
  derived and/or modified sequence opt2 from anti-influenza_CDR
gcccccgccgucgccgcccaggccuccgcc

SEQ ID NO: 22302 - RNA, 30 nt, Artificial Sequence
  derived and/or modified sequence opt2 from anti-influenza_CDR
guccaccaccccggcaccgacaacgaccag

SEQ ID NO: 22303 - RNA, 30 nt, Artificial Sequence
  derived and/or modified sequence opt2 from anti-influenza_CDR
uucggccagggcaccaaggucgagaucaag

SEQ ID NO: 22304 - RNA, 30 nt, Artificial Sequence; identical to SEQ ID NO: 14662
  derived and/or modified sequence opt2 from anti-influenza_CDR

SEQ ID NO: 22305 - RNA, 30 nt, Artificial Sequence
  derived and/or modified sequence opt2 from anti-influenza_CDR
ggccucaccuucuccuccuacgccguccac

SEQ ID NO: 22306 - RNA, 30 nt, Artificial Sequence
  derived and/or modified sequence opt2 from anti-influenza_CDR
ggccccaccuucuccuccuacgccguccac

SEQ ID NO: 22307 - RNA, 30 nt, Artificial Sequence
  derived and/or modified sequence opt2 from anti-influenza_CDR
ggcuccaucuucuccaacuacggcaucucc

SEQ ID NO: 22308 - RNA, 30 nt, Artificial Sequence
  derived and/or modified sequence opt2 from anti-influenza_CDR
ggcuacuccuucaacaacuacggcaucaac

SEQ ID NO: 22309 - RNA, 30 nt, Artificial Sequence; identical to SEQ ID NO: 14667
  derived and/or modified sequence opt2 from anti-influenza_CDR

SEQ ID NO: 22310 - RNA, 30 nt, Artificial Sequence
  derived and/or modified sequence opt2 from anti-influenza_CDR
ggcuacaccuucaccuccuucaucauguac

SEQ ID NO: 22311 - RNA, 30 nt, Artificial Sequence
  derived and/or modified sequence opt2 from anti-influenza_CDR
cgcggcaacuacggcaacggcuucgccuac

SEQ ID NO: 22312 - RNA, 30 nt, Artificial Sequence
  derived and/or modified sequence opt2 from anti-influenza_CDR
cagcaguacggcuccucccccgcccucacc

SEQ ID NO: 22313 - RNA, 30 nt, Artificial Sequence
  derived and/or modified sequence opt2 from anti-influenza_CDR
caggaguacaacaacgacuccccccucacc

SEQ ID NO: 22314 - RNA, 30 nt, Artificial Sequence
  derived and/or modified sequence opt2 from anti-influenza_CDR
auccgcuccggccucaaccgcuucgagacc

SEQ ID NO: 22315 - RNA, 30 nt, Artificial Sequence
  derived and/or modified sequence opt2 from anti-influenza_CDR
gucuucuacuccggcuccuccaacuacaac

SEQ ID NO: 22316 - RNA, 30 nt, Artificial Sequence
  derived and/or modified sequence opt2 from anti-influenza_CDR
ggcgccuccaucuccaccggcggcaacuac

SEQ ID NO: 22317 - RNA, 30 nt, Artificial Sequence
  derived and/or modified sequence opt2 from anti-influenza_CDR
aucuucuacuccggcaccaccaaguacaac

SEQ ID NO: 22318 - RNA, 30 nt, Artificial Sequence
  derived and/or modified sequence opt2 from anti-influenza_CDR
gccuccuacgccggcaccuacauccaccuc

SEQ ID NO: 22319 - RNA, 30 nt, Artificial Sequence
  derived and/or modified sequence opt2 from anti-influenza_CDR
cagcagcucaacuccuacccccccaucacc

SEQ ID NO: 22320 - RNA, 30 nt, Artificial Sequence
  derived and/or modified sequence opt2 from anti-influenza_CDR
cagcaguucaacgacuggcccuuccucacc

SEQ ID NO: 22321 - RNA, 30 nt, Artificial Sequence
  derived and/or modified sequence opt2 from anti-influenza_CDR
cagcagcucaccaccuacccccccaucacc

SEQ ID NO: 22322 - RNA, 30 nt, Artificial Sequence
  derived and/or modified sequence opt2 from anti-influenza_CDR
ggcggcuccaucuccaacggcggcuaccac

SEQ ID NO: 22323 - RNA, 30 nt, Artificial Sequence
  derived and/or modified sequence opt2 from anti-influenza_CDR
ggcgacuccgucaucaacuccgccuacuac

SEQ ID NO: 22324 - RNA, 30 nt, Artificial Sequence
  derived and/or modified sequence opt2 from anti-influenza_CDR
cagcaguacgacaacuggcuccccaucacc

SEQ ID NO: 22325 - RNA, 30 nt, Artificial Sequence
  derived and/or modified sequence opt2 from anti-influenza_CDR
gccggcgacuacuccggcggcaucuacgcc

SEQ ID NO: 22326 - RNA, 30 nt, Artificial Sequence
  derived and/or modified sequence opt2 from anti-influenza_CDR
gccggcgacuacuccggcuccaacuacgcc

SEQ ID NO: 22327 - RNA, 30 nt, Artificial Sequence
  derived and/or modified sequence opt2 from anti-influenza_CDR
gccggcgacuacuccggcgccaacuacgcc

SEQ ID NO: 22328 - RNA, 30 nt, Artificial Sequence
  derived and/or modified sequence opt2 from anti-influenza_CDR
ggccucucccucuacuccaacgagaucaac

SEQ ID NO: 22329 - RNA, 30 nt, Artificial Sequence
  derived and/or modified sequence opt2 from anti-influenza_CDR
gccuccuacgccggcaacaacaucuacguc

SEQ ID NO: 22330 - RNA, 30 nt, Artificial Sequence
  derived and/or modified sequence opt2 from anti-influenza_CDR
gccucccaguccgucuccaccuuccucgcc

SEQ ID NO: 22331 - RNA, 30 nt, Artificial Sequence
  derived and/or modified sequence opt2 from anti-influenza_CDR
aucaaguccaacaccgacggcggcaccacc

SEQ ID NO: 22332 - RNA, 30 nt, Artificial Sequence
  derived and/or modified sequence opt2 from anti-influenza_CDR
gaguccgucgacaucuacggcaacuccuuc

SEQ ID NO: 22333 - RNA, 30 nt, Artificial Sequence
  derived and/or modified sequence opt2 from anti-influenza_CDR
gaguccaucgacaucuacggcaacuccuuc

SEQ ID NO: 22334 - RNA, 30 nt, Artificial Sequence
  derived and/or modified sequence opt2 from anti-influenza_CDR
gccggcgacuacuccggcgucaacuacgcc

SEQ ID NO: 22335 - RNA, 33 nt, Artificial Sequence
  derived and/or modified sequence opt2 from anti-influenza_CDR
gccgccugggacgacucccucaacggccagcuc

SEQ ID NO: 22336 - RNA, 33 nt, Artificial Sequence
  derived and/or modified sequence opt2 from anti-influenza_CDR
ugcuccuacgccggcuccuccuccucccgcguc

SEQ ID NO: 22337 - RNA, 33 nt, Artificial Sequence
  derived and/or modified sequence opt2 from anti-influenza_CDR
cucguccucgccaccggccuccgcaacuccccc

SEQ ID NO: 22338 - RNA, 33 nt, Artificial Sequence
  derived and/or modified sequence opt2 from anti-influenza_CDR
cagucccuccuccacuccgacggcaagaccuac

SEQ ID NO: 22339 - RNA, 33 nt, Artificial Sequence
  derived and/or modified sequence opt2 from anti-influenza_CDR
cgcaccucccagucccucuccuccuaccuccac

SEQ ID NO: 22340 - RNA, 33 nt, Artificial Sequence
  derived and/or modified sequence opt2 from anti-influenza_CDR
cgcgccucccagcgccucaacuccuaccuccac

SEQ ID NO: 22341 - RNA, 33 nt, Artificial Sequence
  derived and/or modified sequence opt2 from anti-influenza_CDR
cgcaccucccagucccuccgcuccuaccuccac

SEQ ID NO: 22342 - RNA, 33 nt, Artificial Sequence
  derived and/or modified sequence opt2 from anti-influenza_CDR
cgcaccucccagucccucuccuccuacacccac

SEQ ID NO: 22343 - RNA, 33 nt, Artificial Sequence
  derived and/or modified sequence opt2 from anti-influenza_CDR
cgcaccucccagucccucuccuccuacgaccac

SEQ ID NO: 22344 - RNA, 33 nt, Artificial Sequence
  derived and/or modified sequence opt2 from anti-influenza_CDR
caggucugggacuccuccuccgaccacuacguc

SEQ ID NO: 22345 - RNA, 33 nt, Artificial Sequence
  derived and/or modified sequence opt2 from anti-influenza_CDR
caggucuggggcuccuccuccgaccacuacguc

SEQ ID NO: 22346 - RNA, 33 nt, Artificial Sequence
  derived and/or modified sequence opt2 from anti-influenza_CDR
ggcaccugggacuccucccucuccgucggcaug

SEQ ID NO: 22347 - RNA, 33 nt, Artificial Sequence
  derived and/or modified sequence opt2 from anti-influenza_CDR
cagucccuccuccacggcaacggcuacaacuac

SEQ ID NO: 22348 - RNA, 33 nt, Artificial Sequence
  derived and/or modified sequence opt2 from anti-influenza_CDR
cgcgccucccagggcauccgcaacgaccucggc

SEQ ID NO: 22349 - RNA, 33 nt, Artificial Sequence
  derived and/or modified sequence opt2 from anti-influenza_CDR
cgcgccucccagaacauccgcuccuaccucaac

SEQ ID NO: 22350 - RNA, 33 nt, Artificial Sequence
  derived and/or modified sequence opt2 from anti-influenza_CDR
cgcgccaaccaggacaucggcaucuaccucaac

SEQ ID NO: 22351 - RNA, 33 nt, Artificial Sequence
  derived and/or modified sequence opt2 from anti-influenza_CDR
cgcgccucccaguccgucuccaacaaccucgcc

SEQ ID NO: 22352 - RNA, 33 nt, Artificial Sequence
  derived and/or modified sequence opt2 from anti-influenza_CDR
cagcaguaccacaacuggccccccuccuacucc

SEQ ID NO: 22353 - RNA, 33 nt, Artificial Sequence
  derived and/or modified sequence opt2 from anti-influenza_CDR
cgcgccucccagggcauccucaacugccucgcc

SEQ ID NO: 22354 - RNA, 33 nt, Artificial Sequence
  derived and/or modified sequence opt2 from anti-influenza_CDR
cgcgccucccaguccaucgccuccuggcucgcc

SEQ ID NO: 22355 - RNA, 33 nt, Artificial Sequence
  derived and/or modified sequence opt2 from anti-influenza_CDR
gccccccgcgucuacgaguacuacuucgaccag

SEQ ID NO: 22356 - RNA, 33 nt, Artificial Sequence
  derived and/or modified sequence opt2 from anti-influenza_CDR
cgcgccucccaguccgucuccuccuaccucgcc

SEQ ID NO: 22357 - RNA, 33 nt, Artificial Sequence
  derived and/or modified sequence opt2 from anti-influenza_CDR
uccggcgacgcccuccccaagcagaacgccuac

SEQ ID NO: 22358 - RNA, 33 nt, Artificial Sequence
  derived and/or modified sequence opt2 from anti-influenza_CDR
caguccgccgacuccuccggcaccuccuggguc

SEQ ID NO: 22359 - RNA, 33 nt, Artificial Sequence
  derived and/or modified sequence opt2 from anti-influenza_CDR
ggcggcuccaacaucggcggcaaguccguccac

SEQ ID NO: 22360 - RNA, 33 nt, Artificial Sequence
  derived and/or modified sequence opt2 from anti-influenza_CDR
cagcacuacggcuccuccccccgcuacgccuuc

SEQ ID NO: 22361 - RNA, 33 nt, Artificial Sequence
  derived and/or modified sequence opt2 from anti-influenza_CDR
cgcgccucccaguccaucuccuccuaccucaac

SEQ ID NO: 22362 - RNA, 33 nt, Artificial Sequence
  derived and/or modified sequence opt2 from anti-influenza_CDR
ggcggcaacgccaucggcuccaagaagguccac

SEQ ID NO: 22363 - RNA, 33 nt, Artificial Sequence
  derived and/or modified sequence opt2 from anti-influenza_CDR
caggucugggacuucaccaucgaccacgucguc

SEQ ID NO: 22364 - RNA, 33 nt, Artificial Sequence
  derived and/or modified sequence opt2 from anti-influenza_CDR
gccaccugggacggcucccucuccgccuggguc

SEQ ID NO: 22365 - RNA, 33 nt, Artificial Sequence
  derived and/or modified sequence opt2 from anti-influenza_CDR
cgcgccucccaguccgucggcaacuaccucgcc

SEQ ID NO: 22366 - RNA, 33 nt, Artificial Sequence
  derived and/or modified sequence opt2 from anti-influenza_CDR
cagcagcgcuccaaguggccccccauguacucc

SEQ ID NO: 22367 - RNA, 33 nt, Artificial Sequence
  derived and/or modified sequence opt2 from anti-influenza_CDR
gacgucuccaccaccugguccugguucgccccc

SEQ ID NO: 22368 - RNA, 33 nt, Artificial Sequence
  derived and/or modified sequence opt2 from anti-influenza_CDR
cgcgccucccagaacaucaagcgcuacuucaac

SEQ ID NO: 22369 - RNA, 33 nt, Artificial Sequence
  derived and/or modified sequence opt2 from anti-influenza_CDR
cgcgccucccaguccgucggcaacucccucgcc

SEQ ID NO: 22370 - RNA, 33 nt, Artificial Sequence
  derived and/or modified sequence opt2 from anti-influenza_CDR
ggcgaguccacccucuccuacuacgccgucucc

SEQ ID NO: 22371 - RNA, 33 nt, Artificial Sequence
  derived and/or modified sequence opt2 from anti-influenza_CDR
cgcgccucccagaacaucuacaaguaccucaac

SEQ ID NO: 22372 - RNA, 33 nt, Artificial Sequence
  derived and/or modified sequence opt2 from anti-influenza_CDR
gccuccugcuccggcggcuacugcauccucgac

SEQ ID NO: 22373 - RNA, 33 nt, Artificial Sequence
  derived and/or modified sequence opt2 from anti-influenza_CDR
cgcaccucccaguccaucuccuccuaccucaac

SEQ ID NO: 22374 - RNA, 33 nt, Artificial Sequence
  derived and/or modified sequence opt2 from anti-influenza_CDR
cgcgccucccaguccaucggcgccuacgucaac

SEQ ID NO: 22375 - RNA, 33 nt, Artificial Sequence
  derived and/or modified sequence opt2 from anti-influenza_CDR
cgcgccucccaguccaucuccaccuaccucaac

SEQ ID NO: 22376 - RNA, 33 nt, Artificial Sequence
  derived and/or modified sequence opt2 from anti-influenza_CDR
cgcgccucccaguccaucgacaaguuccucaac

SEQ ID NO: 22377 - RNA, 33 nt, Artificial Sequence
  derived and/or modified sequence opt2 from anti-influenza_CDR
ggcggccacaacaucggcuccaacuccguccac

SEQ ID NO: 22378 - RNA, 33 nt, Artificial Sequence
  derived and/or modified sequence opt2 from anti-influenza_CDR
cgcgccucccaguccaucuccaccuaccuccac

SEQ ID NO: 22379 - RNA, 33 nt, Artificial Sequence
  derived and/or modified sequence opt2 from anti-influenza_CDR
cacgucggcggccacaccuacggcaucgacuac

SEQ ID NO: 22380 - RNA, 33 nt, Artificial Sequence
  derived and/or modified sequence opt2 from anti-influenza_CDR
cgcgccucccaguccaucuccaacuaccucaac

SEQ ID NO: 22381 - RNA, 33 nt, Artificial Sequence
  derived and/or modified sequence opt2 from anti-influenza_CDR
cacgacgacgccucccacggcuacuccaucucc

SEQ ID NO: 22382 - RNA, 33 nt, Artificial Sequence
  derived and/or modified sequence opt2 from anti-influenza_CDR
cgcgccucccagaccaucuccaccuaccucaac

SEQ ID NO: 22383 - RNA, 33 nt, Artificial Sequence
  derived and/or modified sequence opt2 from anti-influenza_CDR
cgcgccucccaguccaucucccgcuaccucaac

SEQ ID NO: 22384 - RNA, 33 nt, Artificial Sequence
  derived and/or modified sequence opt2 from anti-influenza_CDR
ggcaccugggacuccucccucuccgccuacguc

SEQ ID NO: 22385 - RNA, 33 nt, Artificial Sequence
  derived and/or modified sequence opt2 from anti-influenza_CDR
uccuccaacuacuacgacuccgucuacgacuac

SEQ ID NO: 22386 - RNA, 33 nt, Artificial Sequence
  derived and/or modified sequence opt2 from anti-influenza_CDR
gccgccugggacgacauccucaacguccccguc

SEQ ID NO: 22387 - RNA, 33 nt, Artificial Sequence
  derived and/or modified sequence opt2 from anti-influenza_CDR
gucgccugggacgacuccgucgacggcuacguc

SEQ ID NO: 22388 - RNA, 33 nt, Artificial Sequence
  derived and/or modified sequence opt2 from anti-influenza_CDR
ggccccaaguacuacuccgaguacauggacguc

SEQ ID NO: 22389 - RNA, 33 nt, Artificial Sequence
  derived and/or modified sequence opt2 from anti-influenza_CDR
cgcgccucccagggcaucuccuccuaccucgcc

SEQ ID NO: 22390 - RNA, 33 nt, Artificial Sequence
  derived and/or modified sequence opt2 from anti-influenza_CDR
uccuccggcuacuaccccgaguacuuccaggac

SEQ ID NO: 22391 - RNA, 33 nt, Artificial Sequence
  derived and/or modified sequence opt2 from anti-influenza_CDR
uccggccacaagcucggcgacaaguacgucucc

SEQ ID NO: 22392 - RNA, 33 nt, Artificial Sequence
  derived and/or modified sequence opt2 from anti-influenza_CDR
uccaccggcuacuaccccgccuaccuccaccac

SEQ ID NO: 22393 - RNA, 33 nt, Artificial Sequence
  derived and/or modified sequence opt2 from anti-influenza_CDR
cgcgccucccagcgcgucuccuccuaccucgcc

SEQ ID NO: 22394 - RNA, 33 nt, Artificial Sequence; identical to SEQ ID NO: 21287
  derived and/or modified sequence opt2 from anti-influenza_CDR

SEQ ID NO: 22395 - RNA, 33 nt, Artificial Sequence
  derived and/or modified sequence opt2 from anti-influenza_CDR
caggucugggacuccuccuccgaccacgccguc

SEQ ID NO: 22396 - RNA, 33 nt, Artificial Sequence
  derived and/or modified sequence opt2 from anti-influenza_CDR
gccaccugggacgacaaccucuccggccccguc

SEQ ID NO: 22397 - RNA, 33 nt, Artificial Sequence
  derived and/or modified sequence opt2 from anti-influenza_CDR
uccuccggcuacuaccccgccuaccucccccac

SEQ ID NO: 22398 - RNA, 33 nt, Artificial Sequence
  derived and/or modified sequence opt2 from anti-influenza_CDR
ggcggcaacaacaucggcuccaagggcguccac

SEQ ID NO: 22399 - RNA, 33 nt, Artificial Sequence
  derived and/or modified sequence opt2 from anti-influenza_CDR
caggucugggacuccuccuccgaccacgucguc

SEQ ID NO: 22400 - RNA, 33 nt, Artificial Sequence
  derived and/or modified sequence opt2 from anti-influenza_CDR
ggcaacuacuacuacgaguccucccucgacuac

SEQ ID NO: 22401 - RNA, 33 nt, Artificial Sequence
  derived and/or modified sequence opt2 from anti-influenza_CDR
ggcccccacuacuacuccuccuacauggacguc

SEQ ID NO: 22402 - RNA, 33 nt, Artificial Sequence
  derived and/or modified sequence opt2 from anti-influenza_CDR
cgcgccucccagggcaucuccaccuaccucgcc

SEQ ID NO: 22403 - RNA, 33 nt, Artificial Sequence
  derived and/or modified sequence opt2 from anti-influenza_CDR
ggccccaccuacuacuacuccuacauggacguc

SEQ ID NO: 22404 - RNA, 33 nt, Artificial Sequence
  derived and/or modified sequence opt2 from anti-influenza_CDR
ggcggcaacaacaucggccgcaacuccguccac

SEQ ID NO: 22405 - RNA, 33 nt, Artificial Sequence
  derived and/or modified sequence opt2 from anti-influenza_CDR
caggucuggcacuccuccuccgaccacuacguc

SEQ ID NO: 22406 - RNA, 33 nt, Artificial Sequence
  derived and/or modified sequence opt2 from anti-influenza_CDR
uccuccggcuacuacccccaguacuuccaggac

SEQ ID NO: 22407 - RNA, 33 nt, Artificial Sequence
  derived and/or modified sequence opt2 from anti-influenza_CDR
cgcgccucccaguccgucucccgcuaccucgcc

SEQ ID NO: 22408 - RNA, 33 nt, Artificial Sequence
  derived and/or modified sequence opt2 from anti-influenza_CDR
uggggccagggcaccacccucaccgucuccucc

SEQ ID NO: 22409 - RNA, 33 nt, Artificial Sequence
  derived and/or modified sequence opt2 from anti-influenza_CDR
cgcgccucccaguccgucgacuccaaccucgcc

SEQ ID NO: 22410 - RNA, 33 nt, Artificial Sequence
  derived and/or modified sequence opt2 from anti-influenza_CDR
cgcgccucccaguccgucucccacaaccucgcc

SEQ ID NO: 22411 - RNA, 33 nt, Artificial Sequence
  derived and/or modified sequence opt2 from anti-influenza_CDR
cgcgccucccaguccgucuccuccaaccucgcc

SEQ ID NO: 22412 - RNA, 33 nt, Artificial Sequence
  derived and/or modified sequence opt2 from anti-influenza_CDR
cgcgccucccaguccgucgaccacaaccucgcc

SEQ ID NO: 22413 - RNA, 33 nt, Artificial Sequence
  derived and/or modified sequence opt2 from anti-influenza_CDR
cagcacuacaccaacuggcccccccgccucacc

SEQ ID NO: 22414 - RNA, 33 nt, Artificial Sequence
  derived and/or modified sequence opt2 from anti-influenza_CDR
cagcacuacaccaacuaccccccccgccucacc

SEQ ID NO: 22415 - RNA, 33 nt, Artificial Sequence
  derived and/or modified sequence opt2 from anti-influenza_CDR
cagcacuacaccaacuuccccccccgccucacc

SEQ ID NO: 22416 - RNA, 33 nt, Artificial Sequence
  derived and/or modified sequence opt2 from anti-influenza_CDR
cgcgccucccaggucaucucccacaaccucgcc

SEQ ID NO: 22417 - RNA, 33 nt, Artificial Sequence
  derived and/or modified sequence opt2 from anti-influenza_CDR
cagcacuacuccaacuggcccccccgccucacc

SEQ ID NO: 22418 - RNA, 33 nt, Artificial Sequence
  derived and/or modified sequence opt2 from anti-influenza_CDR
cagcacuacuccaacuuccccccccgccucacc

SEQ ID NO: 22419 - RNA, 33 nt, Artificial Sequence
  derived and/or modified sequence opt2 from anti-influenza_CDR
cagcacuacuccaacuaccccccccgccucacc

SEQ ID NO: 22420 - RNA, 33 nt, Artificial Sequence
  derived and/or modified sequence opt2 from anti-influenza_CDR
cgcgccucccaguccgucgccaacaaccucgcc

SEQ ID NO: 22421 - RNA, 33 nt, Artificial Sequence
  derived and/or modified sequence opt2 from anti-influenza_CDR
cagcaguacaacaacuggccccccauguacacc

SEQ ID NO: 22422 - RNA, 33 nt, Artificial Sequence
  derived and/or modified sequence opt2 from anti-influenza_CDR
cgcgccucccaguccaucggcaacuggcucgcc

SEQ ID NO: 22423 - RNA, 33 nt, Artificial Sequence
  derived and/or modified sequence opt2 from anti-influenza_CDR
cagcgcuacaccuccaacucccagggcuucacc

SEQ ID NO: 22424 - RNA, 33 nt, Artificial Sequence
  derived and/or modified sequence opt2 from anti-influenza_CDR
gccgccugggacgacacccucaacggccccguc

SEQ ID NO: 22425 - RNA, 33 nt, Artificial Sequence
  derived and/or modified sequence opt2 from anti-influenza_CDR
aaggccucccagaacgucggcuccaacgucgcc

SEQ ID NO: 22426 - RNA, 33 nt, Artificial Sequence
  derived and/or modified sequence opt2 from anti-influenza_CDR
caggucugggacauguccuccgaccgccgcguc

SEQ ID NO: 22427 - RNA, 33 nt, Artificial Sequence
  derived and/or modified sequence opt2 from anti-influenza_CDR
cagucccuccuccacuccaacggcuacaacuac

SEQ ID NO: 22428 - RNA, 33 nt, Artificial Sequence
  derived and/or modified sequence opt2 from anti-influenza_CDR
accuaccucgucggcgccgucggcuuccagcac

SEQ ID NO: 22429 - RNA, 33 nt, Artificial Sequence; identical to SEQ ID NO: 21340
  derived and/or modified sequence opt2 from anti-influenza_CDR

SEQ ID NO: 22430 - RNA, 33 nt, Artificial Sequence
  derived and/or modified sequence opt2 from anti-influenza_CDR
cagucccuccucgacuccaacggcuacaacuac

SEQ ID NO: 22431 - RNA, 33 nt, Artificial Sequence
  derived and/or modified sequence opt2 from anti-influenza_CDR
augcaggcccuccagaccccccccauguacacc

SEQ ID NO: 22432 - RNA, 33 nt, Artificial Sequence
  derived and/or modified sequence opt2 from anti-influenza_CDR
cagucccuccuccacuccaacggcuacaaccac

SEQ ID NO: 22433 - RNA, 33 nt, Artificial Sequence
  derived and/or modified sequence opt2 from anti-influenza_CDR
caggucugggacaucaccuccgaccucgucguc

SEQ ID NO: 22434 - RNA, 33 nt, Artificial Sequence
  derived and/or modified sequence opt2 from anti-influenza_CDR
cgcgccucccaggacaucuccaccuggcucgcc

SEQ ID NO: 22435 - RNA, 33 nt, Artificial Sequence
  derived and/or modified sequence opt2 from anti-influenza_CDR
cgcgccucccgcuccaucaccaccuuccucgcc

SEQ ID NO: 22436 - RNA, 33 nt, Artificial Sequence
  derived and/or modified sequence opt2 from anti-influenza_CDR
ggcuggggcgccgucaccucccccuucgacuuc

SEQ ID NO: 22437 - RNA, 33 nt, Artificial Sequence
  derived and/or modified sequence opt2 from anti-influenza_CDR
cgcgccucccaguccgucuccuccuccuaccuc

SEQ ID NO: 22438 - RNA, 36 nt, Artificial Sequence
  derived and/or modified sequence opt2 from anti-influenza_CDR
caguccguccucuacuccuccaacaacaagaacuac

SEQ ID NO: 22439 - RNA, 36 nt, Artificial Sequence
  derived and/or modified sequence opt2 from anti-influenza_CDR
gccgccugggacgacucccucuccggcuccuggguc

SEQ ID NO: 22440 - RNA, 36 nt, Artificial Sequence
  derived and/or modified sequence opt2 from anti-influenza_CDR
gucuucuacuccgccgaccgcaccuccuacgccgac

SEQ ID NO: 22441 - RNA, 36 nt, Artificial Sequence
  derived and/or modified sequence opt2 from anti-influenza_CDR
cgcgucggccaguccgucuccggcucccaccucgcc

SEQ ID NO: 22442 - RNA, 36 nt, Artificial Sequence
  derived and/or modified sequence opt2 from anti-influenza_CDR
acccucuccuccgccuacuccaacuacaaggucgac

SEQ ID NO: 22443 - RNA, 36 nt, Artificial Sequence
  derived and/or modified sequence opt2 from anti-influenza_CDR
gucggcaccggcggcaucgucggcuccaagggcgac

SEQ ID NO: 22444 - RNA, 36 nt, Artificial Sequence
  derived and/or modified sequence opt2 from anti-influenza_CDR
cgcuacucccgcuccucccccggcaccuucgagucc

SEQ ID NO: 22445 - RNA, 36 nt, Artificial Sequence
  derived and/or modified sequence opt2 from anti-influenza_CDR
caguccuacgacuccucccucuccggcuuccacguc

SEQ ID NO: 22446 - RNA, 36 nt, Artificial Sequence
  derived and/or modified sequence opt2 from anti-influenza_CDR
cgcgccucccaguccgucuccuccucccagcucgcc

SEQ ID NO: 22447 - RNA, 36 nt, Artificial Sequence
  derived and/or modified sequence opt2 from anti-influenza_CDR
cgcgccucccaguucgucuccacccgcucccucgcc

SEQ ID NO: 22448 - RNA, 36 nt, Artificial Sequence
  derived and/or modified sequence opt2 from anti-influenza_CDR
gccaccugggacgacucccucaacggcuucuacguc

SEQ ID NO: 22449 - RNA, 36 nt, Artificial Sequence
  derived and/or modified sequence opt2 from anti-influenza_CDR
cgcgccucccacuucgucaacuaccgcucccucgcc

SEQ ID NO: 22450 - RNA, 36 nt, Artificial Sequence
  derived and/or modified sequence opt2 from anti-influenza_CDR
cgcgccucccacuucgucaucggccgcgccgucgcc

SEQ ID NO: 22451 - RNA, 36 nt, Artificial Sequence
  derived and/or modified sequence opt2 from anti-influenza_CDR
cgcaucuaccacggcggcaacuccggcuucgacuuc

SEQ ID NO: 22452 - RNA, 36 nt, Artificial Sequence
  derived and/or modified sequence opt2 from anti-influenza_CDR
acccucuccuccggcuucgacaacuaccaggucgcc

SEQ ID NO: 22453 - RNA, 36 nt, Artificial Sequence
  derived and/or modified sequence opt2 from anti-influenza_CDR
gucggcaacggcggcaacgucgccuccaagggcgac

SEQ ID NO: 22454 - RNA, 36 nt, Artificial Sequence
  derived and/or modified sequence opt2 from anti-influenza_CDR
guccgcggcggcuccaccgucgccuacuucggcguc

SEQ ID NO: 22455 - RNA, 36 nt, Artificial Sequence
  derived and/or modified sequence opt2 from anti-influenza_CDR
ugccucucccgcaugcgcggcuacggccucgacguc

SEQ ID NO: 22456 - RNA, 36 nt, Artificial Sequence
  derived and/or modified sequence opt2 from anti-influenza_CDR
gucggccagauggacaaguacuacgccauggacguc

SEQ ID NO: 22457 - RNA, 36 nt, Artificial Sequence
  derived and/or modified sequence opt2 from anti-influenza_CDR
ggcgucaccaacaaggucaacuccaucaucgacaag

SEQ ID NO: 22458 - RNA, 36 nt, Artificial Sequence
  derived and/or modified sequence opt2 from anti-influenza_CDR
ggcgucaccaacaaggucaaccgcaucaucgacaag

SEQ ID NO: 22459 - RNA, 36 nt, Artificial Sequence
  derived and/or modified sequence opt2 from anti-influenza_CDR
ggcgucaccaacaaggagaacuccaucaucgacaag

SEQ ID NO: 22460 - RNA, 36 nt, Artificial Sequence
  derived and/or modified sequence opt2 from anti-influenza_CDR
ccccucggcauccuccacuacuacgccauggaccuc

SEQ ID NO: 22461 - RNA, 36 nt, Artificial Sequence
  derived and/or modified sequence opt2 from anti-influenza_CDR
aagaucaccuccaaggucaacaacaucgucgacaag

SEQ ID NO: 22462 - RNA, 36 nt, Artificial Sequence
  derived and/or modified sequence opt2 from anti-influenza_CDR
ggcaucaccaacaaggucaacuccaucaucgacaag

SEQ ID NO: 22463 - RNA, 36 nt, Artificial Sequence
  derived and/or modified sequence opt2 from anti-influenza_CDR
aacggccgcuccuccaccuccuggggcaucgacguc

SEQ ID NO: 22464 - RNA, 36 nt, Artificial Sequence
  derived and/or modified sequence opt2 from anti-influenza_CDR
ggcaucaccaacaaggagaacuccgucaucgagaag

SEQ ID NO: 22465 - RNA, 36 nt, Artificial Sequence
  derived and/or modified sequence opt2 from anti-influenza_CDR
ccccucggcucccgcuacuacuacggcauggacguc

SEQ ID NO: 22466 - RNA, 36 nt, Artificial Sequence
  derived and/or modified sequence opt2 from anti-influenza_CDR
ggcaucaccaacaaggucaacuccgucaucgagaag

SEQ ID NO: 22467 - RNA, 36 nt, Artificial Sequence
  derived and/or modified sequence opt2 from anti-influenza_CDR
ggcgucaccaacaaggucaacuccaucaucaacaag

SEQ ID NO: 22468 - RNA, 36 nt, Artificial Sequence
  derived and/or modified sequence opt2 from anti-influenza_CDR
cacaugggcuaccagguccgcgagaccauggacguc

SEQ ID NO: 22469 - RNA, 36 nt, Artificial Sequence
  derived and/or modified sequence opt2 from anti-influenza_CDR
gccaccugggaccgccgccccaccgccuacgucguc

SEQ ID NO: 22470 - RNA, 36 nt, Artificial Sequence
  derived and/or modified sequence opt2 from anti-influenza_CDR
gagggcaaguggggcccccaggccgccuucgacauc

SEQ ID NO: 22471 - RNA, 36 nt, Artificial Sequence
  derived and/or modified sequence opt2 from anti-influenza_CDR
ggcgacaagggcaucuacuacuacuacauggacguc

SEQ ID NO: 22472 - RNA, 36 nt, Artificial Sequence
  derived and/or modified sequence opt2 from anti-influenza_CDR
ggcuccggcuaccacaucuccacccccuucgacaac

SEQ ID NO: 22473 - RNA, 36 nt, Artificial Sequence
  derived and/or modified sequence opt2 from anti-influenza_CDR
cgcgccucccaguccgucuccuccuccuaccucgcc

SEQ ID NO: 22474 - RNA, 36 nt, Artificial Sequence
  derived and/or modified sequence opt2 from anti-influenza_CDR
ggcuccggcuacaccacccgcaacuacuucgacuac

SEQ ID NO: 22475 - RNA, 36 nt, Artificial Sequence
  derived and/or modified sequence opt2 from anti-influenza_CDR
cgcgccucccaguccgucuccuccaacuaccucggc

SEQ ID NO: 22476 - RNA, 36 nt, Artificial Sequence
  derived and/or modified sequence opt2 from anti-influenza_CDR
ggcuccaccuacgacuucuccuccggccucgacuac

SEQ ID NO: 22477 - RNA, 36 nt, Artificial Sequence
  derived and/or modified sequence opt2 from anti-influenza_CDR
ggcguccaccaccccggcaccgacaacgaccagauc

SEQ ID NO: 22478 - RNA, 36 nt, Artificial Sequence
  derived and/or modified sequence opt2 from anti-influenza_CDR
ggcguccaccaccccuccaccgacuccgaccagacc

SEQ ID NO: 22479 - RNA, 36 nt, Artificial Sequence
  derived and/or modified sequence opt2 from anti-influenza_CDR
ggcguccaccaccccuccaacgagaccgagcagcgc

SEQ ID NO: 22480 - RNA, 36 nt, Artificial Sequence
  derived and/or modified sequence opt2 from anti-influenza_CDR
caguccaucaccuucgacuacaagaacuaccucgcc

SEQ ID NO: 22481 - RNA, 36 nt, Artificial Sequence
  derived and/or modified sequence opt2 from anti-influenza_CDR
ggcggccucaucggcaccggcuccuacuacuggggc

SEQ ID NO: 22482 - RNA, 36 nt, Artificial Sequence
  derived and/or modified sequence opt2 from anti-influenza_CDR
gcccgcuacaacuggggcauccgcuacuucgacuuc

SEQ ID NO: 22483 - RNA, 36 nt, Artificial Sequence
  derived and/or modified sequence opt2 from anti-influenza_CDR
caguccguccucuccaacuccaagaaccucaacuac

SEQ ID NO: 22484 - RNA, 36 nt, Artificial Sequence
  derived and/or modified sequence opt2 from anti-influenza_CDR
ugccaggucugggagaccuccgaggaccucuggguc

SEQ ID NO: 22485 - RNA, 39 nt, Artificial Sequence
  derived and/or modified sequence opt2 from anti-influenza_CDR
gcccgcggcggccgcuacuacgucgacuacuucgacuac

SEQ ID NO: 22486 - RNA, 39 nt, Artificial Sequence
  derived and/or modified sequence opt2 from anti-influenza_CDR
gcccgcuccggcgacggcuacaacuacuacuucccccuc

SEQ ID NO: 22487 - RNA, 39 nt, Artificial Sequence
  derived and/or modified sequence opt2 from anti-influenza_CDR
gcccgcggcugcggcuacaacugcuacuacuucgacggc

SEQ ID NO: 22488 - RNA, 39 nt, Artificial Sequence
  derived and/or modified sequence opt2 from anti-influenza_CDR
uccggcuccuccuccaacaucggcuccaacaccgucaac

SEQ ID NO: 22489 - RNA, 39 nt, Artificial Sequence
  derived and/or modified sequence opt2 from anti-influenza_CDR
gacucccccuacuccuccuccugguccuucuucgacuac

SEQ ID NO: 22490 - RNA, 39 nt, Artificial Sequence
  derived and/or modified sequence opt2 from anti-influenza_CDR
uccggcuccgacuccaacaucggcgacuacuucgucugc

SEQ ID NO: 22491 - RNA, 39 nt, Artificial Sequence
  derived and/or modified sequence opt2 from anti-influenza_CDR
gcccgcauggucgucgucaccggcgacggcuucgacguc

SEQ ID NO: 22492 - RNA, 39 nt, Artificial Sequence
  derived and/or modified sequence opt2 from anti-influenza_CDR
uggcucuccaucaucaacgccggcggcggcgacaucgac

SEQ ID NO: 22493 - RNA, 39 nt, Artificial Sequence
  derived and/or modified sequence opt2 from anti-influenza_CDR
gccgccuccucccuccaguccggcguccccucccgcuuc

SEQ ID NO: 22494 - RNA, 39 nt, Artificial Sequence
  derived and/or modified sequence opt2 from anti-influenza_CDR
cacgacgccaaguucuccggcuccuacuacgucgccucc

SEQ ID NO: 22495 - RNA, 39 nt, Artificial Sequence
  derived and/or modified sequence opt2 from anti-influenza_CDR
cacgacgucaaguucuccggcuccuacuacgucgccucc

SEQ ID NO: 22496 - RNA, 39 nt, Artificial Sequence
  derived and/or modified sequence opt2 from anti-influenza_CDR
accggcuccgaguccaccaccggcuacggcauggacguc

SEQ ID NO: 22497 - RNA, 39 nt, Artificial Sequence
  derived and/or modified sequence opt2 from anti-influenza_CDR
gccgccuccaccuccguccucggcuacggcauggacguc

SEQ ID NO: 22498 - RNA, 39 nt, Artificial Sequence
  derived and/or modified sequence opt2 from anti-influenza_CDR
uccggcuccaccuucaacaucggcuccaacgccgucgac

SEQ ID NO: 22499 - RNA, 39 nt, Artificial Sequence
  derived and/or modified sequence opt2 from anti-influenza_CDR
uccggcucccgcuccaacgucggcgacaacuccgucuac

SEQ ID NO: 22500 - RNA, 39 nt, Artificial Sequence
  derived and/or modified sequence opt2 from anti-influenza_CDR
uccggcuccuccuccaacaucggcaacgacuacgucucc

SEQ ID NO: 22501 - RNA, 39 nt, Artificial Sequence
  derived and/or modified sequence opt2 from anti-influenza_CDR
ggcggcggcuccuacggcgccuacgagggcuucgacuac

SEQ ID NO: 22502 - RNA, 39 nt, Artificial Sequence
  derived and/or modified sequence opt2 from anti-influenza_CDR
uccggcuccuccuccaacaucggcuccaacuacgucuac

SEQ ID NO: 22503 - RNA, 39 nt, Artificial Sequence
  derived and/or modified sequence opt2 from anti-influenza_CDR
gcccgccgccagcagcucuacaagggcuacuaccaccac

SEQ ID NO: 22504 - RNA, 39 nt, Artificial Sequence
  derived and/or modified sequence opt2 from anti-influenza_CDR
uccggcuccaccuccaacaucggcuacaaccccgucucc

SEQ ID NO: 22505 - RNA, 39 nt, Artificial Sequence
  derived and/or modified sequence opt2 from anti-influenza_CDR
gcccgcggcaugaacuacuacuccgacuacuucgacuac

SEQ ID NO: 22506 - RNA, 39 nt, Artificial Sequence
  derived and/or modified sequence opt2 from anti-influenza_CDR
gcccgcggccacuccggcuccuaccgccucuucgacuuc

SEQ ID NO: 22507 - RNA, 39 nt, Artificial Sequence
  derived and/or modified sequence opt2 from anti-influenza_CDR
gccaagccccuccgcggcuccuaccgcuacuucgaccuc

SEQ ID NO: 22508 - RNA, 39 nt, Artificial Sequence
  derived and/or modified sequence opt2 from anti-influenza_CDR
cccaucugggucaagaccccccucaagcucgccaacggc

SEQ ID NO: 22509 - RNA, 39 nt, Artificial Sequence
  derived and/or modified sequence opt2 from anti-influenza_CDR
caggccucccaguccgucuacaacaagaacaaccucgcc

SEQ ID NO: 22510 - RNA, 39 nt, Artificial Sequence
  derived and/or modified sequence opt2 from anti-influenza_CDR
caguccuccgaguccgucuacaagaacaacaaccucgcc

SEQ ID NO: 22511 - RNA, 39 nt, Artificial Sequence
  derived and/or modified sequence opt2 from anti-influenza_CDR
caguccucccaguccgucgacuccaacaaccagcucucc

SEQ ID NO: 22512 - RNA, 39 nt, Artificial Sequence
  derived and/or modified sequence opt2 from anti-influenza_CDR
caguccucccaguccgucgacaacaacaaggaccucgcc

SEQ ID NO: 22513 - RNA, 39 nt, Artificial Sequence
  derived and/or modified sequence opt2 from anti-influenza_CDR
caguccucccaguccgucuacaacaacaaccgccucucc

SEQ ID NO: 22514 - RNA, 39 nt, Artificial Sequence
  derived and/or modified sequence opt2 from anti-influenza_CDR
caguccucccaguccgucuacaagaacaacaaccucgcc

SEQ ID NO: 22515 - RNA, 39 nt, Artificial Sequence
  derived and/or modified sequence opt2 from anti-influenza_CDR
ggcggcggcuucggcuggucccagaccuacuucggcuac

SEQ ID NO: 22516 - RNA, 42 nt, Artificial Sequence
  derived and/or modified sequence opt2 from anti-influenza_CDR
uggcucggccgcaccuacuaccgcuccaagugguacaacgac

SEQ ID NO: 22517 - RNA, 42 nt, Artificial Sequence
  derived and/or modified sequence opt2 from anti-influenza_CDR
ggcggccucgucggcggcuacgacgaguacuucuucgacuac

SEQ ID NO: 22518 - RNA, 42 nt, Artificial Sequence
  derived and/or modified sequence opt2 from anti-influenza_CDR
caccccaaguacuucuacggcuccggcuccuaccccgacuuc

SEQ ID NO: 22519 - RNA, 42 nt, Artificial Sequence
  derived and/or modified sequence opt2 from anti-influenza_CDR
accggcuccuccuccgacgucggcgccuccaacuccgucucc

SEQ ID NO: 22520 - RNA, 42 nt, Artificial Sequence
  derived and/or modified sequence opt2 from anti-influenza_CDR
ggcgccuacuacgacuccuccggcuaccccgccuucuacauc

SEQ ID NO: 22521 - RNA, 42 nt, Artificial Sequence
  derived and/or modified sequence opt2 from anti-influenza_CDR
accggcuccuccuccaacaucggcuccgacuacgacguccac

SEQ ID NO: 22522 - RNA, 42 nt, Artificial Sequence
  derived and/or modified sequence opt2 from anti-influenza_CDR
gaguucgagaccuccggcuacuuccacggcuccuucgacuac

SEQ ID NO: 22523 - RNA, 42 nt, Artificial Sequence
  derived and/or modified sequence opt2 from anti-influenza_CDR
gccuccuccaccggcgccgucaccuccuccuacuuccccaac

SEQ ID NO: 22524 - RNA, 42 nt, Artificial Sequence
  derived and/or modified sequence opt2 from anti-influenza_CDR
accggcggcuccuccgacaucggcgccuccaacuccgucucc

SEQ ID NO: 22525 - RNA, 42 nt, Artificial Sequence
  derived and/or modified sequence opt2 from anti-influenza_CDR
accggcuccuccuccgacgucggcggcuacgacuacgucucc

SEQ ID NO: 22526 - RNA, 42 nt, Artificial Sequence
  derived and/or modified sequence opt2 from anti-influenza_CDR
ggcuccuccaccggcgccgucacccgcggccacuaccccuac

SEQ ID NO: 22527 - RNA, 42 nt, Artificial Sequence
  derived and/or modified sequence opt2 from anti-influenza_CDR
ggcuccuccaccggccccgucaccuccggccacuaccccuac

SEQ ID NO: 22528 - RNA, 42 nt, Artificial Sequence
  derived and/or modified sequence opt2 from anti-influenza_CDR
cacuacggcgacuccgaggccaucaacgacgccuucgacauc

SEQ ID NO: 22529 - RNA, 42 nt, Artificial Sequence
  derived and/or modified sequence opt2 from anti-influenza_CDR
accggcuccuccuccaacaucggcgccggcuacgacguccac

SEQ ID NO: 22530 - RNA, 42 nt, Artificial Sequence
  derived and/or modified sequence opt2 from anti-influenza_CDR
aucccccacuacaacuucggcuccggcuccuacuucgacuac

SEQ ID NO: 22531 - RNA, 42 nt, Artificial Sequence
  derived and/or modified sequence opt2 from anti-influenza_CDR
accggcaccuccuccgacgucggcggcuacaacuacgucucc

SEQ ID NO: 22532 - RNA, 42 nt, Artificial Sequence
  derived and/or modified sequence opt2 from anti-influenza_CDR
accggcaccuccuccgacgucggcgccuacaacuacgucucc

SEQ ID NO: 22533 - RNA, 42 nt, Artificial Sequence
  derived and/or modified sequence opt2 from anti-influenza_CDR
gccgagcgccccaagguccgcggccaggccggccgcaugaac

SEQ ID NO: 22534 - RNA, 42 nt, Artificial Sequence
  derived and/or modified sequence opt2 from anti-influenza_CDR
ggcucccgccccuggguccgcggcgucuccucccgcaucucc

SEQ ID NO: 22535 - RNA, 42 nt, Artificial Sequence
  derived and/or modified sequence opt2 from anti-influenza_CDR
aucuggggcgucgccgcccccggcaccgccgccgcccagauc

SEQ ID NO: 22536 - RNA, 42 nt, Artificial Sequence
  derived and/or modified sequence opt2 from anti-influenza_CDR
uggguccgccagccccccggcaagggccucgagugggucgcc

SEQ ID NO: 22537 - RNA, 42 nt, Artificial Sequence
  derived and/or modified sequence opt2 from anti-influenza_CDR
gcccgcggccccgagggcgucuggggccgcuccaucgacucc

SEQ ID NO: 22538 - RNA, 42 nt, Artificial Sequence
  derived and/or modified sequence opt2 from anti-influenza_CDR
gcccgcgaccccgacacccccuucguccgcgccuucgacucc

SEQ ID NO: 22539 - RNA, 42 nt, Artificial Sequence
  derived and/or modified sequence opt2 from anti-influenza_CDR
accggcuccaccuccgacaucggcuccuacaacuacgucucc

SEQ ID NO: 22540 - RNA, 42 nt, Artificial Sequence
  derived and/or modified sequence opt2 from anti-influenza_CDR
ugggacuggaacuucgaccucuaccucggcugguucgacccc

SEQ ID NO: 22541 - RNA, 42 nt, Artificial Sequence
  derived and/or modified sequence opt2 from anti-influenza_CDR
ugggccuggaacuucgacuucuuccucggcugguucgacccc

SEQ ID NO: 22542 - RNA, 42 nt, Artificial Sequence
  derived and/or modified sequence opt2 from anti-influenza_CDR
ggccccggcuacuccggcuaccacuacggcugguucgacacc

SEQ ID NO: 22543 - RNA, 42 nt, Artificial Sequence
  derived and/or modified sequence opt2 from anti-influenza_CDR
gcccgcugggacuacggcgucuacgagggcuacaucgacuac

SEQ ID NO: 22544 - RNA, 45 nt, Artificial Sequence
  derived and/or modified sequence opt2 from anti-influenza_CDR
gcccgcgccggcaccacccucacccgcuucaacugguucgacccc

SEQ ID NO: 22545 - RNA, 45 nt, Artificial Sequence
  derived and/or modified sequence opt2 from anti-influenza_CDR
gcccgcgccggcaccaccgucacccgcuucaacugguucgacccc

SEQ ID NO: 22546 - RNA, 45 nt, Artificial Sequence
  derived and/or modified sequence opt2 from anti-influenza_CDR
gcccgcggccagcgcuacuacuacgaccgcgacggcauggacguc

SEQ ID NO: 22547 - RNA, 45 nt, Artificial Sequence
  derived and/or modified sequence opt2 from anti-influenza_CDR
gcccgcuccggcggcuaccucccccagaacaacuggaucgacccc

SEQ ID NO: 22548 - RNA, 45 nt, Artificial Sequence
  derived and/or modified sequence opt2 from anti-influenza_CDR
auggagaacgagcgcacccucgacuuccacgacuccaacgucaag

SEQ ID NO: 22549 - RNA, 45 nt, Artificial Sequence
  derived and/or modified sequence opt2 from anti-influenza_CDR
ggcgccgaccacggcuccggcuccaacuucgucucccccuacguc

SEQ ID NO: 22550 - RNA, 45 nt, Artificial Sequence
  derived and/or modified sequence opt2 from anti-influenza_CDR
gacacccgcuccucccucgacaacuaccaguacggcauggacguc

SEQ ID NO: 22551 - RNA, 45 nt, Artificial Sequence
  derived and/or modified sequence opt2 from anti-influenza_CDR
gaggacuacgacauccucaccggcgccggccccggcauggagguc

SEQ ID NO: 22552 - RNA, 45 nt, Artificial Sequence
  derived and/or modified sequence opt2 from anti-influenza_CDR
caccccuacgacguccucaccggcuccggcgacugguucgacccc

SEQ ID NO: 22553 - RNA, 45 nt, Artificial Sequence
  derived and/or modified sequence opt2 from anti-influenza_CDR
ggcgccgaccacggcuccggcaacaacuucgucucccccuacguc

SEQ ID NO: 22554 - RNA, 45 nt, Artificial Sequence
  derived and/or modified sequence opt2 from anti-influenza_CDR
gucaucuacuccggcggcuccaccuacuacgccgacuccgucaag

SEQ ID NO: 22555 - RNA, 45 nt, Artificial Sequence
  derived and/or modified sequence opt2 from anti-influenza_CDR
ugguaccagcagaagcccggcaaggcccccaagcuccucaucuac

SEQ ID NO: 22556 - RNA, 45 nt, Artificial Sequence
  derived and/or modified sequence opt2 from anti-influenza_CDR
gaccccuacaacgacggcaccaaguacaacgagaaguucgagggc

SEQ ID NO: 22557 - RNA, 45 nt, Artificial Sequence
  derived and/or modified sequence opt2 from anti-influenza_CDR
gcccgcgcccacaccgcccucacccgcuuccgcuggcucgacccc

SEQ ID NO: 22558 - RNA, 45 nt, Artificial Sequence
  derived and/or modified sequence opt2 from anti-influenza_CDR
gccucccucgacuacgacuucuccuacuacuaccaccgcgacguc

SEQ ID NO: 22559 - RNA, 45 nt, Artificial Sequence
  derived and/or modified sequence opt2 from anti-influenza_CDR
gcccgcgucgccacccccuacuacuacgaguccggcuucgacuac

SEQ ID NO: 22560 - RNA, 45 nt, Artificial Sequence
  derived and/or modified sequence opt2 from anti-influenza_CDR
gcccgccgcggcggcggcuggcaguacuacuacggcauggacguc

SEQ ID NO: 22561 - RNA, 48 nt, Artificial Sequence
  derived and/or modified sequence opt2 from anti-influenza_CDR
uccggccacaucaccgucuucggcgucaacgucgacgccuucgacaug

SEQ ID NO: 22562 - RNA, 48 nt, Artificial Sequence
  derived and/or modified sequence opt2 from anti-influenza_CDR
ggcggccacaucaccgucuucggccucaacaucgacgccuacgacauc

SEQ ID NO: 22563 - RNA, 48 nt, Artificial Sequence
  derived and/or modified sequence opt2 from anti-influenza_CDR
ggcggccacaucaccgaguucggccucaacaucgacgccuacgacauc

SEQ ID NO: 22564 - RNA, 48 nt, Artificial Sequence
  derived and/or modified sequence opt2 from anti-influenza_CDR
ggcggccacaucaccgucuucggcgucaacaucgacgccuucgacauc

SEQ ID NO: 22565 - RNA, 48 nt, Artificial Sequence
  derived and/or modified sequence opt2 from anti-influenza_CDR
ggcggccacaucaccgucuucggcgucaacaucgacgccuucgacguc

SEQ ID NO: 22566 - RNA, 48 nt, Artificial Sequence
  derived and/or modified sequence opt2 from anti-influenza_CDR
gcccgcgacggcuggggccagcagcucguccccuacuacuucgacuac

SEQ ID NO: 22567 - RNA, 48 nt, Artificial Sequence
  derived and/or modified sequence opt2 from anti-influenza_CDR
gacuucugggucuccuacuacuacgacuccuccgccccccccgccauc

SEQ ID NO: 22568 - RNA, 48 nt, Artificial Sequence
  derived and/or modified sequence opt2 from anti-influenza_CDR
gcccgcgccggcgucaagaucuucggccucaucgucggcgcccucgac

SEQ ID NO: 22569 - RNA, 48 nt, Artificial Sequence
  derived and/or modified sequence opt2 from anti-influenza_CDR
gcccgcgacggcgccggcuccuacuacccccucaacugguucgacccc

SEQ ID NO: 22570 - RNA, 48 nt, Artificial Sequence
  derived and/or modified sequence opt2 from anti-influenza_CDR
gucaucuacucccacggccgcgccuacuacuccgccuccgucaacggc

SEQ ID NO: 22571 - RNA, 48 nt, Artificial Sequence
  derived and/or modified sequence opt2 from anti-influenza_CDR
gacacccuccacaacggcuacaccaacuacaaccccucccuccgcggc

SEQ ID NO: 22572 - RNA, 48 nt, Artificial Sequence
  derived and/or modified sequence opt2 from anti-influenza_CDR
uacaucuccuacaacggccgccccaaguacaaccccucccucaccucc

SEQ ID NO: 22573 - RNA, 48 nt, Artificial Sequence
  derived and/or modified sequence opt2 from anti-influenza_CDR
gagacccgcuucggcgagcuccucucccccuacgacgccuucgagauc

SEQ ID NO: 22574 - RNA, 48 nt, Artificial Sequence
  derived and/or modified sequence opt2 from anti-influenza_CDR
cucaucuacugggacgacgacaagcgcuacucccccucccucaagcgc

SEQ ID NO: 22575 - RNA, 48 nt, Artificial Sequence
  derived and/or modified sequence opt2 from anti-influenza_CDR
uacaucuacuacaucggcaacaccgacuaccgccccucccucaagucc

SEQ ID NO: 22576 - RNA, 48 nt, Artificial Sequence
  derived and/or modified sequence opt2 from anti-influenza_CDR
gagaucucccacggcggcuccaccaacuacaaccccucccucaagucc

SEQ ID NO: 22577 - RNA, 48 nt, Artificial Sequence
  derived and/or modified sequence opt2 from anti-influenza_CDR
gagaucaaccacuccggccgcaccaacuacaaccccucccucaagucc

SEQ ID NO: 22578 - RNA, 48 nt, Artificial Sequence
  derived and/or modified sequence opt2 from anti-influenza_CDR
cucaucuccugggacgacgagaagcacuacucccccucccuccagucc

SEQ ID NO: 22579 - RNA, 48 nt, Artificial Sequence
  derived and/or modified sequence opt2 from anti-influenza_CDR
gagggcgucuacuucgacuccggcaccuaccgcggcuacuucgacuac

SEQ ID NO: 22580 - RNA, 48 nt, Artificial Sequence
  derived and/or modified sequence opt2 from anti-influenza_CDR
uacaucuaccacuccggcuccaccaacuacaaccccucccucaagucc

SEQ ID NO: 22581 - RNA, 48 nt, Artificial Sequence
  derived and/or modified sequence opt2 from anti-influenza_CDR
uacaucuacuaccgcggcuccaccuucuacaaccccucccucaagucc

SEQ ID NO: 22582 - RNA, 48 nt, Artificial Sequence
  derived and/or modified sequence opt2 from anti-influenza_CDR
uacaucuccuacuccggcuccaccaaguacaaccccucccuccgcucc

SEQ ID NO: 22583 - RNA, 48 nt, Artificial Sequence
  derived and/or modified sequence opt2 from anti-influenza_CDR
gagaucaagcacuccggccgcaccaacuacaaccccucccucgagucc

SEQ ID NO: 22584 - RNA, 48 nt, Artificial Sequence
  derived and/or modified sequence opt2 from anti-influenza_CDR
gagaucaaccacuccggcggcaccaacuacaaccccucccucaagcgc

SEQ ID NO: 22585 - RNA, 48 nt, Artificial Sequence
  derived and/or modified sequence opt2 from anti-influenza_CDR
uucauguacuacuccgccuccaccuacuacaaccccucccucaagucc

SEQ ID NO: 22586 - RNA, 48 nt, Artificial Sequence
  derived and/or modified sequence opt2 from anti-influenza_CDR
uacgucuacuacuccggcuccaccaccuacaaccccucccucaagucc

SEQ ID NO: 22587 - RNA, 48 nt, Artificial Sequence
  derived and/or modified sequence opt2 from anti-influenza_CDR
aacaucuacuacaccggcaucaccuucuacaaccccucccucuccucc

SEQ ID NO: 22588 - RNA, 48 nt, Artificial Sequence
  derived and/or modified sequence opt2 from anti-influenza_CDR
uucaucuacuacggcggcaacaccaaguacaaccccucccucaagucc

SEQ ID NO: 22589 - RNA, 48 nt, Artificial Sequence
  derived and/or modified sequence opt2 from anti-influenza_CDR
uucauguuccacuccggcuccccccgcuacaaccccacccucaagucc

SEQ ID NO: 22590 - RNA, 48 nt, Artificial Sequence
  derived and/or modified sequence opt2 from anti-influenza_CDR
uucuucuacaacggcggcuccaccaaguacaaccccucccucaagucc

SEQ ID NO: 22591 - RNA, 48 nt, Artificial Sequence
  derived and/or modified sequence opt2 from anti-influenza_CDR
cacaucuacgacuacggccgcaccuucuacaacuccucccuccagucc

SEQ ID NO: 22592 - RNA, 48 nt, Artificial Sequence
  derived and/or modified sequence opt2 from anti-influenza_CDR
gucuucuacuccgagacccgcaccuacuacgccgacuccgucaagggc

SEQ ID NO: 22593 - RNA, 48 nt, Artificial Sequence
  derived and/or modified sequence opt2 from anti-influenza_CDR
uacgucuacaaccgcggcuccaccaaguacucccccucccucaagucc

SEQ ID NO: 22594 - RNA, 48 nt, Artificial Sequence
  derived and/or modified sequence opt2 from anti-influenza_CDR
uacaucuacaaccgcggcuccaccaaguacacccccucccucaagucc

SEQ ID NO: 22595 - RNA, 48 nt, Artificial Sequence
  derived and/or modified sequence opt2 from anti-influenza_CDR
uaccucuacuacuccggcuccaccaaguacaaccccucccucaagucc

SEQ ID NO: 22596 - RNA, 48 nt, Artificial Sequence
  derived and/or modified sequence opt2 from anti-influenza_CDR
uacgucuacaacuccggcaacaccaaguacaaccccucccucaagucc

SEQ ID NO: 22597 - RNA, 48 nt, Artificial Sequence
  derived and/or modified sequence opt2 from anti-influenza_CDR
cacaucuucgacuccggcuccaccuacuacaaccccucccucaagucc

SEQ ID NO: 22598 - RNA, 48 nt, Artificial Sequence
  derived and/or modified sequence opt2 from anti-influenza_CDR
gucuucuacuccgccgaccgcaccuccuacgccgacuccgucaagggc

SEQ ID NO: 22599 - RNA, 48 nt, Artificial Sequence
  derived and/or modified sequence opt2 from anti-influenza_CDR
uacaucuacuacuccggcaacaccuacuacaaccccucccucaagucc

SEQ ID NO: 22600 - RNA, 48 nt, Artificial Sequence
  derived and/or modified sequence opt2 from anti-influenza_CDR
cgcuccucccagucccuccuccacuccaacggcuacaacuaccucgac

SEQ ID NO: 22601 - RNA, 48 nt, Artificial Sequence
  derived and/or modified sequence opt2 from anti-influenza_CDR
accaucuaccacuccggcuccaccuacuacaaccccucccucaagucc

SEQ ID NO: 22602 - RNA, 48 nt, Artificial Sequence
  derived and/or modified sequence opt2 from anti-influenza_CDR
cgcuccucccagucccuccuccacuccaacggccacaucuacuucgac

SEQ ID NO: 22603 - RNA, 48 nt, Artificial Sequence
  derived and/or modified sequence opt2 from anti-influenza_CDR
aucuggggcgucgccgcccccuccaccgccuccgcccagaccucccuc

SEQ ID NO: 22604 - RNA, 48 nt, Artificial Sequence
  derived and/or modified sequence opt2 from anti-influenza_CDR
cgcuccucccagucccuccucuacaccgacggcuucaccuaccucucc

SEQ ID NO: 22605 - RNA, 48 nt, Artificial Sequence
  derived and/or modified sequence opt2 from anti-influenza_CDR
gccaagccccgccucgacuaccucgacuacuuccacgccgccgacucc

SEQ ID NO: 22606 - RNA, 48 nt, Artificial Sequence
  derived and/or modified sequence opt2 from anti-influenza_CDR
gcccgcucccccggcuacuccggcuaccucuacggcugguucgacccc

SEQ ID NO: 22607 - RNA, 48 nt, Artificial Sequence
  derived and/or modified sequence opt2 from anti-influenza_CDR
gccaucgccggcuccggcuccgccgacuacgccuccugggccaagggc

SEQ ID NO: 22608 - RNA, 48 nt, Artificial Sequence
  derived and/or modified sequence opt2 from anti-influenza_CDR
gccaucgccggcuccggcuccgccgacuacgccuccugggccaagucc

SEQ ID NO: 22609 - RNA, 48 nt, Artificial Sequence
  derived and/or modified sequence opt2 from anti-influenza_CDR
gccaucggcggcggcggcuccgccgacuacgccuccugggccaagucc

SEQ ID NO: 22610 - RNA, 48 nt, Artificial Sequence
  derived and/or modified sequence opt2 from anti-influenza_CDR
cgcuccucccagucccuccuccgcuccaacggcuacaacuaccucgac

SEQ ID NO: 22611 - RNA, 48 nt, Artificial Sequence
  derived and/or modified sequence opt2 from anti-influenza_CDR
cagggcgaccacaucgccuggcuccuccgcggcaucaacuucgacuac

SEQ ID NO: 22612 - RNA, 51 nt, Artificial Sequence
  derived and/or modified sequence opt2 from anti-influenza_CDR
gcccgccucggcuccggcuccuaccacaacggccccaacugguucgacccc

SEQ ID NO: 22613 - RNA, 51 nt, Artificial Sequence
  derived and/or modified sequence opt2 from anti-influenza_CDR
gcccgcgccgagaaccuccucucccccuaccucgccgagggcuucgacccc

SEQ ID NO: 22614 - RNA, 51 nt, Artificial Sequence
  derived and/or modified sequence opt2 from anti-influenza_CDR
gucaucuccuacgacggcuccaacaaguacuacgccgacuccgucaagggc

SEQ ID NO: 22615 - RNA, 51 nt, Artificial Sequence
  derived and/or modified sequence opt2 from anti-influenza_CDR
ggcaccaucccccuccucggcaccaccaacuacgcccagaaguuccagggc

SEQ ID NO: 22616 - RNA, 51 nt, Artificial Sequence
  derived and/or modified sequence opt2 from anti-influenza_CDR
ggcaucaucgccgucuucaacaccgccaacuacgcccagaaguuccagggc

SEQ ID NO: 22617 - RNA, 51 nt, Artificial Sequence
  derived and/or modified sequence opt2 from anti-influenza_CDR
aacaucgaggacgacggcggcgacaaguacuacgucgacuccgucaagggc

SEQ ID NO: 22618 - RNA, 51 nt, Artificial Sequence
  derived and/or modified sequence opt2 from anti-influenza_CDR
uggaucaaccccaacuccggcaccaccggcuccgcccagcgcuuccagggc

SEQ ID NO: 22619 - RNA, 51 nt, Artificial Sequence
  derived and/or modified sequence opt2 from anti-influenza_CDR
ggcaucaaccccgucuucggccgcccccacuacgcccagaaguuccagggc

SEQ ID NO: 22620 - RNA, 51 nt, Artificial Sequence
  derived and/or modified sequence opt2 from anti-influenza_CDR
ggcaucaucccccucaucaacgcccccaacuacgcccccaaguuccagggc

SEQ ID NO: 22621 - RNA, 51 nt, Artificial Sequence
  derived and/or modified sequence opt2 from anti-influenza_CDR
ggcaucauccccaugaugggcaccgucaacuacgcccagaagcuccagggc

SEQ ID NO: 22622 - RNA, 51 nt, Artificial Sequence
  derived and/or modified sequence opt2 from anti-influenza_CDR
ggcaucaucccccucuucggcgccgccaaguacgcccagaaguuccagggc

SEQ ID NO: 22623 - RNA, 51 nt, Artificial Sequence
  derived and/or modified sequence opt2 from anti-influenza_CDR
aaguccucccagcgcguccucuacuccuccaacaacaagaacuaccucgcc

SEQ ID NO: 22624 - RNA, 51 nt, Artificial Sequence
  derived and/or modified sequence opt2 from anti-influenza_CDR
cucaucuccgacgacggcuccaacaaguucuacgccgacuccgucaagggc

SEQ ID NO: 22625 - RNA, 51 nt, Artificial Sequence
  derived and/or modified sequence opt2 from anti-influenza_CDR
aucaucuccuacgacggcaacgaccaguacuacaccgacuccgucaagggc

SEQ ID NO: 22626 - RNA, 51 nt, Artificial Sequence
  derived and/or modified sequence opt2 from anti-influenza_CDR
uggaucuccaccuacaacggcaacaccaacuucgcccagaacuuccagggc

SEQ ID NO: 22627 - RNA, 51 nt, Artificial Sequence
  derived and/or modified sequence opt2 from anti-influenza_CDR
gucgagggcuccuaccgcgacuucuggaacaaccagaaccgcuucgacccc

SEQ ID NO: 22628 - RNA, 51 nt, Artificial Sequence
  derived and/or modified sequence opt2 from anti-influenza_CDR
uggaucaaccccaacuccggcgacaccaacuacgcccagaaguuccagggc

SEQ ID NO: 22629 - RNA, 51 nt, Artificial Sequence
  derived and/or modified sequence opt2 from anti-influenza_CDR
aaguccucccaguccguccucuacuccuccaacaacaagucccaccucgcc

SEQ ID NO: 22630 - RNA, 51 nt, Artificial Sequence
  derived and/or modified sequence opt2 from anti-influenza_CDR
aucaucuaccccggcgacuccgacacccgcuacucccccuccuuccagggc

SEQ ID NO: 22631 - RNA, 51 nt, Artificial Sequence
  derived and/or modified sequence opt2 from anti-influenza_CDR
ggcaucauccccgucuuccccacccccaacuacgcccagauguuccagggc

SEQ ID NO: 22632 - RNA, 51 nt, Artificial Sequence
  derived and/or modified sequence opt2 from anti-influenza_CDR
ggcaucguccccgucuucggcaccgccaacuacgcccagaaguuccagggc

SEQ ID NO: 22633 - RNA, 51 nt, Artificial Sequence
  derived and/or modified sequence opt2 from anti-influenza_CDR
uggaucaaccccgaguccggcgacaccaaguacgcccagaaguuccagggc

SEQ ID NO: 22634 - RNA, 51 nt, Artificial Sequence
  derived and/or modified sequence opt2 from anti-influenza_CDR
cgcuccucccaguccaucuuccacaacuccaacaacgagaacuaccucgcc

SEQ ID NO: 22635 - RNA, 51 nt, Artificial Sequence
  derived and/or modified sequence opt2 from anti-influenza_CDR
uggaucaacgccaagcgcggcggcaccaacuacgcccagaaguuccagggc

SEQ ID NO: 22636 - RNA, 51 nt, Artificial Sequence
  derived and/or modified sequence opt2 from anti-influenza_CDR
uggaucaaccccgacuccggcgccaccuccuccgcccagaacuuccagggc

SEQ ID NO: 22637 - RNA, 51 nt, Artificial Sequence
  derived and/or modified sequence opt2 from anti-influenza_CDR
uggaucucccccgacuccgacgccaccaaguacgcccagaaguuccagggc

SEQ ID NO: 22638 - RNA, 51 nt, Artificial Sequence
  derived and/or modified sequence opt2 from anti-influenza_CDR
aacaucaagcaggacggccgcgagaaguacuacgucgacucccuccgcggc

SEQ ID NO: 22639 - RNA, 51 nt, Artificial Sequence
  derived and/or modified sequence opt2 from anti-influenza_CDR
ggcaucaucgccaucuucggcacccccaaguacgcccagaaguuccagggc

SEQ ID NO: 22640 - RNA, 51 nt, Artificial Sequence
  derived and/or modified sequence opt2 from anti-influenza_CDR
aaguccucccaguccauccucaacuccuccaacaacaagaacuaccucgcc

SEQ ID NO: 22641 - RNA, 51 nt, Artificial Sequence
  derived and/or modified sequence opt2 from anti-influenza_CDR
uggaucuccgccuacaacggcaacaccaacuacgcccagaaguuccagggc

SEQ ID NO: 22642 - RNA, 51 nt, Artificial Sequence
  derived and/or modified sequence opt2 from anti-influenza_CDR
ggcgucauccccaucuuccgcaccgccaacuacgcccagaacuuccagggc

SEQ ID NO: 22643 - RNA, 51 nt, Artificial Sequence
  derived and/or modified sequence opt2 from anti-influenza_CDR
ggcaucaucgccaucuuccacacccccaaguacgcccagaaguuccagggc

SEQ ID NO: 22644 - RNA, 51 nt, Artificial Sequence
  derived and/or modified sequence opt2 from anti-influenza_CDR
ggcaucucccccauguucggcaccaccaccuacgcccagaaguuccagggc

SEQ ID NO: 22645 - RNA, 51 nt, Artificial Sequence
  derived and/or modified sequence opt2 from anti-influenza_CDR
aaguccucccaguccguccucuacuccuccaacaacaagaacuaccucgcc

SEQ ID NO: 22646 - RNA, 51 nt, Artificial Sequence
  derived and/or modified sequence opt2 from anti-influenza_CDR
ggcaucauccccaucuucggcaccaccaaguacgcccccaaguuccagggc

SEQ ID NO: 22647 - RNA, 51 nt, Artificial Sequence
  derived and/or modified sequence opt2 from anti-influenza_CDR
ggcaucuccccccucuucggcaccaccaacuacgcccagaaguuccagggc

SEQ ID NO: 22648 - RNA, 51 nt, Artificial Sequence
  derived and/or modified sequence opt2 from anti-influenza_CDR
ggcaucaugggcauguucggcaccaccaacuacgcccagaaguuccagggc

SEQ ID NO: 22649 - RNA, 51 nt, Artificial Sequence
  derived and/or modified sequence opt2 from anti-influenza_CDR
ggcaucaucggcauguucggcuccaccaacuacgcccagaacuuccagggc

SEQ ID NO: 22650 - RNA, 51 nt, Artificial Sequence
  derived and/or modified sequence opt2 from anti-influenza_CDR
uggaucaaccccaacuccggcggcaccaacuacgcccagaaguuccagggc

SEQ ID NO: 22651 - RNA, 51 nt, Artificial Sequence
  derived and/or modified sequence opt2 from anti-influenza_CDR
gccaucuccuccuccggcgacuccaccuacuacgccgacuccgucaagggc

SEQ ID NO: 22652 - RNA, 51 nt, Artificial Sequence
  derived and/or modified sequence opt2 from anti-influenza_CDR
uccaucuccuccuccuccuccuacaucuacuacgucgacuccgucaagggc

SEQ ID NO: 22653 - RNA, 51 nt, Artificial Sequence
  derived and/or modified sequence opt2 from anti-influenza_CDR
gacaucaucggcauguucggcuccaccaacuacgcccagaacuuccagggc

SEQ ID NO: 22654 - RNA, 51 nt, Artificial Sequence
  derived and/or modified sequence opt2 from anti-influenza_CDR
ggcaucauccccauguucggcaccaccaacuacgcccagaaguuccagggc

SEQ ID NO: 22655 - RNA, 51 nt, Artificial Sequence
  derived and/or modified sequence opt2 from anti-influenza_CDR
ggcaucaucgccaucuucggcaccgccaacuacgcccagaaguuccagggc

SEQ ID NO: 22656 - RNA, 51 nt, Artificial Sequence
  derived and/or modified sequence opt2 from anti-influenza_CDR
ggcaucauccccaucuucggcaccaccaacuacgcccagaaguuccagggc

SEQ ID NO: 22657 - RNA, 51 nt, Artificial Sequence
  derived and/or modified sequence opt2 from anti-influenza_CDR
ggcaucuucgcccucuucggcaccaccgacuacgcccagaaguuccagggc

SEQ ID NO: 22658 - RNA, 51 nt, Artificial Sequence
  derived and/or modified sequence opt2 from anti-influenza_CDR
ggcaucaucggcauguucggcaccgccaacuacgcccagaaguuccagggc

SEQ ID NO: 22659 - RNA, 51 nt, Artificial Sequence
  derived and/or modified sequence opt2 from anti-influenza_CDR
ggcaucaucgccgucuucggcaccaccaaguacgcccacaaguuccagggc

SEQ ID NO: 22660 - RNA, 51 nt, Artificial Sequence
  derived and/or modified sequence opt2 from anti-influenza_CDR
ggcauccucggcgucuucggcucccccuccuacgcccagaaguuccagggc

SEQ ID NO: 22661 - RNA, 51 nt, Artificial Sequence
  derived and/or modified sequence opt2 from anti-influenza_CDR
ggcaucuucggcauguucggcaccgccaacuacgcccagaaguuccagggc

SEQ ID NO: 22662 - RNA, 51 nt, Artificial Sequence
  derived and/or modified sequence opt2 from anti-influenza_CDR
uggaucuccgccuacaccggcgacaccgacuacgcccagaaguuccagggc

SEQ ID NO: 22663 - RNA, 51 nt, Artificial Sequence
  derived and/or modified sequence opt2 from anti-influenza_CDR
uccuucgaccccgaggacggcgagaccaucuacgcccagaaguuccagggc

SEQ ID NO: 22664 - RNA, 51 nt, Artificial Sequence
  derived and/or modified sequence opt2 from anti-influenza_CDR
ggcaucuccggcuccggcgaguccaccuacuacgccgacuccgucaagggc

SEQ ID NO: 22665 - RNA, 51 nt, Artificial Sequence
  derived and/or modified sequence opt2 from anti-influenza_CDR
gucgucuccuacgacggcaacuacaaguacuacgccgacuccguccagggc

SEQ ID NO: 22666 - RNA, 51 nt, Artificial Sequence
  derived and/or modified sequence opt2 from anti-influenza_CDR
ggcuccaucuccuacuccggcuccaccuacuaccaccccucccucaagucc

SEQ ID NO: 22667 - RNA, 51 nt, Artificial Sequence
  derived and/or modified sequence opt2 from anti-influenza_CDR
acccgcggccgccccaucggccgcaacugggagccccgcgacaaggacuac

SEQ ID NO: 22668 - RNA, 51 nt, Artificial Sequence
  derived and/or modified sequence opt2 from anti-influenza_CDR
gcccgcgaggccggcuaccacuccuccuucuccggcgucuacuucgacuac

SEQ ID NO: 22669 - RNA, 51 nt, Artificial Sequence
  derived and/or modified sequence opt2 from anti-influenza_CDR
cgcaucgaccccaacggcuccggcaccaccuacgcccagaaguuccagggc

SEQ ID NO: 22670 - RNA, 51 nt, Artificial Sequence
  derived and/or modified sequence opt2 from anti-influenza_CDR
cgcaucgaccccaacggcgccggcaccaccuacgcccagaaguuccagggc

SEQ ID NO: 22671 - RNA, 51 nt, Artificial Sequence
  derived and/or modified sequence opt2 from anti-influenza_CDR
uggaucgaccccaacaacgacggcaccaucuacgcccagaaguuccagggc

SEQ ID NO: 22672 - RNA, 51 nt, Artificial Sequence
  derived and/or modified sequence opt2 from anti-influenza_CDR
augauguaccccggcgacuccgacaccaucuacucccccuccuuccagggc

SEQ ID NO: 22673 - RNA, 51 nt, Artificial Sequence
  derived and/or modified sequence opt2 from anti-influenza_CDR
augauguaccccggcgacgccgacgccaucuacucccccuccuuccagggc

SEQ ID NO: 22674 - RNA, 51 nt, Artificial Sequence
  derived and/or modified sequence opt2 from anti-influenza_CDR
augauguaccccggcgaguccgagaccaucuacucccccuccuuccagggc

SEQ ID NO: 22675 - RNA, 51 nt, Artificial Sequence
  derived and/or modified sequence opt2 from anti-influenza_CDR
augauguaccccggcgacgccgacaccaucuacucccccuccuuccagggc

SEQ ID NO: 22676 - RNA, 51 nt, Artificial Sequence
  derived and/or modified sequence opt2 from anti-influenza_CDR
augauguaccccggcuccuccgacaccaucuacucccccuccuuccagggc

SEQ ID NO: 22677 - RNA, 51 nt, Artificial Sequence
  derived and/or modified sequence opt2 from anti-influenza_CDR
augauguaccccggcgacuccgacgccaucuacucccccuccuuccagggc

SEQ ID NO: 22678 - RNA, 51 nt, Artificial Sequence
  derived and/or modified sequence opt2 from anti-influenza_CDR
augauguaccccggcgacaccgacaccaucuacucccccuccuuccagggc

SEQ ID NO: 22679 - RNA, 51 nt, Artificial Sequence
  derived and/or modified sequence opt2 from anti-influenza_CDR
augauguaccccggcgaguccgacaccaucuacucccccuccuuccagggc

SEQ ID NO: 22680 - RNA, 51 nt, Artificial Sequence
  derived and/or modified sequence opt2 from anti-influenza_CDR
gucaucuccugggacuccggccgcaucggcuacgccgacuccgucaagggc

SEQ ID NO: 22681 - RNA, 51 nt, Artificial Sequence
  derived and/or modified sequence opt2 from anti-influenza_CDR
guccgcuccggcgccuacuacuucaacuaccucguccccuacuucgacuac

SEQ ID NO: 22682 - RNA, 51 nt, Artificial Sequence
  derived and/or modified sequence opt2 from anti-influenza_CDR
guccgcuccggcgccuacuacgucaacuaccucguccccuacuucgacuac

SEQ ID NO: 22683 - RNA, 51 nt, Artificial Sequence
  derived and/or modified sequence opt2 from anti-influenza_CDR
aucaucuccugggacuccggccgcaucggcuacgccgacuccguccgcggc

SEQ ID NO: 22684 - RNA, 51 nt, Artificial Sequence
  derived and/or modified sequence opt2 from anti-influenza_CDR
cacggcggcgucuacuacuacggcuccgccuccuccggcugguucgacccc

SEQ ID NO: 22685 - RNA, 54 nt, Artificial Sequence
  derived and/or modified sequence opt2 from anti-influenza_CDR
cgcaccuacuaccgcuccaagugguacaacgacuacgccgaguccgucaagucc

SEQ ID NO: 22686 - RNA, 54 nt, Artificial Sequence
  derived and/or modified sequence opt2 from anti-influenza_CDR
cgcaccuacuaccgcuccaagugguacuacgacuacgccgaguccgucaagucc

SEQ ID NO: 22687 - RNA, 54 nt, Artificial Sequence
  derived and/or modified sequence opt2 from anti-influenza_CDR
cgcaccuacuaccgcuccaagugguacaacgacuacgccgucuccgucaagucc

SEQ ID NO: 22688 - RNA, 54 nt, Artificial Sequence
  derived and/or modified sequence opt2 from anti-influenza_CDR
cgcaccuacuaccgcuccaagugguacaacgacuacgccgacuuccucaagcgc

SEQ ID NO: 22689 - RNA, 54 nt, Artificial Sequence
  derived and/or modified sequence opt2 from anti-influenza_CDR
cgcaccuacuaccgcuccggcugguacaacgacuacgccgaguccgucaagucc

SEQ ID NO: 22690 - RNA, 54 nt, Artificial Sequence
  derived and/or modified sequence opt2 from anti-influenza_CDR
gcccgccucggcggcaacaaggacuacggcgacuaccucugguacuucgaccuc

SEQ ID NO: 22691 - RNA, 54 nt, Artificial Sequence
  derived and/or modified sequence opt2 from anti-influenza_CDR
gccaaggacaccgccgaccacggcgacuacgucgaccucggcuucuucgacgcc

SEQ ID NO: 22692 - RNA, 54 nt, Artificial Sequence
  derived and/or modified sequence opt2 from anti-influenza_CDR
gcccgcuccggcaucuucgacugguccgccccccucgucgaggccuucgacauc

SEQ ID NO: 22693 - RNA, 54 nt, Artificial Sequence
  derived and/or modified sequence opt2 from anti-influenza_CDR
gcccgccacgccuccugcuccgcccgcuccugcuacuggggccccgucgacuac

SEQ ID NO: 22694 - RNA, 54 nt, Artificial Sequence
  derived and/or modified sequence opt2 from anti-influenza_CDR
gacgccccccccaacgucgaggucgccuccaugaccaacugguacuucgaccuc

SEQ ID NO: 22695 - RNA, 54 nt, Artificial Sequence
  derived and/or modified sequence opt2 from anti-influenza_CDR
cuccgcaccgacuacggcgaccccgacuccgucuacuacuacggcauggacguc

SEQ ID NO: 22696 - RNA, 54 nt, Artificial Sequence
  derived and/or modified sequence opt2 from anti-influenza_CDR
ggcaccugcgccggcgacugcucccuccacuacuacuacuacggccucgacguc

SEQ ID NO: 22697 - RNA, 54 nt, Artificial Sequence
  derived and/or modified sequence opt2 from anti-influenza_CDR
cacgucuccgucucccacggcggccgcaccaaguccaaccccuccgucaugucc

SEQ ID NO: 22698 - RNA, 54 nt, Artificial Sequence
  derived and/or modified sequence opt2 from anti-influenza_CDR
gcccucaucuacuucgacggcuccaagcaguacuacgccgacuccgucaagggc

SEQ ID NO: 22699 - RNA, 54 nt, Artificial Sequence
  derived and/or modified sequence opt2 from anti-influenza_CDR
acccucaucuccuacgacggcgccaaccaguacuacgccgacuccgucaagggc

SEQ ID NO: 22700 - RNA, 54 nt, Artificial Sequence
  derived and/or modified sequence opt2 from anti-influenza_CDR
gccguccccggccccgucuucggcaucuucccccccugguccuacuucgacaac

SEQ ID NO: 22701 - RNA, 54 nt, Artificial Sequence
  derived and/or modified sequence opt2 from anti-influenza_CDR
ggcggcaucauccccaucuucggcgccgccaacuacgcccagaaguuccagggc

SEQ ID NO: 22702 - RNA, 54 nt, Artificial Sequence
  derived and/or modified sequence opt2 from anti-influenza_CDR
ggcuggaucuccgccuacaccggcaacacccacuacgccaagaacuucgagggc

SEQ ID NO: 22703 - RNA, 54 nt, Artificial Sequence
  derived and/or modified sequence opt2 from anti-influenza_CDR
ggcuggaucaaccccaacuucggcggcacccacuacgcccgcaaguuccagggc

SEQ ID NO: 22704 - RNA, 54 nt, Artificial Sequence
  derived and/or modified sequence opt2 from anti-influenza_CDR
guccgcuggcgcgccgccgccgucaucauggaccaguucuacaagauggacguc

SEQ ID NO: 22705 - RNA, 54 nt, Artificial Sequence
  derived and/or modified sequence opt2 from anti-influenza_CDR
gccguccccggccccaucuucggcaucuucccccccugguccuacuucgaccac

SEQ ID NO: 22706 - RNA, 54 nt, Artificial Sequence
  derived and/or modified sequence opt2 from anti-influenza_CDR
gccgccuccaccgccaccuccggcaccuacuacgccaugcgccccuucgacuuc

SEQ ID NO: 22707 - RNA, 57 nt, Artificial Sequence
  derived and/or modified sequence opt2 from anti-influenza_CDR
gcccgcggcaagcgccccggcuacugcuccggcggcgucugcuccuccgacuacugg

SEQ ID NO: 22708 - RNA, 57 nt, Artificial Sequence
  derived and/or modified sequence opt2 from anti-influenza_CDR
gcccgccacuaccccuacuacgaccuccccaccggcuucuacucccaguucgacuuc

SEQ ID NO: 22709 - RNA, 57 nt, Artificial Sequence
  derived and/or modified sequence opt2 from anti-influenza_CDR
ggcuccggcggcuacggcggcuucgacuacuucggcaagcuccgcaccugggacuuc

SEQ ID NO: 22710 - RNA, 57 nt, Artificial Sequence
  derived and/or modified sequence opt2 from anti-influenza_CDR
uucauccgcacccgccccuggggcggcaccgccgacaccgccgccuccgucaagggc

SEQ ID NO: 22711 - RNA, 57 nt, Artificial Sequence
  derived and/or modified sequence opt2 from anti-influenza_CDR
cucaacuaccacgacuccggcaccuacuacaacgccccccgcggcugguucgacccc

SEQ ID NO: 22712 - RNA, 57 nt, Artificial Sequence
  derived and/or modified sequence opt2 from anti-influenza_CDR
gucaaggacggcuacugcacccucaccuccugccccgucggcugguacuucgaccuc

SEQ ID NO: 22713 - RNA, 57 nt, Artificial Sequence
  derived and/or modified sequence opt2 from anti-influenza_CDR
gccguccccggccccaucuucggcaucuucccccccugguccuacuucgaccacugg

SEQ ID NO: 22714 - RNA, 57 nt, Artificial Sequence
  derived and/or modified sequence opt2 from anti-influenza_CDR
gcccgcgccaugauccagggcgucgucacccucuaccuccgccccggcgacuacugg

SEQ ID NO: 22715 - RNA, 57 nt, Artificial Sequence
  derived and/or modified sequence opt2 from anti-influenza_CDR
gccaaggucggccccuacaccggcuacgacgacuacaacuacuacggcauggacguc

SEQ ID NO: 22716 - RNA, 57 nt, Artificial Sequence
  derived and/or modified sequence opt2 from anti-influenza_CDR
gccaaggucgagcgcuccuucuacgacggcuccggcuacggcgacgcccucgagauc

SEQ ID NO: 22717 - RNA, 57 nt, Artificial Sequence
  derived and/or modified sequence opt2 from anti-influenza_CDR
uacugcgcccgcggccgcgucaacuccggcuacgacuggggccccaacuucgacucc

SEQ ID NO: 22718 - RNA, 57 nt, Artificial Sequence
  derived and/or modified sequence opt2 from anti-influenza_CDR
uucugcgcccgcggcucccccaacuccggcuacgacuggggcccccacuucgacuac

SEQ ID NO: 22719 - RNA, 57 nt, Artificial Sequence
  derived and/or modified sequence opt2 from anti-influenza_CDR
cgcaucaaguccaacaccgacggcggcaccaccgacuacgccgcccccgucaagggc

SEQ ID NO: 22720 - RNA, 57 nt, Artificial Sequence
  derived and/or modified sequence opt2 from anti-influenza_CDR
cuccgccuccagggcgaggucgucgucccccccucccaguccaacugguucgacccc

SEQ ID NO: 22721 - RNA, 60 nt, Artificial Sequence
  derived and/or modified sequence opt2 from anti-influenza_CDR
gccaaggagggcggcaacaccaucuucggccucgucaccauggccuacuacuucgacucc

SEQ ID NO: 22722 - RNA, 60 nt, Artificial Sequence
  derived and/or modified sequence opt2 from anti-influenza_CDR
gcccgcgccggcggcgacuccuccggcuacuacggcgcccucggccgcuucuuccagcac

SEQ ID NO: 22723 - RNA, 60 nt, Artificial Sequence
  derived and/or modified sequence opt2 from anti-influenza_CDR
gccaaggacucccgcggcuacugcuccuccaucaucugcuucgagggcggccucgacaac

SEQ ID NO: 22724 - RNA, 60 nt, Artificial Sequence
  derived and/or modified sequence opt2 from anti-influenza_CDR
ggcuccggcuccuccgaccgcuccgacuacgacccccacuacuacuacuaccucgacguc

SEQ ID NO: 22725 - RNA, 60 nt, Artificial Sequence
  derived and/or modified sequence opt2 from anti-influenza_CDR
ggcaccgaccccgacaccgaggucuacugccgcgucggcaacugcgccgccuucgacuac

SEQ ID NO: 22726 - RNA, 60 nt, Artificial Sequence
  derived and/or modified sequence opt2 from anti-influenza_CDR
ggcaccucccacgucucccgcuacuucgacuggcucccccccaccaacugguucgacccc

SEQ ID NO: 22727 - RNA, 60 nt, Artificial Sequence
  derived and/or modified sequence opt2 from anti-influenza_CDR
ggcaccgaccccgacaccgagggcuacugccgcuccggcuccugcuccgccuucgacuuc

SEQ ID NO: 22728 - RNA, 60 nt, Artificial Sequence
  derived and/or modified sequence opt2 from anti-influenza_CDR
ggcaccgaccccgacaccgaggucuacugccgcgccggcaacugcgccgccuucgacuuc

SEQ ID NO: 22729 - RNA, 60 nt, Artificial Sequence
  derived and/or modified sequence opt2 from anti-influenza_CDR
cgcggcggccacuccuucggcuacggcuccggcggcgacacccacuccgaguucgacucc

SEQ ID NO: 22730 - RNA, 60 nt, Artificial Sequence
  derived and/or modified sequence opt2 from anti-influenza_CDR
cacauguccaugcagcaggucgucuccgccggcugggagcgcgccgaccucgucggcgac

SEQ ID NO: 22731 - RNA, 60 nt, Artificial Sequence
  derived and/or modified sequence opt2 from anti-influenza_CDR
gacucccgccuccgcucccuccucuacuucgaguggcucucccagggcuacuucaacccc

SEQ ID NO: 22732 - RNA, 60 nt, Artificial Sequence
  derived and/or modified sequence opt2 from anti-influenza_CDR
gcccgccaccucggccagcagcucgucuccaacaccuacuacuacuacggcauggacguc

SEQ ID NO: 22733 - RNA, 63 nt, Artificial Sequence
  derived and/or modified sequence opt2 from anti-influenza_CDR
accaccggcggcaccaccaccugcaccgccgccggcugcggcggcggcugcugcaccugcugc

SEQ ID NO: 22734 - RNA, 63 nt, Artificial Sequence
  derived and/or modified sequence opt2 from anti-influenza_CDR
gcccgcgccgccgacgaguccgucgagucccucaccaucaaggccuuccgcaccaacuaccac

SEQ ID NO: 22735 - RNA, 63 nt, Artificial Sequence
  derived and/or modified sequence opt2 from anti-influenza_CDR
gcccgcaugccccucgccaacuacgaccuccucaccggccucuacaucggcgccuucgaccuc

SEQ ID NO: 22736 - RNA, 63 nt, Artificial Sequence
  derived and/or modified sequence opt2 from anti-influenza_CDR
gacaugcucgccuacuacuccgacaacuccggcaagaaguacaacgucuacggcauggacguc

SEQ ID NO: 22737 - RNA, 63 nt, Artificial Sequence
  derived and/or modified sequence opt2 from anti-influenza_CDR
gacaugcucgccuacuacuacgacggcuccggcauccgcuacaaccucuacggcauggacguc

SEQ ID NO: 22738 - RNA, 66 nt, Artificial Sequence
  derived and/or modified sequence opt2 from anti-influenza_CDR
gccaaggacccccgccuccgccaccuccucuacuuccccuucaccuccaugaucuacuucgacuac

SEQ ID NO: 22739 - RNA, 66 nt, Artificial Sequence
  derived and/or modified sequence opt2 from anti-influenza_CDR
gccaaggacucccagcuccgcucccuccucuacuucgaguggcucucccagggcuacuucgacccc

SEQ ID NO: 22740 - RNA, 66 nt, Artificial Sequence
  derived and/or modified sequence opt2 from anti-influenza_CDR
gccaaggacucccagcuccgcucccuccucuacuucgaguggcucucccagggcuacuucgacuac

SEQ ID NO: 22741 - RNA, 66 nt, Artificial Sequence
  derived and/or modified sequence opt2 from anti-influenza_CDR
gccaaggacucccagcuccgcucccuccucuacuucgaguggcucucccagggcuacuucgagccc

SEQ ID NO: 22742 - RNA, 66 nt, Artificial Sequence
  derived and/or modified sequence opt2 from anti-influenza_CDR
gccaaggagcgcccccuccgccuccuccgcuacuucgacuggcucuccggcggcgccaacgacuac

SEQ ID NO: 22743 - RNA, 66 nt, Artificial Sequence
  derived and/or modified sequence opt2 from anti-influenza_CDR
gcccgcgacguccacaacuacgacuuccucaccggcuacccccuccaccucuacggcauggacguc

SEQ ID NO: 22744 - RNA, 66 nt, Artificial Sequence
  derived and/or modified sequence opt2 from anti-influenza_CDR
gcccgcgacggccgcgagggcuacuucuacggcuccggcuccuucuacaaccucaagggccucaac

SEQ ID NO: 22745 - RNA, 66 nt, Artificial Sequence
  derived and/or modified sequence opt2 from anti-influenza_CDR
uccaccgaccgcggccacguccuccgcuacuucggcuggaugcuccccggcgacgccuucgacguc

SEQ ID NO: 22746 - RNA, 66 nt, Artificial Sequence
  derived and/or modified sequence opt2 from anti-influenza_CDR
cucaacuacuacgaccgcuccggcuaccacucccccgacggccccuccaacaacugguucgacccc

SEQ ID NO: 22747 - RNA, 66 nt, Artificial Sequence
  derived and/or modified sequence opt2 from anti-influenza_CDR
gcccgcgucccccgcgaccgccuccucacccucuacuacgaguccuccaccuacggcuucgacuac

SEQ ID NO: 22748 - RNA, 66 nt, Artificial Sequence
  derived and/or modified sequence opt2 from anti-influenza_CDR
gcccgcaaguggggccgcaugaccgucuucggcgucgccaccgaccagcucuacuacuucgacuac

SEQ ID NO: 22749 - RNA, 66 nt, Artificial Sequence
  derived and/or modified sequence opt2 from anti-influenza_CDR
gccaccgacaucgucgucgagcgcgacgccucccucggcggcuucaacuccuacggcauggacguc

SEQ ID NO: 22750 - RNA, 69 nt, Artificial Sequence
  derived and/or modified sequence opt2 from anti-influenza_CDR
gcccgcaaccuccccgacaucgccgucgucaccgccguccaggacgccacccccgucugguucgacccc

SEQ ID NO: 22751 - RNA, 69 nt, Artificial Sequence
  derived and/or modified sequence opt2 from anti-influenza_CDR
gacggccccuacuccgacgacuuccgcuccggcuacgccgcccgcuaccgcuacuucggcauggacguc

SEQ ID NO: 22752 - RNA, 72 nt, Artificial Sequence
  derived and/or modified sequence opt2 from anti-influenza_CDR
ggccgcgagcuccuccgccuccagcacuuccucaccgacucccaguccgagcgccgcgacugcuucgacccc

SEQ ID NO: 22753 - RNA, 72 nt, Artificial Sequence
  derived and/or modified sequence opt2 from anti-influenza_CDR
augucccuccucaccgaggucgagacccccacccgcaacgaguggggcugccgcugcaacgacuccuccgac

SEQ ID NO: 22754 - RNA, 72 nt, Artificial Sequence
  derived and/or modified sequence opt2 from anti-influenza_CDR
augucccuccucaccgaggucgagacccccaccaagaacgagugggagugccgcugcaacgacuccuccgac

SEQ ID NO: 22755 - RNA, 72 nt, Artificial Sequence
  derived and/or modified sequence opt2 from anti-influenza_CDR
augucccuccucaccgaggucgagacccccauccgcaacgagugggagugccgcugcaacgacuccuccgac

SEQ ID NO: 22756 - RNA, 72 nt, Artificial Sequence
  derived and/or modified sequence opt2 from anti-influenza_CDR
augucccuccucaccgaggucgagacccccauccgcaacggcugggagugcaagugcaacgacuccuccgac

SEQ ID NO: 22757 - RNA, 72 nt, Artificial Sequence
  derived and/or modified sequence opt2 from anti-influenza_CDR
augucccuccucaccgaggucgagacccccauccgcuccgaguggggcugccgcugcaacgacuccuccgac

SEQ ID NO: 22758 - RNA, 72 nt, Artificial Sequence
  derived and/or modified sequence opt2 from anti-influenza_CDR
auguccuuccuccccgaggucgagacccccauccgcaacgaguggggcugccgcugcaacgacuccuccgac

SEQ ID NO: 22759 - RNA, 72 nt, Artificial Sequence
  derived and/or modified sequence opt2 from anti-influenza_CDR
augucccuccucaccgaggucgagacccccauccgcaacgaguggggcugccgcugcaacgacuccuccaac

SEQ ID NO: 22760 - RNA, 72 nt, Artificial Sequence
  derived and/or modified sequence opt2 from anti-influenza_CDR
augucccuccucaccgaggucgagacccccauccgcaaggaguggggcugccgcugcaacgacuccuccgac

SEQ ID NO: 22761 - RNA, 72 nt, Artificial Sequence
  derived and/or modified sequence opt2 from anti-influenza_CDR
auguccuuccucaccgaggucgagacccccauccgcaacgaguggggcugccgcugcaacgacuccuccgac

SEQ ID NO: 22762 - RNA, 72 nt, Artificial Sequence
  derived and/or modified sequence opt2 from anti-influenza_CDR
augucccuccccaccgaggucgagacccccauccgcuccgaguggggcugccgcugcaacgacuccuccgac

SEQ ID NO: 22763 - RNA, 72 nt, Artificial Sequence
  derived and/or modified sequence opt2 from anti-influenza_CDR
augucccuccuccccgaggucgagacccccauccgcaacgaguggggcugccgcugcaacgacuccuccgac

SEQ ID NO: 22764 - RNA, 72 nt, Artificial Sequence
  derived and/or modified sequence opt2 from anti-influenza_CDR
augucccuccuccccgaggucgagacccccauccgcaacggcuggggcugccgcugcaacgacuccuccgac

SEQ ID NO: 22765 - RNA, 72 nt, Artificial Sequence
  derived and/or modified sequence opt2 from anti-influenza_CDR
augucccuccucaccgaggucgagacccccacccgcaacggcugggagugccgcugcuccggcuccuccgac

SEQ ID NO: 22766 - RNA, 72 nt, Artificial Sequence
  derived and/or modified sequence opt2 from anti-influenza_CDR
augucccuccucaccgaggucgagacccccauccgcaacgagugggaguaccgcugcaacgacuccuccgac

SEQ ID NO: 22767 - RNA, 72 nt, Artificial Sequence
  derived and/or modified sequence opt2 from anti-influenza_CDR
augucccuccucaccgaggucgagacccccauccgcaacgagugggaguaccgcugcuccgacuccuccgac

SEQ ID NO: 22768 - RNA, 72 nt, Artificial Sequence
  derived and/or modified sequence opt2 from anti-influenza_CDR
augucccuccucaccgaggucgagacccccacccgcaacggcugggagugccgcuacuccgacuccuccgac

SEQ ID NO: 22769 - RNA, 72 nt, Artificial Sequence
  derived and/or modified sequence opt2 from anti-influenza_CDR
auguccuuccucaccgaggucgagacccucacccgcaacggcugggagugccgcugcuccgacuccuccgac

SEQ ID NO: 22770 - RNA, 72 nt, Artificial Sequence
  derived and/or modified sequence opt2 from anti-influenza_CDR
augucccuccucaccgaggucgagacccucacccgcaacggcugggagugcaagugccgcgacuccuccgac

SEQ ID NO: 22771 - RNA, 72 nt, Artificial Sequence
  derived and/or modified sequence opt2 from anti-influenza_CDR
augucccuccucaccgaggucgagacccccauccgcaacgaguggggcugccgcugcaacgacuccuccgac

SEQ ID NO: 22772 - RNA, 72 nt, Artificial Sequence
  derived and/or modified sequence opt2 from anti-influenza_CDR
augucccuccucaccgaggucgagacccccauccgcuccgaguggggcugccgcugcaacgacuccggcgac

SEQ ID NO: 22773 - RNA, 72 nt, Artificial Sequence
  derived and/or modified sequence opt2 from anti-influenza_CDR
augucccuccucaccgaggucgagacccccauccgcaacgagugggagugccgcugcaacggcuccuccgac

SEQ ID NO: 22774 - RNA, 72 nt, Artificial Sequence
  derived and/or modified sequence opt2 from anti-influenza_CDR
augucccuccccaccgaggucgagacccccauccgcaacgaguggggcugccgcugcaacgacuccuccgac

SEQ ID NO: 22775 - RNA, 72 nt, Artificial Sequence
  derived and/or modified sequence opt2 from anti-influenza_CDR
augucccuccucaccgaggucgagacccccauccgcaacgaguggggcugccgcugcaacggcuccuccgac

SEQ ID NO: 22776 - RNA, 72 nt, Artificial Sequence
  derived and/or modified sequence opt2 from anti-influenza_CDR
augucccuccucaccgaggucgacacccucacccgcaacggcuggggcugccgcugcuccgacuccuccgac

SEQ ID NO: 22777 - RNA, 72 nt, Artificial Sequence
  derived and/or modified sequence opt2 from anti-influenza_CDR
augucccuccucaccgaggucgagacccucaccaagaacggcuggggcugccgcugcuccgacuccuccgac

SEQ ID NO: 22778 - RNA, 72 nt, Artificial Sequence
  derived and/or modified sequence opt2 from anti-influenza_CDR
augucccuccucaccgaggucgagacccccacccgcaacggcugggagugcaagugcuccgacuccuccgac

SEQ ID NO: 22779 - RNA, 72 nt, Artificial Sequence
  derived and/or modified sequence opt2 from anti-influenza_CDR
augucccuccucaccgaggucgagacccacacccgcaacggcugggagugcaagugcuccgacuccuccgac

SEQ ID NO: 22780 - RNA, 72 nt, Artificial Sequence
  derived and/or modified sequence opt2 from anti-influenza_CDR
augucccuccucaccgaggucaagacccccacccgcaacggcugggagugcaagugcuccgacuccuccgac

SEQ ID NO: 22781 - RNA, 72 nt, Artificial Sequence
  derived and/or modified sequence opt2 from anti-influenza_CDR
augucccuccucaccgaggucgagacccucacccgcaacggcuggggcugccgcugcuccgacuccuccgac

SEQ ID NO: 22782 - RNA, 72 nt, Artificial Sequence
  derived and/or modified sequence opt2 from anti-influenza_CDR
augucccuccucaccgaggucgagacccccacccgcgacggcugggagugcaagugcuccgacuccuccgac

SEQ ID NO: 22783 - RNA, 72 nt, Artificial Sequence
  derived and/or modified sequence opt2 from anti-influenza_CDR
augucccuccucaccgaggucgagacccccacccgcaacggcuggggcugccgcugcuccgacuccuccgac

SEQ ID NO: 22784 - RNA, 72 nt, Artificial Sequence
  derived and/or modified sequence opt2 from anti-influenza_CDR
augucccuccucaccgaggucgagacccccacccgcaacggcugggagugcaagugcaacgacuccuccgac

SEQ ID NO: 22785 - RNA, 72 nt, Artificial Sequence
  derived and/or modified sequence opt2 from anti-influenza_CDR
augucccuccucaccgaggucgagacccucacccgcaacggcugggagugcaagugcuccgacuccuccgac

SEQ ID NO: 22786 - RNA, 72 nt, Artificial Sequence
  derived and/or modified sequence opt2 from anti-influenza_CDR
augucccuccucaccgaggucgagacccccauccgcaacgaguggggcugcaagugcaacgacuccuccgac

SEQ ID NO: 22787 - RNA, 72 nt, Artificial Sequence
  derived and/or modified sequence opt2 from anti-influenza_CDR
auguccuuccucaccgaggucgagacccccauccgcaacgaguggggcugccgcugcaacggcuccuccgac

SEQ ID NO: 22788 - RNA, 72 nt, Artificial Sequence
  derived and/or modified sequence opt2 from anti-influenza_CDR
augucccuccucaccgaggucgagacccccacccgcaacggcugggagugccgcugcaacgacuccuccgac

SEQ ID NO: 22789 - RNA, 72 nt, Artificial Sequence
  derived and/or modified sequence opt2 from anti-influenza_CDR
augucccuccucaccgaggucgagacccccauccgcaagggcugggagugcaacugcuccgacuccuccgac

SEQ ID NO: 22790 - RNA, 72 nt, Artificial Sequence
  derived and/or modified sequence opt2 from anti-influenza_CDR
augucccuccucaccgaggucgagacccccacccgcaacgagugggagugccgcugcuccgacuccuccgac

SEQ ID NO: 22791 - RNA, 72 nt, Artificial Sequence
  derived and/or modified sequence opt2 from anti-influenza_CDR
augucccuccucaccggcgucgagacccacacccgcaacggcuggggcugcaagugcuccgacuccuccgac

SEQ ID NO: 22792 - RNA, 72 nt, Artificial Sequence
  derived and/or modified sequence opt2 from anti-influenza_CDR
augucccuccuccccgaggucgagacccacacccgcaacggcuggggcugccgcugcuccgacuccuccgac

SEQ ID NO: 22793 - RNA, 72 nt, Artificial Sequence
  derived and/or modified sequence opt2 from anti-influenza_CDR
accgacggccccuacuccgacgacuuccgcuccggcuacgccgcccgcuaccgcuacuucggcauggacguc

SEQ ID NO: 22794 - RNA, 75 nt, Artificial Sequence
  derived and/or modified sequence opt2 from anti-influenza_CDR
gccaagcacaugucccuccagcaggucgucuccgccggcugggagcgcgccgaccucgucggcgacgccuucgac

SEQ ID NO: 22795 - RNA, 75 nt, Artificial Sequence
  derived and/or modified sequence opt2 from anti-influenza_CDR
gccaagcaccucuccaugcagcaggucgucuccgccggcugggagcgcgccgaccucgucggcgacgccuucgac

SEQ ID NO: 22796 - RNA, 75 nt, Artificial Sequence
  derived and/or modified sequence opt2 from anti-influenza_CDR
gccaagcacgccucccuccagcaggucgucuccgccggcugggagcgcgccgaccucgucggcgacgccuucgac

SEQ ID NO: 22797 - RNA, 75 nt, Artificial Sequence
  derived and/or modified sequence opt2 from anti-influenza_CDR
gccaagcacuccucccuccagcaggucgucuccgccggcugggagcgcgccgaccucgucggcgacgccuucgac

SEQ ID NO: 22798 - RNA, 75 nt, Artificial Sequence
  derived and/or modified sequence opt2 from anti-influenza_CDR
gccaagcaccucucccuccagcaggucgucuccgccggcugggagcgcgccgaccucgucggcgacgccuucgac

SEQ ID NO: 22799 - RNA, 75 nt, Artificial Sequence
  derived and/or modified sequence opt2 from anti-influenza_CDR
gccaagcacauguccaugcagcaggucgucuccgccggcugggagcgcgccgaccucgucggcgacgccuucgac

SEQ ID NO: 22800 - RNA, 75 nt, Artificial Sequence
  derived and/or modified sequence opt2 from anti-influenza_CDR
gcccgcggccccgagaccuacuacuacgacaagaccaacuggcucaacucccaccccgacgaguacuuccagcac

SEQ ID NO: 22801 - RNA, 75 nt, Artificial Sequence
  derived and/or modified sequence opt2 from anti-influenza_CDR
accaccgacggccccuacuccgacgacuuccgcuccggcuacgccgcccgcuaccgcuacuucggcauggacguc

SEQ ID NO: 22802 - RNA, 75 nt, Artificial Sequence
  derived and/or modified sequence opt2 from anti-influenza_CDR
accgacggccccuacuccgacgacuuccgcuccggcuacgccgcccgcuaccgcuacuucggcauggacgucugg

SEQ ID NO: 22803 - RNA, 78 nt, Artificial Sequence
  derived and/or modified sequence opt2 from anti-influenza_CDR
gacauccagaugacccagucccccuccucccucuccgccuccgucggcgaccgcgucaccaucaccugccgcuccucc

SEQ ID NO: 22804 - RNA, 78 nt, Artificial Sequence
  derived and/or modified sequence opt2 from anti-influenza_CDR
gccaccggccgcgccgccaccggcuccgccuccugcaccggcggcggcaccuacuggaccuacugcaccugcaccacc

SEQ ID NO: 22805 - RNA, 81 nt, Artificial Sequence
  derived and/or modified sequence opt2 from anti-influenza_CDR
ggcuacauccccgaggccccccgcgacggccaggccuacguccgcaaggacggcgaguggguccuccucuccaccuuccuc

SEQ ID NO: 22806 - RNA, 90 nt, Artificial Sequence
  derived and/or modified sequence opt2 from anti-influenza_CDR
cagguccagcuccucgagaccggcggcggccucgucaagcccggccagucccucaagcucuccugcgccgccuccggcuucaccuucacc

SEQ ID NO: 22807 - RNA, 96 nt, Artificial Sequence
  derived and/or modified sequence opt2 from anti-influenza_CDR
cgcuucaccaucucccgcgacaacuccaagaacacccucuaccuccagaugaacucccuccgcgccgaggacaccgccgucuacuacugcgccaag

SEQ ID NO: 22808 - RNA, 96 nt, Artificial Sequence
  derived and/or modified sequence opt2 from anti-influenza_CDR
ggcguccccucccgcuucuccggcuccggcuccggcaccgacuucacccucaccaucuccucccuccagcccgaggacuucgccaccuacuacugc

SEQ ID NO: 22809 - RNA, 15 nt, Artificial Sequence
  derived and/or modified sequence opt2 from anti-OX40_HeavyChain_CDR1
uccuacuccaugaac

SEQ ID NO: 22810 - RNA, 15 nt, Artificial Sequence
  derived and/or modified sequence opt2 from anti-OX40_HeavyChain_CDR1
gacuacgccaugcac

SEQ ID NO: 22811 - RNA, 15 nt, Artificial Sequence
  derived and/or modified sequence opt2 from anti-OX40_HeavyChain_CDR1
gacuccuacaugucc

SEQ ID NO: 22812 - RNA, 15 nt, Artificial Sequence
  derived and/or modified sequence opt2 from anti-OX40_HeavyChain_CDR1
gacgccuacaugucc

SEQ ID NO: 22813 - RNA, 15 nt, Artificial Sequence
  derived and/or modified sequence opt2 from anti-OX40_HeavyChain_CDR1
gaguccuacaugucc

SEQ ID NO: 22814 - RNA, 15 nt, Artificial Sequence
  derived and/or modified sequence opt2 from anti-OX40_HeavyChain_CDR1
uccggcuacuggaac

SEQ ID NO: 22815 - RNA, 21 nt, Artificial Sequence
  derived and/or modified sequence opt2 from anti-OX40_LightChain_CDR2
uacaccucccgccuccacucc

SEQ ID NO: 22816 - RNA, 21 nt, Artificial Sequence
  derived and/or modified sequence opt2 from anti-OX40_LightChain_CDR2
gccgccuccucccuccagucc

SEQ ID NO: 22817 - RNA, 21 nt, Artificial Sequence
  derived and/or modified sequence opt2 from anti-OX40_LightChain_CDR2
gacgccuccaaccgcgccacc

SEQ ID NO: 22818 - RNA, 21 nt, Artificial Sequence
  derived and/or modified sequence opt2 from anti-OX40_LightChain_CDR2
uacaccucccgccuccgcucc

SEQ ID NO: 22819 - RNA, 24 nt, Artificial Sequence
  derived and/or modified sequence opt2 from anti-OX40_LightChain_CDR3
cagcagcgcuccaacuggcccacc

SEQ ID NO: 22820 - RNA, 24 nt, Artificial Sequence
  derived and/or modified sequence opt2 from anti-OX40_HeavyChain_CDR3
gccccccgcugguacuucuccguc

SEQ ID NO: 22821 - RNA, 24 nt, Artificial Sequence
  derived and/or modified sequence opt2 from anti-OX40_HeavyChain_CDR3
gccccccgcugguacuucuccgcc

SEQ ID NO: 22822 - RNA, 24 nt, Artificial Sequence
  derived and/or modified sequence opt2 from anti-OX40_HeavyChain_CDR3
gccccccgcugguacuucgccguc

SEQ ID NO: 22823 - RNA, 27 nt, Artificial Sequence
  derived and/or modified sequence opt2 from anti-OX40_LightChain_CDR3
cagcagggcaacacccuccccuggacc

SEQ ID NO: 22824 - RNA, 27 nt, Artificial Sequence
  derived and/or modified sequence opt2 from anti-OX40_HeavyChain_CDR3
gaguccggcugguaccucuucgacuac

SEQ ID NO: 22825 - RNA, 27 nt, Artificial Sequence
  derived and/or modified sequence opt2 from anti-OX40_LightChain_CDR3
cagcaguacaacuccuacccccccacc

SEQ ID NO: 22826 - RNA, 27 nt, Artificial Sequence
  derived and/or modified sequence opt2 from anti-OX40_LightChain_CDR3
cagcagggccacacccucccccccacc

SEQ ID NO: 22827 - RNA, 27 nt, Artificial Sequence
  derived and/or modified sequence opt2 from anti-OX40_LightChain_CDR3
cagcagggccacacccuccccgccacc

SEQ ID NO: 22828 - RNA, 27 nt, Artificial Sequence
  derived and/or modified sequence opt2 from anti-OX40_LightChain_CDR3
cagcagggccacaccgccccccccacc

SEQ ID NO: 22829 - RNA, 27 nt, Artificial Sequence
  derived and/or modified sequence opt2 from anti-OX40_LightChain_CDR3
cagcagggcgccacccucccccccacc

SEQ ID NO: 22830 - RNA, 27 nt, Artificial Sequence
  derived and/or modified sequence opt2 from anti-OX40_LightChain_CDR3
cagcagggccacgcccucccccccacc

SEQ ID NO: 22831 - RNA, 27 nt, Artificial Sequence
  derived and/or modified sequence opt2 from anti-OX40_LightChain_CDR3
cagcaggcccacacccucccccccacc

SEQ ID NO: 22832 - RNA, 27 nt, Artificial Sequence
  derived and/or modified sequence opt2 from anti-OX40_LightChain_CDR3
cagcagggccacacccucgcccccacc

SEQ ID NO: 22833 - RNA, 27 nt, Artificial Sequence
  derived and/or modified sequence opt2 from anti-OX40_LightChain_CDR3
caggccggccacacccucccccccacc

SEQ ID NO: 22834 - RNA, 30 nt, Artificial Sequence
  derived and/or modified sequence opt2 from anti-OX40_HeavyChain_CDR1
ggcuacaccuucaccuccuacgucaugcac

SEQ ID NO: 22835 - RNA, 30 nt, Artificial Sequence
  derived and/or modified sequence opt2 from anti-OX40_HeavyChain_CDR3
uacuacggcuccucccucuccauggacuac

SEQ ID NO: 22836 - RNA, 33 nt, Artificial Sequence
  derived and/or modified sequence opt2 from anti-OX40_LightChain_CDR1
cgcgccucccaggacaucuccaacuaccucaac

SEQ ID NO: 22837 - RNA, 33 nt, Artificial Sequence
  derived and/or modified sequence opt2 from anti-OX40_LightChain_CDR1
cgcgccucccagggcaucuccuccuggcucgcc

SEQ ID NO: 22838 - RNA, 33 nt, Artificial Sequence; identical to SEQ ID NO: 22356
  derived and/or modified sequence opt2 from anti-OX40_LightChain_CDR1

SEQ ID NO: 22839 - RNA, 39 nt, Artificial Sequence
  derived and/or modified sequence opt2 from anti-OX40_HeavyChain_CDR3
uaccgcuacgacuacgacggcggccacgccauggacuac

SEQ ID NO: 22840 - RNA, 39 nt, Artificial Sequence; identical to SEQ ID NO: 15198
  derived and/or modified sequence opt2 from anti-OX40_HeavyChain_CDR3

SEQ ID NO: 22841 - RNA, 39 nt, Artificial Sequence
  derived and/or modified sequence opt2 from anti-OX40_HeavyChain_CDR3
uacaaguacgacuacgacggcggccacgccauggacuac

SEQ ID NO: 22842 - RNA, 45 nt, Artificial Sequence
  derived and/or modified sequence opt2 from anti-OX40_HeavyChain_CDR3
gaccaguccaccgccgacuacuacuucuacuacggcauggacguc

SEQ ID NO: 22843 - RNA, 48 nt, Artificial Sequence
  derived and/or modified sequence opt2 from anti-OX40_HeavyChain_CDR2
uacaucuccuacaacggcaucaccuaccacaaccccucccucaagucc

SEQ ID NO: 22844 - RNA, 48 nt, Artificial Sequence
  derived and/or modified sequence opt2 from anti-OX40_HeavyChain_CDR2
uacaucuccuacaacgccaucaccuaccacaaccccucccucaagucc

SEQ ID NO: 22845 - RNA, 48 nt, Artificial Sequence
  derived and/or modified sequence opt2 from anti-OX40_HeavyChain_CDR2
uacaucuccuacuccggcaucaccuaccacaaccccucccucaagucc

SEQ ID NO: 22846 - RNA, 51 nt, Artificial Sequence
  derived and/or modified sequence opt2 from anti-OX40_HeavyChain_CDR2
uacaucaaccccuacaacgacggcaccaaguacaacgagaaguucaagggc

SEQ ID NO: 22847 - RNA, 51 nt, Artificial Sequence
  derived and/or modified sequence opt2 from anti-OX40_HeavyChain_CDR2
uacaucuccuccuccuccuccaccaucgacuacgccgacuccgucaagggc

SEQ ID NO: 22848 - RNA, 51 nt, Artificial Sequence
  derived and/or modified sequence opt2 from anti-OX40_HeavyChain_CDR2
ggcaucuccuggaacuccggcuccaucggcuacgccgacuccgucaagggc

SEQ ID NO: 22849 - RNA, 51 nt, Artificial Sequence
  derived and/or modified sequence opt2 from anti-OX40_HeavyChain_CDR2
gacauguaccccgacaacggcgacuccuccuacaaccagaaguuccgcgag

SEQ ID NO: 22850 - RNA, 51 nt, Artificial Sequence
  derived and/or modified sequence opt2 from anti-OX40_HeavyChain_CDR2
gacauguaccccgacaacgccgacuccuccuacaaccagaaguuccgcgag

SEQ ID NO: 22851 - RNA, 51 nt, Artificial Sequence
  derived and/or modified sequence opt2 from anti-OX40_HeavyChain_CDR2
gacauguaccccgacaacgccgacgccuccuacaaccagaaguuccgcgag

SEQ ID NO: 22852 - RNA, 51 nt, Artificial Sequence
  derived and/or modified sequence opt2 from anti-OX40_HeavyChain_CDR2
gacauguaccccgacaacggcgacgccuccuacaaccagaaguuccgcgag

SEQ ID NO: 22853 - RNA, 51 nt, Artificial Sequence
  derived and/or modified sequence opt2 from anti-OX40_HeavyChain_CDR2
gacauguaccccgacuccggcgacuccuccuacaaccagaaguuccgcgag

SEQ ID NO: 22854 - RNA, 51 nt, Artificial Sequence
  derived and/or modified sequence opt2 from anti-OX40_HeavyChain_CDR2
gacauguaccccgacaacggcuccuccuccuacaaccagaaguuccgcgag

SEQ ID NO: 22855 - RNA, 309 nt, Artificial Sequence
  derived and/or modified sequence opt2 from Ig_LightChain_kappa_constant_domain
accgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgc

SEQ ID NO: 22856 - RNA, 309 nt, Artificial Sequence
  derived and/or modified sequence opt2 from Ig_LightChain_kappa_constant_domain
accgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccaacacccucacccucuccaaggccgacuacgagaagcacaaggucuacgccugcgaggucacccaccagggccucuccucccccgucaccaaguccuucaaccgc

SEQ ID NO: 22857 - RNA, 312 nt, Artificial Sequence
  derived and/or modified sequence opt2 from Ig_LightChain_lambda_constant_domain
cccaaggccgcccccuccgucacccucuucccccccuccuccgaggagcuccaggccaacaaggccacccucgucugccucaucuccgacuucuaccccggcgccgucaccgucgccuggaaggccgacuccucccccgucaaggccggcgucgagaccaccacccccuccaagcaguccaacaacaaguacgccgccuccuccuaccucucccucacccccgagcaguggaagucccaccgcuccuacuccugccaggucacccacgagggcuccaccgucgagaagaccgucgcccccaccgagugcucc

SEQ ID NO: 22858 - RNA, 312 nt, Artificial Sequence
  derived and/or modified sequence opt2 from Ig_LightChain_lambda_constant_domain
cccaaggccgcccccuccgucacccucuucccccccuccuccgaggagcuccaggccaacaaggccacccucgucugccucaucuccgacuucuaccccggcgccgucaccgucgccuggaaggccgacuccucccccgucaaggccggcgucgagaccaccacccccuccaagcaguccaacaacaaguacgccgccuccuccuaccucucccucacccccgagcaguggaagucccaccgcuccuacuccugccaggucacccacgagggcuccaccgucgagaagaccgucgcccccgccgagugcucc

SEQ ID NO: 22859 - RNA, 312 nt, Artificial Sequence
  derived and/or modified sequence opt2 from Ig_LightChain_lambda_constant_domain
cccaaggccgcccccuccgucacccucuucccccccuccuccgaggagcuccaggccaacaaggccacccucgucugccucaucuccgacuucuaccccggcgccgucaccgucgccuggaaggccgacuccucccccgucaaggccggcgucgagaccaccacccccuccaagcaguccaacaacaaguacgccgccuccuccuaccucucccucacccccgagcaguggaagucccacaaguccuacuccugccaggucacccacgagggcuccaccgucgagaagaccgucgcccccaccgagugcucc

SEQ ID NO: 22860 - RNA, 312 nt, Artificial Sequence
  derived and/or modified sequence opt2 from Ig_LightChain_lambda_constant_domain
cccaaggccgcccccuccgucacccucuucccccccuccuccgaggagcuccaggccaacaaggccacccucgucugccucaucuccgacuucuaccccggcgccgucaccgucgccuggaaggccgacuccucccccgucaaggccggcgucgagaccaccacccccuccaagcaguccaacaacaaguacgccgccuccuccuaccucucccucacccccgagcaguggaagucccacaaguccuacuccugccaggucacccacgagggcuccaccgucgagaagaccgucgcccccgccgagugcucc

SEQ ID NO: 22861 - RNA, 282 nt, Artificial Sequence
  derived and/or modified sequence opt2 from IgG1_HeavyChain_CH1_constant_domain
uccgccuccaccaagggccccuccgucuucccccucgcccccuccuccaaguccaccuccggcggcaccgccgcccucggcugccucgucaaggacuacuuccccgagcccgucaccgucuccuggaacuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaagguc

SEQ ID NO: 22862 - RNA, 270 nt, Artificial Sequence
  derived and/or modified sequence opt2 from IgG1_HeavyChain_CH1_constant_domain
uccggccccuccgucuucccccucgcccccuccuccaaguccaccuccggcggcaccgccgcccucggcugccucgucaaggacuacuuccccgagcccgucaccgucuccuggaacuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaagguc

SEQ ID NO: 22863 - RNA, 270 nt, Artificial Sequence
  derived and/or modified sequence opt2 from IgG1_HeavyChain_CH1_constant_domain
uccggccccuccgucuucccccucgcccccuccuccaaguccaccuccggcggcaccgccgcccucggcugccucgucaaggacuacuuccccgagcccgucaccgucuccuggaacuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggcc

SEQ ID NO: 22864 - RNA, 270 nt, Artificial Sequence
  derived and/or modified sequence opt2 from IgG1_HeavyChain_CH1_constant_domain
uccggccccuccgucuucccccucgcccccuccuccaaguccaccuccggcggcaccgccgcccucggcugccucgucaaggacuacuuccccgagcccgucaccgucuccuggaacuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcguc

SEQ ID NO: 22865 - RNA, 270 nt, Artificial Sequence
  derived and/or modified sequence opt2 from IgG1_HeavyChain_CH1_constant_domain
uccggccccuccgucuucccccucgcccccuccuccaaguccaccuccggcggcaccgccgcccucggcugccucgucaaggacuacuuccccgagcccgucaccgucuccuggaacuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgcc

SEQ ID NO: 22866 - RNA, 270 nt, Artificial Sequence
  derived and/or modified sequence opt2 from IgG1_HeavyChain_CH1_constant_domain
uccggccccuccguccucccccucgcccccuccuccaaguccaccuccggcggcaccgccgcccucggcugccucgucaaggacuacuuccccgagcccgucaccgucuccuggaacuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaagguc

SEQ ID NO: 22867 - RNA, 270 nt, Artificial Sequence
  derived and/or modified sequence opt2 from IgG1_HeavyChain_CH1_constant_domain
uccggccccuccguccucccccucgcccccuccuccaaguccaccuccggcggcaccgccgcccucggcugccucgucaaggacuacuuccccgagcccgucaccgucuccuggaacuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggcc

SEQ ID NO: 22868 - RNA, 270 nt, Artificial Sequence
  derived and/or modified sequence opt2 from IgG1_HeavyChain_CH1_constant_domain
uccggccccuccguccucccccucgcccccuccuccaaguccaccuccggcggcaccgccgcccucggcugccucgucaaggacuacuuccccgagcccgucaccgucuccuggaacuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcguc

SEQ ID NO: 22869 - RNA, 270 nt, Artificial Sequence
  derived and/or modified sequence opt2 from IgG1_HeavyChain_CH1_constant_domain
uccggccccuccguccucccccucgcccccuccuccaaguccaccuccggcggcaccgccgcccucggcugccucgucaaggacuacuuccccgagcccgucaccgucuccuggaacuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgcc

SEQ ID NO: 22870 - RNA, 282 nt, Artificial Sequence
  derived and/or modified sequence opt2 from IgG1_HeavyChain_CH1_constant_domain
uccgccuccaccaagggccccuccgucuucccccucgcccccuccuccaaguccaccuccggcggcaccgccgcccucggcugccucgucaaggacuacuuccccgagcccgucaccgucuccuggaacuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggcc

SEQ ID NO: 22871 - RNA, 282 nt, Artificial Sequence
  derived and/or modified sequence opt2 from IgG1_HeavyChain_CH1_constant_domain
uccgccuccaccaagggccccuccgucuucccccucgcccccuccuccaaguccaccuccggcggcaccgccgcccucggcugccucgucaaggacuacuuccccgagcccgucaccgucuccuggaacuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcguc

SEQ ID NO: 22872 - RNA, 282 nt, Artificial Sequence
  derived and/or modified sequence opt2 from IgG1_HeavyChain_CH1_constant_domain
uccgccuccaccaagggccccuccgucuucccccucgcccccuccuccaaguccaccuccggcggcaccgccgcccucggcugccucgucaaggacuacuuccccgagcccgucaccgucuccuggaacuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgcc

SEQ ID NO: 22873 - RNA, 282 nt, Artificial Sequence
  derived and/or modified sequence opt2 from IgG1_HeavyChain_CH1_constant_domain
uccgccuccaccaagggccccuccguccucccccucgcccccuccuccaaguccaccuccggcggcaccgccgcccucggcugccucgucaaggacuacuuccccgagcccgucaccgucuccuggaacuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaagguc

SEQ ID NO: 22874 - RNA, 282 nt, Artificial Sequence
  derived and/or modified sequence opt2 from IgG1_HeavyChain_CH1_constant_domain
uccgccuccaccaagggccccuccguccucccccucgcccccuccuccaaguccaccuccggcggcaccgccgcccucggcugccucgucaaggacuacuuccccgagcccgucaccgucuccuggaacuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggcc

SEQ ID NO: 22875 - RNA, 282 nt, Artificial Sequence
  derived and/or modified sequence opt2 from IgG1_HeavyChain_CH1_constant_domain
uccgccuccaccaagggccccuccguccucccccucgcccccuccuccaaguccaccuccggcggcaccgccgcccucggcugccucgucaaggacuacuuccccgagcccgucaccgucuccuggaacuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcguc

SEQ ID NO: 22876 - RNA, 282 nt, Artificial Sequence
  derived and/or modified sequence opt2 from IgG1_HeavyChain_CH1_constant_domain
uccgccuccaccaagggccccuccguccucccccucgcccccuccuccaaguccaccuccggcggcaccgccgcccucggcugccucgucaaggacuacuuccccgagcccgucaccgucuccuggaacuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgcc

SEQ ID NO: 22877 - RNA, 330 nt, Artificial Sequence
  derived and/or modified sequence opt2 from IgG1_HeavyChain_CH2_constant_domain
gcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaag

SEQ ID NO: 22878 - RNA, 330 nt, Artificial Sequence
  derived and/or modified sequence opt2 from IgG1_HeavyChain_CH2_constant_domain
gcccccgagcuccucggcggccccuccgucuuccucuucccccccaagcccaaggacacccucaugaucucccgcacccccgaggucaccugcgucgucgucgacgucucccacgaggaccccgaggucaaguucaacgucuacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaag

SEQ ID NO: 22879 - RNA, 330 nt, Artificial Sequence
  derived and/or modified sequence opt2 from IgG1_HeavyChain_CH2_constant_domain
gcccccgagcuccucggcggccccuccgucuuccucuucccccccaagcccaaggacacccucaugaucucccgcacccccgaggucaccugcgucgucgucgacgucucccacgaggaccccgaggucaaguucaacgucuacgucgacggcgucgagguccacaacgccaagaccaagccccgcgaggagcaguacgccuccaccuaccgcgucgucuccguccucaccguccuccaccaggacuggcucaacggcaaggaguacaagugcaaggucuccaacaaggcccuccccgcccccaucgagaagaccaucuccaaggccaag

SEQ ID NO: 22880 - RNA, 330 nt, Artificial Sequence
  derived and/or modified sequence opt2 from IgG1_HeavyChain_CH2_constant_domain
gcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacgccuccaccuaccgcgucgucuccguccucaccguccuccaccaggacuggcucaacggcaaggaguacaagugcaaggucuccaacaaggcccuccccgcccccaucgagaagaccaucuccaaggccaag

SEQ ID NO: 22881 - RNA, 330 nt, Artificial Sequence
  derived and/or modified sequence opt2 from IgG1_HeavyChain_CH2_constant_domain
gcccccgagcuccucggcgcccccuccgucuuccucuucccccccaagcccaaggacacccucaugaucucccgcacccccgaggucaccugcgucgucgucgacgucucccacgaggaccccgaggucaaguucaacgucuacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaag

SEQ ID NO: 22882 - RNA, 330 nt, Artificial Sequence
  derived and/or modified sequence opt2 from IgG1_HeavyChain_CH2_constant_domain
gcccccgagcuccucggcgcccccuccgucuuccucuucccccccaagcccaaggacacccucaugaucucccgcacccccgaggucaccugcgucgucgucgacgucucccacgaggaccccgaggucaaguucaacgucuacgucgacggcgucgagguccacaacgccaagaccaagccccgcgaggagcaguacgccuccaccuaccgcgucgucuccguccucaccguccuccaccaggacuggcucaacggcaaggaguacaagugcaaggucuccaacaaggcccuccccgcccccaucgagaagaccaucuccaaggccaag

SEQ ID NO: 22883 - RNA, 330 nt, Artificial Sequence
  derived and/or modified sequence opt2 from IgG1_HeavyChain_CH2_constant_domain
gcccccgagcuccucggcgcccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaag

SEQ ID NO: 22884 - RNA, 330 nt, Artificial Sequence
  derived and/or modified sequence opt2 from IgG1_HeavyChain_CH2_constant_domain
gcccccgagcuccucggcgcccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacgccuccaccuaccgcgucgucuccguccucaccguccuccaccaggacuggcucaacggcaaggaguacaagugcaaggucuccaacaaggcccuccccgcccccaucgagaagaccaucuccaaggccaag

SEQ ID NO: 22885 - RNA, 330 nt, Artificial Sequence
  derived and/or modified sequence opt2 from IgG1_HeavyChain_CH2_constant_domain
gcccccgagcucgccggcggccccuccgucuuccucuucccccccaagcccaaggacacccucaugaucucccgcacccccgaggucaccugcgucgucgucgacgucucccacgaggaccccgaggucaaguucaacgucuacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaag

SEQ ID NO: 22886 - RNA, 330 nt, Artificial Sequence
  derived and/or modified sequence opt2 from IgG1_HeavyChain_CH2_constant_domain
gcccccgagcucgccggcggccccuccgucuuccucuucccccccaagcccaaggacacccucaugaucucccgcacccccgaggucaccugcgucgucgucgacgucucccacgaggaccccgaggucaaguucaacgucuacgucgacggcgucgagguccacaacgccaagaccaagccccgcgaggagcaguacgccuccaccuaccgcgucgucuccguccucaccguccuccaccaggacuggcucaacggcaaggaguacaagugcaaggucuccaacaaggcccuccccgcccccaucgagaagaccaucuccaaggccaag

SEQ ID NO: 22887 - RNA, 330 nt, Artificial Sequence
  derived and/or modified sequence opt2 from IgG1_HeavyChain_CH2_constant_domain
gcccccgagcucgccggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaag

SEQ ID NO: 22888 - RNA, 330 nt, Artificial Sequence
  derived and/or modified sequence opt2 from IgG1_HeavyChain_CH2_constant_domain
gcccccgagcucgccggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacgccuccaccuaccgcgucgucuccguccucaccguccuccaccaggacuggcucaacggcaaggaguacaagugcaaggucuccaacaaggcccuccccgcccccaucgagaagaccaucuccaaggccaag

SEQ ID NO: 22889 - RNA, 330 nt, Artificial Sequence
  derived and/or modified sequence opt2 from IgG1_HeavyChain_CH2_constant_domain
gcccccgagcucgccggcgcccccuccgucuuccucuucccccccaagcccaaggacacccucaugaucucccgcacccccgaggucaccugcgucgucgucgacgucucccacgaggaccccgaggucaaguucaacgucuacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaag

SEQ ID NO: 22890 - RNA, 330 nt, Artificial Sequence
  derived and/or modified sequence opt2 from IgG1_HeavyChain_CH2_constant_domain
gcccccgagcucgccggcgcccccuccgucuuccucuucccccccaagcccaaggacacccucaugaucucccgcacccccgaggucaccugcgucgucgucgacgucucccacgaggaccccgaggucaaguucaacgucuacgucgacggcgucgagguccacaacgccaagaccaagccccgcgaggagcaguacgccuccaccuaccgcgucgucuccguccucaccguccuccaccaggacuggcucaacggcaaggaguacaagugcaaggucuccaacaaggcccuccccgcccccaucgagaagaccaucuccaaggccaag

SEQ ID NO: 22891 - RNA, 330 nt, Artificial Sequence
  derived and/or modified sequence opt2 from IgG1_HeavyChain_CH2_constant_domain
gcccccgagcucgccggcgcccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaag

SEQ ID NO: 22892 - RNA, 330 nt, Artificial Sequence
  derived and/or modified sequence opt2 from IgG1_HeavyChain_CH2_constant_domain
gcccccgagcucgccggcgcccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacgccuccaccuaccgcgucgucuccguccucaccguccuccaccaggacuggcucaacggcaaggaguacaagugcaaggucuccaacaaggcccuccccgcccccaucgagaagaccaucuccaaggccaag

SEQ ID NO: 22893 - RNA, 330 nt, Artificial Sequence
  derived and/or modified sequence opt2 from IgG1_HeavyChain_CH2_constant_domain
gcccccgaggcccucggcggccccuccgucuuccucuucccccccaagcccaaggacacccucaugaucucccgcacccccgaggucaccugcgucgucgucgacgucucccacgaggaccccgaggucaaguucaacgucuacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaag

SEQ ID NO: 22894 - RNA, 330 nt, Artificial Sequence
  derived and/or modified sequence opt2 from IgG1_HeavyChain_CH2_constant_domain
gcccccgaggcccucggcggccccuccgucuuccucuucccccccaagcccaaggacacccucaugaucucccgcacccccgaggucaccugcgucgucgucgacgucucccacgaggaccccgaggucaaguucaacgucuacgucgacggcgucgagguccacaacgccaagaccaagccccgcgaggagcaguacgccuccaccuaccgcgucgucuccguccucaccguccuccaccaggacuggcucaacggcaaggaguacaagugcaaggucuccaacaaggcccuccccgcccccaucgagaagaccaucuccaaggccaag

SEQ ID NO: 22895 - RNA, 330 nt, Artificial Sequence
  derived and/or modified sequence opt2 from IgG1_HeavyChain_CH2_constant_domain
gcccccgaggcccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaag

SEQ ID NO: 22896 - RNA, 330 nt, Artificial Sequence
  derived and/or modified sequence opt2 from IgG1_HeavyChain_CH2_constant_domain
gcccccgaggcccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacgccuccaccuaccgcgucgucuccguccucaccguccuccaccaggacuggcucaacggcaaggaguacaagugcaaggucuccaacaaggcccuccccgcccccaucgagaagaccaucuccaaggccaag

SEQ ID NO: 22897 - RNA, 330 nt, Artificial Sequence
  derived and/or modified sequence opt2 from IgG1_HeavyChain_CH2_constant_domain
gcccccgaggcccucggcgcccccuccgucuuccucuucccccccaagcccaaggacacccucaugaucucccgcacccccgaggucaccugcgucgucgucgacgucucccacgaggaccccgaggucaaguucaacgucuacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaag

SEQ ID NO: 22898 - RNA, 330 nt, Artificial Sequence
  derived and/or modified sequence opt2 from IgG1_HeavyChain_CH2_constant_domain
gcccccgaggcccucggcgcccccuccgucuuccucuucccccccaagcccaaggacacccucaugaucucccgcacccccgaggucaccugcgucgucgucgacgucucccacgaggaccccgaggucaaguucaacgucuacgucgacggcgucgagguccacaacgccaagaccaagccccgcgaggagcaguacgccuccaccuaccgcgucgucuccguccucaccguccuccaccaggacuggcucaacggcaaggaguacaagugcaaggucuccaacaaggcccuccccgcccccaucgagaagaccaucuccaaggccaag

SEQ ID NO: 22899 - RNA, 330 nt, Artificial Sequence
  derived and/or modified sequence opt2 from IgG1_HeavyChain_CH2_constant_domain
gcccccgaggcccucggcgcccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaag

SEQ ID NO: 22900 - RNA, 330 nt, Artificial Sequence
  derived and/or modified sequence opt2 from IgG1_HeavyChain_CH2_constant_domain
gcccccgaggcccucggcgcccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacgccuccaccuaccgcgucgucuccguccucaccguccuccaccaggacuggcucaacggcaaggaguacaagugcaaggucuccaacaaggcccuccccgcccccaucgagaagaccaucuccaaggccaag

SEQ ID NO: 22901 - RNA, 330 nt, Artificial Sequence
  derived and/or modified sequence opt2 from IgG1_HeavyChain_CH2_constant_domain
gcccccgaggccgccggcggccccuccgucuuccucuucccccccaagcccaaggacacccucaugaucucccgcacccccgaggucaccugcgucgucgucgacgucucccacgaggaccccgaggucaaguucaacgucuacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaag

SEQ ID NO: 22902 - RNA, 330 nt, Artificial Sequence
  derived and/or modified sequence opt2 from IgG1_HeavyChain_CH2_constant_domain
gcccccgaggccgccggcggccccuccgucuuccucuucccccccaagcccaaggacacccucaugaucucccgcacccccgaggucaccugcgucgucgucgacgucucccacgaggaccccgaggucaaguucaacgucuacgucgacggcgucgagguccacaacgccaagaccaagccccgcgaggagcaguacgccuccaccuaccgcgucgucuccguccucaccguccuccaccaggacuggcucaacggcaaggaguacaagugcaaggucuccaacaaggcccuccccgcccccaucgagaagaccaucuccaaggccaag

SEQ ID NO: 22903 - RNA, 330 nt, Artificial Sequence
  derived and/or modified sequence opt2 from IgG1_HeavyChain_CH2_constant_domain
gcccccgaggccgccggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaag

SEQ ID NO: 22904 - RNA, 330 nt, Artificial Sequence
  derived and/or modified sequence opt2 from IgG1_HeavyChain_CH2_constant_domain
gcccccgaggccgccggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacgccuccaccuaccgcgucgucuccguccucaccguccuccaccaggacuggcucaacggcaaggaguacaagugcaaggucuccaacaaggcccuccccgcccccaucgagaagaccaucuccaaggccaag

SEQ ID NO: 22905 - RNA, 330 nt, Artificial Sequence
  derived and/or modified sequence opt2 from IgG1_HeavyChain_CH2_constant_domain
gcccccgaggccgccggcgcccccuccgucuuccucuucccccccaagcccaaggacacccucaugaucucccgcacccccgaggucaccugcgucgucgucgacgucucccacgaggaccccgaggucaaguucaacgucuacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaag

SEQ ID NO: 22906 - RNA, 330 nt, Artificial Sequence
  derived and/or modified sequence opt2 from IgG1_HeavyChain_CH2_constant_domain
gcccccgaggccgccggcgcccccuccgucuuccucuucccccccaagcccaaggacacccucaugaucucccgcacccccgaggucaccugcgucgucgucgacgucucccacgaggaccccgaggucaaguucaacgucuacgucgacggcgucgagguccacaacgccaagaccaagccccgcgaggagcaguacgccuccaccuaccgcgucgucuccguccucaccguccuccaccaggacuggcucaacggcaaggaguacaagugcaaggucuccaacaaggcccuccccgcccccaucgagaagaccaucuccaaggccaag

SEQ ID NO: 22907 - RNA, 330 nt, Artificial Sequence
  derived and/or modified sequence opt2 from IgG1_HeavyChain_CH2_constant_domain
gcccccgaggccgccggcgcccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaag

SEQ ID NO: 22908 - RNA, 330 nt, Artificial Sequence
  derived and/or modified sequence opt2 from IgG1_HeavyChain_CH2_constant_domain
gcccccgaggccgccggcgcccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacgccuccaccuaccgcgucgucuccguccucaccguccuccaccaggacuggcucaacggcaaggaguacaagugcaaggucuccaacaaggcccuccccgcccccaucgagaagaccaucuccaaggccaag

SEQ ID NO: 22909 - RNA, 318 nt, Artificial Sequence
  derived and/or modified sequence opt2 from IgG1_HeavyChain_CH3_constant_domain
ggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggc

SEQ ID NO: 22910 - RNA, 318 nt, Artificial Sequence
  derived and/or modified sequence opt2 from IgG1_HeavyChain_CH3_constant_domain
ggccagccccgcgagccccaggucuacacccucccccccucccgcgaggagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggc

SEQ ID NO: 22911 - RNA, 318 nt, Artificial Sequence
  derived and/or modified sequence opt2 from IgG1_HeavyChain_CH3_constant_domain
ggccagccccgcgagccccaggucuacacccucccccccucccgcgacgagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggc

SEQ ID NO: 22912 - RNA, 318 nt, Artificial Sequence
  derived and/or modified sequence opt2 from IgG1_HeavyChain_CH3_constant_domain
ggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggc

SEQ ID NO: 22913 - RNA, 297 nt, Artificial Sequence
  derived and/or modified sequence opt2 from IgG2_HeavyChain_CH1_constant_domain
uccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccaacuucggcacccagaccuacaccugcaacgucgaccacaagcccuccaacaccaaggucgacaagaccguc

SEQ ID NO: 22914 - RNA, 297 nt, Artificial Sequence
  derived and/or modified sequence opt2 from IgG2_HeavyChain_CH1_constant_domain
uccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccgucaccuccuccaacuucggcacccagaccuacaccugcaacgucgaccacaagcccuccaacaccaaggucgacaagaccguc

SEQ ID NO: 22915 - RNA, 327 nt, Artificial Sequence
  derived and/or modified sequence opt2 from IgG2_HeavyChain_CH2_constant_domain
gccccccccgucgccggccccuccgucuuccucuucccccccaagcccaaggacacccucaugaucucccgcacccccgaggucaccugcgucgucgucgacgucucccacgaggaccccgagguccaguucaacugguacgucgacggcgucgagguccacaacgccaagaccaagccccgcgaggagcaguucaacuccaccuuccgcgucgucuccguccucaccgucguccaccaggacuggcucaacggcaaggaguacaagugcaaggucuccaacaagggccuccccgcccccaucgagaagaccaucuccaagaccaag

SEQ ID NO: 22916 - RNA, 327 nt, Artificial Sequence
  derived and/or modified sequence opt2 from IgG2_HeavyChain_CH2_constant_domain
gccccccccgucgccggccccuccgucuuccucuucccccccaagcccaaggacacccucaugaucucccgcacccccgaggucaccugcgucgucgucgacgucucccacgaggaccccgagguccaguucaacugguacgucgacggcgucgagguccacaacgccaagaccaagccccgcgaggagcaguucaacuccaccuuccgcgucgucuccguccucaccgucguccaccaggacuggcucaacggcaaggaguacaagugcaaggucuccaacaagggccuccccgccuccaucgagaagaccaucuccaagaccaag

SEQ ID NO: 22917 - RNA, 327 nt, Artificial Sequence
  derived and/or modified sequence opt2 from IgG2_HeavyChain_CH2_constant_domain
gccccccccgucgccggccccuccgucuuccucuucccccccaagcccaaggacacccucaugaucucccgcacccccgaggucaccugcgucgucgucgacgucucccacgaggaccccgagguccaguucaacugguacgucgacggcgucgagguccacaacgccaagaccaagccccgcgaggagcaguucaacuccaccuuccgcgucgucuccguccucaccgucguccaccaggacuggcucaacggcaaggaguacaagugcaaggucuccaacaagggccuccccucccccaucgagaagaccaucuccaagaccaag

SEQ ID NO: 22918 - RNA, 327 nt, Artificial Sequence
  derived and/or modified sequence opt2 from IgG2_HeavyChain_CH2_constant_domain
gccccccccgucgccggccccuccgucuuccucuucccccccaagcccaaggacacccucaugaucucccgcacccccgaggucaccugcgucgucgucgacgucucccacgaggaccccgagguccaguucaacugguacgucgacggcgucgagguccacaacgccaagaccaagccccgcgaggagcaguucaacuccaccuuccgcgucgucuccguccucaccgucguccaccaggacuggcucaacggcaaggaguacaagugcaaggucuccaacaagggccuccccuccuccaucgagaagaccaucuccaagaccaag

SEQ ID NO: 22919 - RNA, 327 nt, Artificial Sequence
  derived and/or modified sequence opt2 from IgG2_HeavyChain_CH2_constant_domain
gccccccccgucgccggccccuccgucuuccucuucccccccaagcccaaggacacccucaugaucucccgcacccccgaggucaccugcgucgucgucgacgucucccacgaggaccccgagguccaguucaacugguacgucgacggcauggagguccacaacgccaagaccaagccccgcgaggagcaguucaacuccaccuuccgcgucgucuccguccucaccgucguccaccaggacuggcucaacggcaaggaguacaagugcaaggucuccaacaagggccuccccgcccccaucgagaagaccaucuccaagaccaag

SEQ ID NO: 22920 - RNA, 327 nt, Artificial Sequence
  derived and/or modified sequence opt2 from IgG2_HeavyChain_CH2_constant_domain
gccccccccgucgccggccccuccgucuuccucuucccccccaagcccaaggacacccucaugaucucccgcacccccgaggucaccugcgucgucgucgacgucucccacgaggaccccgagguccaguucaacugguacgucgacggcauggagguccacaacgccaagaccaagccccgcgaggagcaguucaacuccaccuuccgcgucgucuccguccucaccgucguccaccaggacuggcucaacggcaaggaguacaagugcaaggucuccaacaagggccuccccgccuccaucgagaagaccaucuccaagaccaag

SEQ ID NO: 22921 - RNA, 327 nt, Artificial Sequence
  derived and/or modified sequence opt2 from IgG2_HeavyChain_CH2_constant_domain
gccccccccgucgccggccccuccgucuuccucuucccccccaagcccaaggacacccucaugaucucccgcacccccgaggucaccugcgucgucgucgacgucucccacgaggaccccgagguccaguucaacugguacgucgacggcauggagguccacaacgccaagaccaagccccgcgaggagcaguucaacuccaccuuccgcgucgucuccguccucaccgucguccaccaggacuggcucaacggcaaggaguacaagugcaaggucuccaacaagggccuccccucccccaucgagaagaccaucuccaagaccaag

SEQ ID NO: 22922 - RNA, 327 nt, Artificial Sequence
  derived and/or modified sequence opt2 from IgG2_HeavyChain_CH2_constant_domain
gccccccccgucgccggccccuccgucuuccucuucccccccaagcccaaggacacccucaugaucucccgcacccccgaggucaccugcgucgucgucgacgucucccacgaggaccccgagguccaguucaacugguacgucgacggcauggagguccacaacgccaagaccaagccccgcgaggagcaguucaacuccaccuuccgcgucgucuccguccucaccgucguccaccaggacuggcucaacggcaaggaguacaagugcaaggucuccaacaagggccuccccuccuccaucgagaagaccaucuccaagaccaag

SEQ ID NO: 22923 - RNA, 318 nt, Artificial Sequence
  derived and/or modified sequence opt2 from IgG2_HeavyChain_CH3_constant_domain
ggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccaugcucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggc

SEQ ID NO: 22924 - RNA, 297 nt, Artificial Sequence
  derived and/or modified sequence opt2 from IgG4_HeavyChain_CH1_constant_domain
uccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcaccaagaccuacaccugcaacgucgaccacaagcccuccaacaccaaggucgacaagcgcguc

SEQ ID NO: 22925 - RNA, 330 nt, Artificial Sequence
  derived and/or modified sequence opt2 from IgG4_HeavyChain_CH2_constant_domain
gcccccgaguuccucggcggccccuccgucuuccucuucccccccaagcccaaggacacccucaugaucucccgcacccccgaggucaccugcgucgucgucgacgucucccaggaggaccccgagguccaguucaacugguacgucgacggcgucgagguccacaacgccaagaccaagccccgcgaggagcaguucaacuccaccuaccgcgucgucuccguccucaccguccuccaccaggacuggcucaacggcaaggaguacaagugcaaggucuccaacaagggccuccccuccuccaucgagaagaccaucuccaaggccaag

SEQ ID NO: 22926 - RNA, 318 nt, Artificial Sequence
  derived and/or modified sequence opt2 from IgG4_HeavyChain_CH3_constant_domain
ggccagccccgcgagccccaggucuacacccucccccccucccaggaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacucccgccucaccgucgacaagucccgcuggcaggagggcaacgucuucuccugcuccgucaugcacgaggcccuccacaaccacuacacccagaagucccucucccucucccucggc

SEQ ID NO: 22927 - RNA, 1347 nt, Artificial Sequence
  derived and/or modified sequence opt3 from AAB-003_gamma1-Chain
gaggugcagcugcucgaaagcggcgggggacuuguccaacccgguggcucccugagauugucuugcgccgcuucaggguucaccuuuaguaacuacggaaugagcuggguuaggcaggcaccuggcaaggguuuagaguggguggccuccauccggucugggggaggccgcacauauuacucggacaauguaaaaggccgauucacuauuucacgugauaacagcaagaauacgcuguaucuacagaugaacagucucagagcggaagacaccgcuguguacuauugugucagguacgaucacuauuccgggucuagcgacuacuggggacaggguacacuggugacuguuuccucagccaguaccaaaggcccaagcguguuuccgcuugcacccucuuccaagucaacaagcgggggaaccgccgcucugggcugcuuggucaaagauuacuucccugagccagugacuguaaguuggaacucuggugcacucacauccgggguucauaccuuucccgccgugcugcaaagcucgggacuguauucucucuccucagucgugacggugccuaguagcuccuuaggcacucagaccuacauauguaaugucaaucacaagccaucuaacacaaagguugacaaaaagguggaacccaaaagcugcgauaagacucauaccuguccuccaugcccggcucccgaggccgcgggcgcaccuucaguauuccuguuuccacccaaaccuaaggacacacuuaugaucagucggaccccagaggugacgugugucgugguugaugugucccacgaagaccccgaggucaaguucaauugguauguggaugggguagaaguucauaacgccaaaacuaagccgcgcgaggagcaguacaauagcacauauagaguggucucuguguugaccguccugcaccaggacuggcuaaacggaaaagaauacaagugcaaagugucaaauaaggcucucccugcccccauugagaaaacuaucaguaaggcaaagggucaaccaagggaaccucagguuuauacacugcccccaagccgggaggaaaugaccaaaaaccaggugucccuuacgugucugguaaagggcuuuuaccccucugauauugcugucgagugggagucgaaugggcagccugaaaacaacuacaaaaccacaccaccgguguuggacagcgacggauccuucuuucucuauucaaagcugacuguugauaaaagucgcuggcaacagggcaauguguucucuugcagcgucaugcacgaggccuuacauaaccacuacacccagaagucccugucacucagccccgguaag

SEQ ID NO: 22928 - RNA, 1329 nt, Artificial Sequence
  derived and/or modified sequence opt3 from Abagovomab_HeavyChain
caggugaagcugcaagagagcggcgccgaacucgcuagacccggggcauccgucaaacuuucuugcaaggccucaggauacaccuucacaaacuauuggaugcaguggguuaaacagaggccuggucagggccuggacuggaucggggcgauuuacccaggagauggcaauacucgguauacgcacaaguuuaaagguaaggcuaccuugacagccgacaagaguagcuccacugcauacaugcaauuaucuucgcuggccucagaggauagcgggguguauuacugugcucgcggagaaggcaacuaugcaugguucgccuacuggggccaggggaccacaguaaccgugaguuccgcuaaaacuacaccgcccucugucuacccucuagccccaggaagcgcggcacagaccaauuccauggugacgcucgguugccugguuaagggcuauuuucccgagccugugacugucaccuggaacucagggagucuuagcucuggagugcauacauucccagccguacugcaguccgacuuguacacucucucaagcaguguuaccgugcccucuuccacauggccuagcgaaaccgucacguguaauguggcucacccagccucgucuacuaaaguggauaagaaaauagucccgcgagacugcggcuguaagcccugcaucuguacaguuccugagguguccucaguauuuauuuucccacccaagccuaaagaugugcugaccaucacucugacaccaaaggugaccugcgucguuguggacauuaguaaagaugaccccgagguccaauuuagcugguucguggaugacguagaaguucauacggcacagacccagccgcgugaggaacaguuuaacuccacauucagaucugugagcgagcucccuaucaugcaccaagauugguuaaaugguaaggaguuuaaauguagggucaacucagcugccuuccccgcgccaauagaaaagacuaucaguaaaaccaaggggcggccuaaggcaccccagguguauacaauuccacccccuaaagagcagauggccaaggacaaagucucccugacuugcaugaucaccgacuuuuucccagaagauauuacaguggaguggcaauggaauggacagccggcugaaaacuacaagaauacccagcccaucauggacacugauggcagcuauuucguuuacucuaaacuuaacgugcagaagucaaauugggaggccggcaacacguuuacauguaguguauugcaugaggggcugcacaaucaccauaccgaaaagagccuaucccacucuccuggaaaa

SEQ ID NO: 22929 - RNA, 642 nt, Artificial Sequence
  derived and/or modified sequence opt3 from Abagovomab_LightChain
gacaucgagcugacccagagccccgccucccucucugcuucagugggcgaaacagucacuauuacgugccaagcaagugagaacauauacagcuaucuugccuggcaccagcagaagcaggggaaauccccucaacuguugguuuacaaugcgaagaccuuagcuggaggugugucuucgagauucucaggcagcgggaguggaacacauuuuucccugaaaaucaagucucuacagccagaagauuucggcauuuauuacugucagcaccauuaugguauccucccgacuuuugggggaggcaccaaacuggagauuaagagggccgacgcagcccccacaguaagcaucuucccuccauccucagaacagcuuaccaguggcggggcuagcguggucugcuuucugaacaauuucuaccccaaggauauaaacgugaaauggaagaucgacggaucugagcggcaaaaugguguuuugaacuccuggacugaucaggacucaaaagauagcacauauaguaugucuuccacccucacgcugacuaaggacgaguacgaacgccacaauagcuacaccugugaggcaacacauaaaacuucgaccucuccuauugugaaguccuuuaaccgaaaugaaugc

SEQ ID NO: 22930 - RNA, 1350 nt, Artificial Sequence
  derived and/or modified sequence opt3 from Abciximab_HeavyChain
gaggugcagcugcaacagagcggcgccgaacucgucaagcccggggcuuccguuaaacuuucuugcaccgcaucaggauucaacaucaaggacacauacgugcacuggguaaaacagagaccugagcagggucuggaauggauuggcaggauagauccagccaauggguauacuaaguacgacccgaaauuucaaggaaaggcgacgaucaccgcugauacaaguagcaacacugccuauuugcaguuauccucucugaccucggaggacacagcaguguacuauuguguccggccccuauacgauuauuacgccauggacuacuggggccaggguaccucagugacuguuagcagugcuaagacaaccgcaccuuccguguauccacucgcccccgucugcggggauacgacuggaucuagcgugacccugggcugucuuguaaaaggcuacuucccugaaccaguuacacugacuuggaacuccgggucauugaguagcggagugcauaccuuucccgcuguccuccagucugaccuguauacacuguccucaagcgugaccgugacgaguucuacuuggccuucccaaagcauuacaugcaaugucgcccacccagcgucgucuaccaagguugauaaaaagaucgagccgcgccccaaauccugugacaagacucauacaugcccuccaugucccgcaccugagcucuuagguggcccaucaguguuccuguuucccccgaagccuaaagauacccuuaugauuagucgaacgcccgaaguaaccugcguggucguggacguuagccacgaggauccagaagugaaguucaauugguacgucgacgggguggagguacauaacgccaaaacaaagccucgugaggaacaguauaauuccacuuacagaguugugucugucuugaccgugcugcaccaggacuggcuaaacggaaaagaguauaaguguaaagucagcaauaaggcucuccccgccccaaucgaaaagacaauaucaaaagcaaagggccagcccagggagccucaaguguacacucugccaccgagucgggaugaacuuaccaaaaaccagguuucccugacaugcuuggugaaggguuuuuaccccagcgacaucgcuguagagugggagucuaaugggcagccugaaaacaauuauaaaaccacuccacccguccucgauucagacggaaguuucuuucuguacagcaaguuaacgguggauaagucccgcuggcaacagggcaacguuuucucuuguucggugaugcacgaggcccugcauaaucacuauacacagaaaagccucucccuuucaccuggcaag

SEQ ID NO: 22931 - RNA, 642 nt, Artificial Sequence
  derived and/or modified sequence opt3 from Abciximab_LightChain
gacauccugaugacccagagccccuccucuaugucagugagucucggcgauacagucagcauuacuugccacgccucccaagggauaucuucgaacaucggauggcuucagcagaagccugguaaaucauucaugggccugauuuacuaugggacgaauuugguugacggagugccaagcagauuuaguggcuccgguucuggggcugauuacagcuuaaccaucuccucacuggacagugaggauuucgcagacuauuacuguguacaguaugcccaacuaccguacacauuuggaggcggcacuaagcucgaaauuaaaagggcggaugcugcccccaccgugagcaucuucccuccaucuuccgagcagcugacaucagggggagcaagcgucgugugcuuucuuaacaauuucuaucccaaggacauaaacguuaaauggaagaucgaugguagugaacggcagaauggcgugcugaacucuuggaccgaccaggauuccaaggacagcacuuacucgaugucuuccacauugacccucacgaaagaugaguacgaacgccauaauucauauacuugugaggccacccacaagacaaguacuagcccuauugucaaauccuuuaaccgaaaugagugc

SEQ ID NO: 22932 - RNA, 1341 nt, Artificial Sequence
  derived and/or modified sequence opt3 from Abituzumab_HeavyChain1
caggugcaacugcagcagagcggcggggagcucgccaagcccggagcuuccgucaaaguuucuugcaaggcaucagguuacaccuucaguagcuuuuggaugcacugggugagacaggccccuggccaagggcuugaauggaucggauauauuaacccaagguccggcuacacagaguauaaugaaauauuccgggacaaagcgacuaugacgaccgauacaucuacuucgaccgcuuacauggagcugagcucauugcgcagugaagacacagccguauauuacugugcauccuuuuuaggucgaggggccauggauuauuggggacagggcaccacugugacagucucuagcgcuuccaccaagggcccgucaguguucccccuggcaccuugcagucguagcacgucugaguccacugccgcucuagggugucucguuaaagacuacuuuccagagcccgugaccgucucauggaacagcggagcccugacaaguggugugcauacuuucccugcgguacuucagucuuccggccuguacagcuugucgucuguugugaccgucccauccucaaauuuugggacacagaccuauacgugcaacguggaucacaagcccaguaauacuaagguggacaaaacagucgaaccuaagagcuccgauaaaacccauacuuguccaccgugccccgcaccuccaguugccggacccucuguguuccucuuuccuccaaagcccaaagacacacugaugaucagcagaaccccggagguaacguguguggucguggauguuucacacgaagacccugaggugcaauucaacugguacgucgauggcguggagguacauaaugcuaagaccaagcccagggaggaacaggcccagaguacauuucggguuguguccguccugacugugguccaccaggacuggcucaacgguaaagaauauaagugcaaagugagcaauaagggguuaccagcaccuauugagaaaaccaucucuaagacaaaaggacaaccccgcgaaccacagguuuacacucugcccccuucaagagaggagaugaccaagaaccaggugagucuuacauguuugguaaagggcuucuauccaagcgauauugcugucgaaugggaguccaauggccaaccggaaaacaauuacaaaaccacucccccuaugcuggacucugacgggucguuuuuccuauauagcaagcucacgguggauaaauccagguggcagcagggaaacguuuucucaugcagugugaugcacgaggcccugcauaaucacuacacacagaagucucuuagccuguccccagguaaa

SEQ ID NO: 22933 - RNA, 642 nt, Artificial Sequence
  derived and/or modified sequence opt3 from Abituzumab_LightChain1
gacauccagaugacccaaagccccuccucucugucagccagugugggcgauagagucacaauuacuugcagggcuagccaggacauauccaacuaccucgcaugguaucagcagaagccugggaaagccccaaaacuucugaucuacuauacgucuaagauucacucgggaguuccgucacgguucagcgguaguggcuccgggaccgauuacacauuuacuaucucuagcuugcaacccgaggacauugcgaccuauuacugucagcagggaaauacauucccuuauaccuuuggccaggguacuaagguggaaaucaaacgcacaguagcugccccauccguguucauauuucccccuucagaugagcaauuaaagagugggaccgcaagcgucgugugccugcuaaacaauuucuacccacgagaagccaagguucaguggaaaguggacaacgcucuccagucuggaaauucccaggagucagucacggaacaagauagcaaggacaguacuuacucucuguccagcacccuuacacugucgaaagcagauuaugagaagcauaaaguguacgccugugagguaacucaccagggcuugucuucccccguuaccaagucauuuaaccguggcgaaugc

SEQ ID NO: 22934 - RNA, 1332 nt, Artificial Sequence
  derived and/or modified sequence opt3 from Abrilumab_HeavyChain1
caggugcaacugguccagagcggcgccgagguuaagaaacccggggcuuccgugaagguaucuugcaaagugucaggauacacccucagugaccuuagcauccacugggucagacaggcaccugguaagggccuggaauggaugggaggguucgauccacaggacggcgagacaauuuaugcccaaaaauuucaggguagggugacuaugacggaagauaccuccacagacacugcguacauggaguugucuucguuaaagucagaagauaccgcuguuuauuacugugccacagggagcaguuccucuugguucgacccguggggacagggcacccuggugacugucagcuccgcaucaacaaagggccccaguguguuuccucuagccccaugcagccggucuaccuccgagucaacggcugcacucgggugucugguaaaagauuauuuccccgagccuguuacugugagcuggaacaguggagcccuuaccucugguguccauacauuuccagcugugcugcaguccagcggcuuguacucgcucucuuccguggucacuguucccucaaguaauuucgggacccaaacauauaccugcaacguggaccacaagccuagcaauacgaaaguagauaagacuguggaacgcaaauguugcgucgaguguccaccgugccccgccccuccaguggcgggacccuccguuuuucuguucccuccaaagcccaaggacacacugaugauaucucgaaccccggaagugacuugugucgugguagauguuagccaugaggacccugaggugcaguuuaacugguacgucgauggcguggaaguccacaaugcaaaaacaaagccccgugaggaacaguucaacucaaccuuuagagugguuagugugcucacgguaguccaucaggacugguuaaaugguaaagaguacaagugcaaaguguccaacaaggggcugccagccccuaucgagaaaaccauuagcaagacaaagggacaacccagggaaccacagguuuauacucuucccccuucucgggaggaaaugaccaaaaaucaggugucauugacaugucuggucaagggcuucuacccaagugacaucgcuguggagugggaaagcaacggccaaccggagaauaacuauaaaacuacacccccuaugcuagauuccgacgggucguuuuuccucuacucuaagcugaccguagauaaaagccgcuggcagcagggaaauguguucuccugcucaguuaugcacgaagcccuucacaaccauuauacccagaagagucugucuuugagcccagguaag

SEQ ID NO: 22935 - RNA, 642 nt, Artificial Sequence
  derived and/or modified sequence opt3 from Abrilumab_LightChain1
gacauccagaugacccaaagccccuccucugugucagccagugucggcgauagaguuacaauuacuugcagggcuagccaggggauauccucuuggcuggcaugguaccagcagaaaccuggaaaagccccaaagcuccuuaucuauggugcgucgaaccuggagucaggcgugccgagccgguucaguggguccggaucuggcacggacuuuaccuugacaauuagcuccuuacaacccgaagauuucgcuaauuacuauugucagcaggccaacucauuuccuuggacuuucggucaggggaccaaaguagagaucaagcgcacaguggcagccccaagugucuuuauuuuucccccuagcgacgaacaacugaaaucuggaaccgcuuccgugguuugccuacucaauaacuucuacccacgagaggcaaaggugcaguggaaggucgauaaugcccugcagucaggcaacagccaggaaagugugacugagcaagacucuaaagauuccacauauagccuuucgucuacccugacguuguccaaggcugacuacgagaaacacaagguauaugccugugaaguuacucaucagggccucucaagucccgugaccaagagcuucaaucguggggagugc

SEQ ID NO: 22936 - RNA, 639 nt, Artificial Sequence
  derived and/or modified sequence opt3 from Abrilumab_LightChain1_variant2
cagaucgugcugacccaaagccccgccauuauguccgcuucuccuggcgagaaggugacaauaacuugcucagcaaguagcuccguuucuuacaugaacugguuccagcagaaaccagggacgucgccgaagcucuggaucuauucaaccagcaaucuugccaguggagugcccgcgagauuuuccgguucuggcagcgggacauccuacucacugacuauuaguaggauggaagcugaggacgccgcaaccuauuacugucagcaacggagcucuuauccuaacacauucggaggcgguaccaaauuggaaaucaagcgcgccgaugcugcaccaacuguauccauuuuucccccuucaagcgagcaguuaacaagugggggagccucuguggucugcuuccugaauaacuuuuacccaaaagacaucaaugugaaguggaagauagauggcuccgaacgacagaacggcguucuaaauagcuggaccgaccaggauucgaaagacucuacguauuccaugucaaguacucucacccugacaaaggaugaguacgagcgucacaacagcuacacuugugaagcuacccauaaaacauccaccucucccaucgucaagagcuucaauagaaacgagugc

SEQ ID NO: 22937 - RNA, 1347 nt, Artificial Sequence
  derived and/or modified sequence opt3 from Actoxumab_HeavyChain1
gaggugcagcugguccaaagcggcgccgaaguuaagaaauccggggagucucucaagaucucaugcaaaggaagugguuacagcuucaccuccuauuggauuggcugggugagacagaugcccgggaagggacuugaauggaugggcauauuuuacccuggugacucuucgacaagguauucacccagcuuccaggggcagguaacuaucagugcugauaaauccgugaacacggcauaccugcaauggucuagcuugaaggccuccgacaccgcgauguauuacugugcucggcgccgaaauuggggaaacgccuuugauauuuggggccagggcacaauggucacugugucaagugcaagcaccaaggggccgucuguuuuccccuuagccccuuccucaaaaagcacaaguggagguaccgcugcacugggcugccuagugaaggacuauuuuccagagcccgucacugugucuuggaacuccggggcccucacaagcggaguacacaccuucccugcuguucugcagucgucuggccuuuacucccugucaaguguggucacggugccaagcuccucuuuggguacucagaccuacaucuguaaugugaaucauaaacccagcaacacaaaggucgauaaacguguugaaccuaagucaugcgacaagacucacaccuguccaccgugccccgccccugagcuccucgggggaccaaguguguuucuguucccaccuaaaccaaaggauacacugaugauuuccagaacccccgagguaacguguguggucguggacguuagccaugaagauccggaggugaaauuuaauugguaugucgacggcguggaaguacacaacgcgaagacuaaaccuagggaggagcaauacaauucuacauaucggguugugucagucuuaaccgugcugcaucaggauuggcuuaacggcaaggaauacaaaugcaaggucaguaauaaggcauugcccgccccaaucgagaaaacuauaagcaaggcuaaagggcagccucgcgaaccccagguguauacacugccacccuccagagaggaaaugaccaagaaccaaguuucucuaacgugucucgugaaaggauucuacccuucggacaucgccguagagugggagagcaauggucagccagaaaacaauuauaagaccacaccgcccguccuggauuccgacggcucauuuuuccuuuacaguaagcugacuguggacaaaucuagguggcagcaagggaacguuuuuagcugcuccgugaugcacgaggcauugcacaaccauuacacccagaagucacucagccugucuccuggaaaa

SEQ ID NO: 22938 - RNA, 645 nt, Artificial Sequence
  derived and/or modified sequence opt3 from Actoxumab_LightChain1
gagaucgugcugacccagagccccggcacacucucccuuucuccuggggaaagagccacucugucaugcagggcuagucaaagcgucuccucuucguacuuggcaugguaucagcagaaaccaggacaggccccgcgguuacugauuuacggugcgucaagccgcgcuacgggcauacccgaccgauucaguggguccggaucuggcaccgauuuuacacuaacuaucagccgucucgagccugaagacuucgccguuuauuacugucaacaguaugguuccucaaccuggacauuugggcagggaaccaaaguggagauuaagagaacuguagcagccccaaguguguucaucuuucccccuagcgaugaacagcugaaaucuggcacagcuuccgucgugugccuucugaacaauuucuacccaagggaggcaaagguucaauggaaaguggacaacgccuugcagucaggcaauagccaggagagugucaccgaacaggauucuaaggacuccacguauagccucucgucuacucugacccuguccaaggcugauuacgagaaacacaagguguacgccugugaaguaacacaucaagggcucucaagucccguuacuaagagcuuuaaccggggagagugc

SEQ ID NO: 22939 - RNA, 672 nt, Artificial Sequence
  derived and/or modified sequence opt3 from Adalimumab_HeavyChain
gaggugcagcuggucgaaagcggcgggggacucguucaacccgguagaucccuuaggcugucuugcgccgcuucaggcuucaccuuugacgauuacgcaaugcacugggugcggcaggccccugggaagggauuggaguggguaagugcgaucacauggaacagcggccauauugacuaugcugauuccguggaaggucgcuucacuauaucucgagacaaugccaaaaacucguuauaccugcagaugaacucacuacgugcagaggauacggccgucuauuacugugcuaaggugagcuaucucaguaccgcauccucucuggacuacugggggcagggaacacuuguuacugugagcuccgccucaaccaaaggcccaagugucuuuccgcuggcucccagcucuaaguccacaucaggcgggaccgccgcguugggaugccucgugaaagauuauuucccugaaccaguaacuguuagcuggaauaguggugcacugacaucuggcgugcacaccuuucccgccguccugcaauccagcgggcucuacucguuaucuuccguggugacggucccuucaaguagccugggaacucagaccuacaucuguaauguuaaccauaagccauccaauacaaagguggacaaaaagguagagcccaaaucuugc

SEQ ID NO: 22940 - RNA, 642 nt, Artificial Sequence
  derived and/or modified sequence opt3 from Adalimumab_LightChain
gacauccagaugacccaaagccccuccucucugucagccagugugggcgauagagucacaauuacuugcagggcuagccaggggauacggaacuaccucgcaugguaucagcagaagccuggaaaagccccaaaacuucugaucuacgcggcuuccacguugcaaucugguguuccgucgcgcuucucaggcagcgggaguggaaccgacuuuacauuaacuauuuccucucugcagcccgaggauguggccaccuauuacugucagcgauauaaucgugcaccuuacacauucggccaggguaccaagguagaaaucaagagaacuguggccgcuccaagcgucuuuauuuuucccccuuccgacgagcaacuaaaaucagggacagcaagugugguuugccuccugaacaauuucuauccaagggaagccaaggugcaguggaaggucgauaacgcccuucagagcggaaauucucaggaguccgugaccgaacaagacucaaaagauagcacguacagucugucuuccacuuugacccucagcaaggcugacuacgagaaacacaagguauaugcgugugagguuacacaucagggccugucgucucccgugacuaaauccuucaaccggggcgaaugc

SEQ ID NO: 22941 - RNA, 1359 nt, Artificial Sequence
  derived and/or modified sequence opt3 from Aducanumab_HeavyChain1
caggugcaacuggucgagagcggcgggggaguugugcagcccgguagaucccucaggcuuucuugcgccgcuucaggcuucgcauuuaguagcuacgggaugcacuggguacggcaggccccuggaaagggccuggaauggguggcggucaucugguucgacgguaccaaaaaguauuacacagauuccgugaaagggcgcuuuacuauuucucgagacaacucgaagaauacguuguauuuacagaugaacacccugcgugcugaggauacagccguuuacuauugugcaagagacaggggaauaggcgcccggcgcggcccauacuauauggaugugugggggaaaggaacuaccgucacagugucaagcgcuaguaccaaggguccguccguauucccccuagcaccuucuagcaaguccacuucaggcgggacagccgcucucggaugccugguuaaagacuacuuuccagaacccgugaccgucaguuggaauagcggcgcccuuacgucuggugugcauacuuucccugcggugcugcaauccucaggguuguacagccucaguucugucguuaccgugccauccagcucgcugggaacacagacuuauaucuguaacguaaaucacaagcccucuaacaccaaaguggauaagagagucgagccuaaauccugcgacaagacacauaccuguccaccgugccccgcaccugaacugcucggcggcccaucaguguuuuuauuucccccuaagccaaaagauacgcugaugauuaguaggacucccgagguuacauguguggucguggacguaagccacgaggauccggaaguuaaguuuaauugguacguggacggggucgaggugcauaacgccaaaaccaagccucgggaggaacaguauaauuccacuuaccgcgucgugucuguucuuacaguguugcaccaggauuggcugaacggaaaagaguauaagugcaaaguaagcaauaaggcucuacccgccccaaucgaaaagaccauuucaaaagcaaagggucaaccucgagagccccaggucuacacgcucccacccaguagagaagagaugaccaaaaaccaggugucccugacaugucuuguuaagggcuucuauccuagcgacaucgcuguggaaugggagucuaaugggcagccagagaacaauuacaaaacuaccccgcccguccuggacucagauggaaguuucuucuuguacagcaagcucacaguggacaaguccagguggcaacagggcaacguauuuucuugcucggugaugcacgaagcccugcauaaccacuauacucagaaauccuuaagccugucaccuggu

SEQ ID NO: 22942 - RNA, 642 nt, Artificial Sequence
  derived and/or modified sequence opt3 from Aducanumab_LightChain1
gacauccagaugacccaaagccccuccucucugucagccagugugggcgauagagucacaauuacuugcagggcuagccaguccauaucuucguaccucaacugguaucagcagaagccugggaaagcaccaaaacuucugaucuacgccgcgagcucauugcaaaguggaguuccgucccgguucucugguagcggcuccgggacggacuuuaccuuaacaauuucaagucugcagcccgaggauuucgcuacuuauuacugucagcagagcuauucuaccccucuaacauuuggaggcgguaccaaaguggaaaucaagcgcacuguagccgcaccauccguguucauuuuucccccuucagacgagcaacucaaaagcgggacagccagugucgugugccugcuuaauaacuucuacccacgagaagcuaagguucaguggaagguggauaaugcacugcagucuggaaacucccaggagagcgucaccgaacaagacucgaaagauucuacguauuccuugucaaguacucucacccugagcaaggccgacuacgagaaacacaagguguacgcuugugagguaacacaucagggccuguccucucccguuacuaagagcuuuaaucguggcgaaugc

SEQ ID NO: 22943 - RNA, 1359 nt, Artificial Sequence
  derived and/or modified sequence opt3 from Afasevikumab_HeavyChain1
gaggugcagcuggucgaaagcggcgggggacucguucaacccgguagaucccuuaggcugucuugcgccgcuucaggcuucaccuuugacgauuacgcaaugcacugggugcggcaggccccugggaagggauuggaguggguaaguggcaucaacuggagcuccggugggauuggauaugcggacucugugaaaggccgcuucacaauaucgcgagauaaugcuaagaacucauuauaccugcagaugaauagccuacgugccgaagacacugcacucuauuacugugccagagauaucggcggguuuggagaguucuauuggaacuuuggucuguggggcagggggacgcuugucaccgugaguuccgcuucuacaaaaggaccaagcguuuucccgcuggcacccuccucaaagaguacuagcggcgguaccgccgcuuuggggugccucgugaaagacuacuuuccugaaccagucacagugucuuggaacuccggagcccugaccucaggcguacauacuuuccccgcgguucugcagagcaguggccucuauucuuuauccagcguggucacagugccuucgucuucccuggggacccaaacguacauuuguaaugugaaucacaagccaucaaacacuaaggucgauaaacggguugagcccaagaguugcgacaaaacccauacauguccuccaugcccggcacccgagcuuuugggagguccuagcguguuucuguucccacccaagccuaaagauacucuaaugaucucccgcaccccagaaguaacauguguggucguggacguuucucacgaggaucccgaagugaaguuuaauugguacgucgacggcguggagguacauaacgccaagaccaaaccgagagaggaacaguauaauagcacguacaggguugugucaguccucacugugcugcaccaggauuggcuuaacgggaaggaguauaaaugcaaggucaguaauaaagcucugccugcccccauugaaaagacaaucuccaaagcaaagggacagccacgggagccucaaguguacaccuugcccccaagccgcgaagagaugacuaagaaccagguuucucucacaugucuggugaaaggcuucuaucccucagacauagcuguagagugggaaaguaauggucagccugagaacaacuacaagaccacgccaccggucuuagacagcgauggguccuuuuuccuguauucuaaacucaccguggacaagucgcgauggcagcaaggcaauguuuucagcugcuccgugaugcacgaagcccuucauaaccacuacacacagaaaucacugaguuugucucccggaaag

SEQ ID NO: 22944 - RNA, 645 nt, Artificial Sequence
  derived and/or modified sequence opt3 from Afasevikumab_LightChain1
gagaucgugcugacccagagccccgccacacucucccuuucuccuggcgaaagagcuacucugucaugcagggcaagucaaagcguccgguccuacuuggccugguaucagcagaagccagggcaggcgccgcgcuuacugauuuacgacgcuucuaaccgagccacgggaauacccgcacguuucucggguucaggcagcgggaccgauuuuacacuaacuaucaguucccucgagccugaagacuucgccguuuauuacugucaacagagaucuaauuggccacccgcuaccuuuggaggcgguacaaaaguggagauuaagaggaccguagcagccccuagcguguucaucuuuccacccuccgaugaacagcugaaaucagggacugcuagugucgugugccuucugaacaauuucuauccucgggaggccaagguucaguggaaaguggacaacgcguugcaaagcggaaauucucaggaguccgucacagaacaggauucaaaggacagcaccuacagucucucuuccacgcugacucugagcaaggcagauuaugagaaacacaagguguacgccugugaaguaacccaucagggccucucgucuccaguuacaaaauccuuuaaccgcggcgagugc

SEQ ID NO: 22945 - RNA, 1293 nt, Artificial Sequence
  derived and/or modified sequence opt3 from Aflibercept_Fusion_protein1
agcgacaccggcagacccuucguggagauguacuccgaaaucccugagauuauacacaugacagaagggagggagcuggucaucccaugccggguuacuucuccgaacauuacggugacccucaagaaauuuccccuugauacacugaucccugacggaaagcgcauuaucugggauucacgaaaagguuucauaaucaguaaugccacuuauaaggaaauuggcuuguuaaccugugaggcuacaguaaacgggcaucuguacaaaaccaauuaucuaacucaccgucagacaaacaccaucauugacgugguccucagcccaucccauggaaucgagcugucugugggcgaaaaguugguucugaauugcacggcaagaacugaguugaacguggguauagauuuuaauugggaauaccccucgucaaagcaccaacauaaaaagcucgucaacagggaccugaaaacccagagcgggagugagaugaagaaauuccuguccacacucacuauugauggagugacccggucugaccagggcuuauauacaugugccgcgagcuccggccugaugaccaagaaaaauucaacguuuguacgcguucacgagaaggauaagacucacacaugcccuccaugucccgcuccugaacuucuugggggaccaaguguguuccuguuuccgcccaaaccuaaggacacccuaaugaucagcagaacuccagaggucacaugcgugguggucgauguuucucaugaagaccccgaggugaaauucaacugguacguagaugguguggaaguccacaaugccaagaccaaaccuagggaggagcaguauaacuccacguaccgggugguuucagugcucaccguccugcaucaagacuggcuuaauggcaaggaauacaaguguaaagugagcaacaaggcacugccagcccccauugagaaaacaaucaguaaggcuaaagggcagccgcgcgaaccucagguauauacuuugcccccaucucgagacgagcucaccaagaaucagguuucccugacaugcuuagugaagggauuuuacccuagcgauaucgcagucgaaugggagucgaacggccaacccgagaacaauuauaaaacuaccccacccgugcuggacucugaugguuccuucuuucucuacucaaaacuuacagucgacaagaguagauggcagcaggggaacguguucagcuguuccguuaugcacgaagcccugcacaaucauuauacccagaagucuuugagccuaucaccugga

SEQ ID NO: 22946 - RNA, 1332 nt, Artificial Sequence
  derived and/or modified sequence opt3 from Afutuzuab_HeavyChain1
caggugcaacugguccagagcggcgccgagguuaagaaacccggguccucugugaagguaucaugcaaagcuaguggauacgcauucagcuauuccuggaucaacugggugagacaggccccuggucagggccucgaaugggggaggauuuuuccaggagacggcgauaccgacuacaaugguaaguucaaagggcgggucacaauaacugcggauaagucuacgucgaccgcuuaugagcuuucaagccugcgcagugaagacacagccguguacuauugugcacgaaacguuuuugauggauacugguugguguauuggggccaaggcacuuuagucaccguguccucugccagcacaaaggggccguccguauucccccuggcuccuucaaguaaaagcaccucuggagguacugcagcccuaggcugccucguuaaggacuacuuuccagagcccgugacagucuccuggaauaguggggcucugaccagcggagugcacacguucccugccgugcuucagaguucuggccuguacuccuugagcucggucguuacugugccaucuuccucacucgguacccagacauauaucuguaacguaaaucauaaacccaguaacacuaagguggauaaaaaggucgaaccuaagagcugcgacaaaacccacacauguccaccgugccccgcgccugagcugcucgggggaccauccguguuucuguuucccccuaagccaaaagauaccuuaauuucucguacgcccgagguuacuuguguggucguggacguaagccaugaagauccggagguuaaguuuaauugguacguggacggcgucgaagugcacaacgcaaaaacaaagccuagagaggagcaguauaauucaaccuacagggucgugaguguucugacugugcuucaucaagauugguugaacggcaaagaauauaagugcaagguauccaauaaagcccugcccgcuccaaucgagaagacaauuagcaaagccaaggggcagccucgggaaccccaggucuacacccuaccacccucucgcgacgagcucacgaaaaaccaggugucacugaccugucuuguuaagggauucuauccuagugacaucgcaguggaaugggagagcaauggucaaccagagaacaauuacaagacaacuccgcccguccuggauuccgacggcucuuucuucuuguacucgaaacucaccguggauaagagcagauggcagcaggggaacguauuuuccugcucagugcacgaagcucugcacaaccauuauacacaaaaaucauuaucucugagcccugga

SEQ ID NO: 22947 - RNA, 651 nt, Artificial Sequence
  derived and/or modified sequence opt3 from Afutuzuab_LightChain1
gacaucgugacccagacaccccugagccucccugucacuccaggcgagccggccuccauuucuugcagaucaaguaagagccuucugcacuccaacgggauaacguacuuguauugguacuuacaaaaacccggacagucuccucagcugcuaaucuaucagucgaaucucguuucaggugugccagauagguucagcggcaguggguccggaaccgacuuuacacugaagauuucucggguagaagcugaggaugugggcgucuacuauugugcacaaaaccuugaacugcccuacacuuucggugggggaaccaaaguggagaucaagcgcacaguugccgcgccuagcguguuuauuuucccacccuccgacgaacaguugaaaucaggcaccgcuagugucgugugccuccugaauaacuuuuauccucgagaggccaagguacaguggaagguugauaaugcacugcagagcggcaacucucaagaguccgugacugaacaggacucaaaagauagcacauacagucucucuuccaccuuaacgcugagcaaggccgacuacgagaaacauaaggucuaugcuugugaagugacucaccaggggcuuucgucuccagugaccaaauccuucaaucguggagagugc

SEQ ID NO: 22948 - RNA, 1347 nt, Artificial Sequence
  derived and/or modified sequence opt3 from Afutuzumab_HeavyChain1
caggugcaacugguccagagcggcgccgagguuaagaaacccggguccucugugaagguaucaugcaaagcuaguggauacgcauucagcuauuccuggaucaacugggugagacaggccccuggucagggccucgaauggauggggaggauuuuuccaggagacggcgauaccgacuacaaugguaaguucaaagggcgggucacaauaacugcggauaagucuacgucgaccgcuuauauggagcuuucaagccugcgcagugaagacacagccguguacuauugugcacgaaacguuuuugauggauacugguugguguauuggggccaaggcacuuuagucaccguguccucugccagcacaaaggggccguccguauucccccuggcuccuucaaguaaaagcaccucuggagguacugcagcccuaggcugccucguuaaggacuacuuuccagagcccgugacagucuccuggaauaguggggcucugaccagcggagugcacacguucccugccgugcuucagaguucuggccuguacuccuugagcucggucguuacugugccaucuuccucacucgguacccagacauauaucuguaacguaaaucauaaacccaguaacacuaagguggauaaaaaggucgaaccuaagagcugcgacaaaacccacacauguccaccgugccccgcgccugagcugcucgggggaccauccguguuucuguuucccccuaagccaaaagauaccuuaaugauuucucguacgcccgagguuacuuguguggucguggacguaagccaugaagauccggagguuaaguuuaauugguacguggacggcgucgaagugcacaacgcaaaaacaaagccuagagaggagcaguauaauucaaccuacagggucgugaguguucugacugugcuucaucaagauugguugaacggcaaagaauauaagugcaagguauccaauaaagcccugcccgcuccaaucgagaagacaauuagcaaagccaaggggcagccucgggaaccccaggucuacacccuaccacccucucgcgacgagcucacgaaaaaccaggugucacugaccugucuuguuaagggauucuauccuagugacaucgcaguggaaugggagagcaauggucaaccagagaacaauuacaagacaacuccgcccguccuggauuccgacggcucuuucuucuuguacucgaaacucaccguggauaagagcagauggcagcaggggaacguauuuuccugcucagugaugcacgaagcucugcacaaccauuauacacaaaaaucauuaucucugagcccuggaaag

SEQ ID NO: 22949 - RNA, 657 nt, Artificial Sequence
  derived and/or modified sequence opt3 from Afutuzumab_LightChain1
gacaucgugaugacccagacaccccugagccucccugucacuccaggcgagccggccuccauuucuugcagaucaaguaagagccuucugcacuccaacgggauaacguacuuguauugguacuuacaaaaacccggacagucuccucagcugcuaaucuaucagaugucgaaucucguuucaggugugccagauagguucagcggcaguggguccggaaccgacuuuacacugaagauuucucggguagaagcugaggaugugggcgucuacuauugugcacaaaaccuugaacugcccuacacuuucggugggggaaccaaaguggagaucaagcgcacaguugccgcgccuagcguguuuauuuucccacccuccgacgaacaguugaaaucaggcaccgcuagugucgugugccuccugaauaacuuuuauccucgagaggccaagguacaguggaagguugauaaugcacugcagagcggcaacucucaagaguccgugacugaacaggacucaaaagauagcacauacagucucucuuccaccuuaacgcugagcaaggccgacuacgagaaacauaaggucuaugcuugugaagugacucaccaggggcuuucgucuccagugaccaaauccuucaaucguggagagugc

SEQ ID NO: 22950 - RNA, 684 nt, Artificial Sequence
  derived and/or modified sequence opt3 from Alacizumab_pegol_HeavyChain1
gaggugcagcuggucgaaagcggcgggggacucguucaacccgguggcucccuuagacugucuugcgccgcuucaggguucaccuuuaguagcuacggaauguccugggugaggcaggcaccuggcaaggguuuggaguggguagccacaaucacuucugggggaucguauacguacuauguggacucagucaaaggccgguucaccauuagccgcgauaacgcgaagaauacauuauaccugcagaugaacagucuacgagcugaagacacugccguguauuacuguguucguauaggcgaggaugcacucgacuauugggggcagggaacccuggugacagucuccucugccagcaccaaagguccauccguguuuccgcuugcucccucaaguaagagcacuucuggcgggacagcagcccugggaugcuugguaaaagauuacuucccugaaccaguuaccguguccuggaacucaggcgcucucacgagcgguguccacacuuuucccgccgugcugcaaaguucugggcuguacucccucagcucgguggucaccguuccuucuuccucauuaggaacacagacuuauaucuguaaugugaaucauaagccaaguaacaccaagguagacaaaaagguggagcccaaaagcugcgauaagacacacaccugugcggca

SEQ ID NO: 22951 - RNA, 642 nt, Artificial Sequence
  derived and/or modified sequence opt3 from Alacizumab_pegol_LightChain1
gacauccagaugacccaaagccccuccucucugucagccagugugggcgauagagucacaauuacuugcagggcuagccaggacauagcagggucccucaacuggcuucagcagaagccuggaaaagccaucaagcggcugauuuacgcgacgucuucguuggauucagguguuccaaaacgcuucagcggcagucgauccgggucugacuauaccuuaacaaucagcucccugcaaccggaggauuuugcuacuuacuauugucuacaguacggaucauuucccccuaccuucggccaggguacaaagguggaaauuaaacguaccguagccgcaccaaguguguucaucuuucccccuagcgacgagcagcucaagucugggacugccuccgucgugugccugcuuaauaacuucuauccaagagaagcuaagguucaauggaaaguggauaaugcacugcagucaggaaacagccaggagagugucacagaacaggacucuaaggauuccaccuacagcuugucgucuacgcucacucuguccaaagccgacuaugagaagcacaaaguguacgcuugugagguaacccaucaaggccugucaagucccguuacaaagagcuuuaauaggggcgaaugc

SEQ ID NO: 22952 - RNA, 1353 nt, Artificial Sequence
  derived and/or modified sequence opt3 from Alemtuzumab_HeavyChain
caggugcaacugcaggagagcggccccgggcucgucagaccuucccagacccuuucucugacaugcacuguuucaggauucacguuuaccgacuucuacaugaacugggugaggcagccaccgggucggggcuuggaauggaucggguuuauucgcgauaaggccaaaggauauacaacugaguacaaucccaguguaaagggccgagugaccauguuagucgacacaagcaaaaaccaauucucccugcgucuaucuucggugaccgcugcagauacugccguuuauuacugugcgagagaaggucacacagcugccccuuuugacuauugggggcagggaucacucgugaccgucagcagugcauccacgaagggcccaucuguguucccccuggccccuagcuccaaaucaacuucuggcgggaccgcugcacuuggaugccugguaaaggauuacuuuccagagcccguuacagugagcuggaauaguggugccuugacuuccggcguccauaccuucccugcugugcuccagucaagcgggcuguauagucugucuuccguggucacaguuccaagcucgucucucggaacccagacguacauauguaacgugaaucacaagccguccaacacuaaaguagacaagaaaguggaacccaagucaugcgauaaaacacauaccuguccuccaugccccgccccugaguuacugggcgguccaagugucuuucuuuuucccccgaagccuaaggacacuuugaugaucagcaggacacccgaggugaccuguguuguggucgaugugucccacgaagacccagagguaaaauucaauugguacguugaugggguggaaguccauaacgcgaagacgaaaccucgggaggagcaauauaauucuaccuaccgcguggucagcgugcugacaguucuacaccaggacuggcucaacggaaaggaauauaaaugcaaggugucaaauaaagcacugcccgccccaauugagaagacuaucaguaaggcuaaaggccagcccagagaaccucagguauacacccuuccaccguccagggaugagcugacaaagaaccaagucagcuugacuugucucgugaaaggcuucuaucccucugacauugccguugaaugggagucaaaugggcagccugagaacaauuacaagaccacaccacccgugcuggacagugaugguagcuuuuucuuauauuccaaacugaccgucgacaagucucgguggcagcaaggaaacguguucucgugcagcguaaugcacgaagcacuccauaaccacuacacucagaagucccuuucacugaguccuggcaaa

SEQ ID NO: 22953 - RNA, 657 nt, Artificial Sequence
  derived and/or modified sequence opt3 from Alemtuzumab_HeavyChain_variant_1bey_H
caggugcaacugcaggagagcggccccgggcucgucagaccuucccagacccuuucucugacaugcacuguuucaggauucacguuuaccgacuucuacaugaacugggugaggcagccaccgggucggggcuuggaauggaucggguuuauucgcgauaaggccaaaggauauacaacugaguacaaucccaguguaaagggccgagugaccauguuagucgacacaagcaaaaaccaauucucccugcgucuaucuucggugaccgcugcagauacugccguuuauuacugugcgagagaaggucacacagcugccccuuuugacuauugggggcagggaucacucgugaccgucagcagugcauccacgaagggcccaucuguguucccccuggccccuagcuccaaaucaacuucuggcgggaccgcugcacuuggaugccugguaaaggauuacuuuccagagcccguuacagugagcuggaauaguggugccuugacuuccggcguccauaccuucccugcugugcuccagucaagcgggcuguauagucugucuuccguggucacaguuccaagcucgucucucggaacccagacguacauauguaacgugaaucacaagccguccaacacuaaaguagacaagaaagug

SEQ ID NO: 22954 - RNA, 660 nt, Artificial Sequence
  derived and/or modified sequence opt3 from Alemtuzumab_HeavyChain_variant_1ce1_H
caggugcaacugcaggagagcggccccgggcucgucagaccuucccagacccuuucucugacaugcacuguuucaggauucacguuuaccgacuucuacaugaacugggugaggcagccaccgggucggggcuuggaauggaucggguuuauucgcgauaaggccaaaggauauacaacugaguacaaucccaguguaaagggccgagugaccauguuagucgacacaagcaaaaaccaauucucccugcgucuaucuucggugaccgcugcagauacugccguuuauuacugugcgagagaaggucacacagcugccccuuuugacuauugggggcagggaucacucgugaccgucagcagugcauccacgaagggcccaucuguguucccccuggccccuagcuccaaaucaacuucuggcgggaccgcugcacuuggaugccugguaaaggauuacuuuccagagcccguuacagugagcuggaauaguggugccuugacuuccggcguccauaccuucccugcugugcuccagucaagcgggcuguauagucugucuuccguggucacaguuccaagcucgucucucggaacccagacguacauauguaacgugaaucacaagccguccaacacuaaaguagacaagaaaguggaa

SEQ ID NO: 22955 - RNA, 1311 nt, Artificial Sequence
  derived and/or modified sequence opt3 from Alemtuzumab_HeavyChain_variant_8005_H
caggugcaacugcaggagagcggccccgggcucgucagaccuucccagacccuuucucugacaugcacuguuucaggauucacguuuaccgacuucuacaugaacugggugaggcagccaccgggucggggcuuggaauggaucggguuuauucgcgauaaggccaaaggauauacaacugaguacaaucccaguguaaagggccgagugaccauguuagucgacacaagcaaaaaccaauucucccugcgucuaucuucggugaccgcugcagauacugccguuuauuacugugcgagagaaggucacacagcugccccuuuugacuauugggggcagggaucacucgugaccgucagcagugcauccacgaagggcccaucuguguucccccuggccccuagcuccaaaucaacuucuggcgggaccgcugcacuuggaugccugguaaaggauuacuuuccagagcccguuacagugagcuggaauaguggugccuugacuuccggcguccauaccuucccugcugugcuccagucaagcgggcuguauagucugucuuccguggucacaguuccaagcucgucucucggaacccagacguacauauguaacgugaaucacaagccguccaacacuaaaguagacaagaaaguggaagcccccgaguuacugggcgguccuucagucuuucuuuucccacccaagccuaaagauacauugaugaucaguaggaccccagaggugacuugcguuguggucgacgugagccaugaagaucccgagguaaaguuuaauugguacguugacgggguggaaguccacaacgcgaagacaaaaccgcgggaggagcaauauaauuccaccuaccgcguggucucugugcugacgguucuacaucaggauuggcucaacggaaaggaauauaaauguaaggugagcaauaaagcacugccugcccccauugagaagaccaucucaaaagcuaagggccagccaagagaaccucagguauacacacuucccccaaguagggacgagcugacuaagaaccaagucuccuugaccugccucgugaaaggcuucuaucccagcgauauugccguugaaugggagucuaaugggcagccugagaacaauuacaagacaacuccaccggugcuggacucagacggaaguuucuuuuuauauagcaaacugaccgucgauaagucccgguggcagcaagguaacguguucucuuguucgguaaugcacgaagcacuccacaaccauuacacacagaaaagccuuucccugucacccggcaag

SEQ ID NO: 22956 - RNA, 633 nt, Artificial Sequence
  derived and/or modified sequence opt3 from Alemtuzumab_LightChain
gacauccagaugacccaaagccccuccucucugucagccagugugggcgauagagucacaauuacuugcaaggcuagccagaacauagacaaauaccucaauugguaucagcagaagccugggaaagcaccaaaacuucugaucuacaacacgaauaacuugcaaaccggaguuccguccagguucucugguucgggcucagggacagauuuuacuuucaccauuagcaguuuacagcccgaggacaucgccacauauuacugucugcagcacauuucccggccucgcaccuuuggacagggcacuaagguggaaaucaagcgaacaguagcggcuccaucuguguucauauuucccccuagcgaugagcaacuaaaguccgguaccgccucagucgugugccuccugaauaacuucuauccacgugaagcaaaaguucaguggaagguggacaaugcccuucagagugggaacagccaggagucugucacggaacaagauuccaaagacucaacuuacagccugaguucuaccuugacacucuccaaggcugauuaugagaaacauaagguguacgcaugugagguaacucaccagggacugagcucgcccguuaccaagucuuuuaauaga

SEQ ID NO: 22957 - RNA, 642 nt, Artificial Sequence
  derived and/or modified sequence opt3 from Alemtuzumab_LightChain_variant_8005_L
gacauccagaugacccaaagccccuccucucugucagccagugugggcgauagagucacaauuacuugcaaggcuagccagaacauagacaaauaccucaauugguaucagcagaagccugggaaagcaccaaaacuucugaucuacaacacgaauaacuugcaaaccggaguuccguccagguucucugguucgggcucagggacagauuuuacuuucaccauuagcaguuuacagcccgaggacaucgccacauauuacugucugcagcacauuucccggccucgcaccuuuggacagggcacuaagguggaaaucaagcgaacaguagcggcuccaucuguguucauauuucccccuagcgaugagcaacuaaaguccgguaccgccucagucgugugccuccugaauaacuucuauccacgugaagcaaaaguucaguggaagguggacaaugcccuucagagugggaacagccaggagucugucacggaacaagauuccaaagacucaacuuacagccugaguucuaccuugacacucuccaaggcugauuaugagaaacauaagguguacgcaugugagguaacucaccagggacugagcucgcccguuaccaagucuuuuaauagaggcgaaugc

SEQ ID NO: 22958 - RNA, 1341 nt, Artificial Sequence
  derived and/or modified sequence opt3 from Alirocumab_HeavyChain1
gaggugcagcuggucgaaagcggcgggggacucguucaacccgguggcucccuuagacugucuugcgcugcuucaggguucaccuuuaacaauuacgcaaugaacugggugaggcaggccccuggaaagggcuuggacuggguaaguacaaucagcgguuccgggggaacuacgaauuaugcggauucugugaaaggccgguucauuauaucgcgcgacucaagcaagcacaccuuauaccugcagaugaacagucuacgagcugaggauacagccgucuauuacugugcaaaagacuccaauuggggcaacuuugaucucugggggcguggaacucuggugaccguuucuagcgccuccacaaaggguccaucaguguucccgcuugcucccaguagcaaaucuaccuccggcgggacugcagcccugggaugcuuggucaaggacuauuuuccugaaccagugacaguaucauggaauagcggcgcucucaccagugguguucauacguuccccgccgugcugcagucuuccgggcuguacagccucucgucugucgugacugugccuuccucaaguuuaggaacccaaacauauaucuguaacgucaaucacaagccaagcaacacuaaaguugauaagaaaguggagcccaaguccugcgacaaaacccauacauguccuccaugcccggcgcccgaacugcuuggcggcccuucuguauuuuuguucccacccaagccuaaggauacccugaugauuagcagaacgccagaggugacuugugucgugguugacgugucacacgaggaucccgaagucaaauuuaauugguacguggacgggguagagguucauaacgcaaagacaaaaccgagggaggaacaguacaauaguaccuaucggguggucuccgugcuaacuguccuccaccaggauuggcugaacggaaaggaguacaaaugcaaggugagcaauaaagcccuuccugcucccaucgaaaagacaauuucuaaggccaaaggucagccacgcgagccucaaguuuauacccugcccccaucaagagacgaauugacgaagaaccaggugagucucaccugucugguaaaaggcuucuaccccagcgacaucgcagucgagugggaauccaacgggcagccugagaauaacuauaagacaacuccaccgguguuagauucugacggaucguuuuuccuguacagcaaacucaccguugauaaguccagguggcagcaaggcaauguguuuucaugcagugucaugcacgaggcccuucauaaccacuauacacagaagucucugagcuugucccccggu

SEQ ID NO: 22959 - RNA, 660 nt, Artificial Sequence
  derived and/or modified sequence opt3 from Alirocumab_LightChain1
gacaucgugaugacccagagccccgauucccuggccgucucucucggcgagagagcuacaauuaacugcaagucaagucaaagcguucuuuacagguccaauaaccggaauuuccuggggugguaucagcagaaaccuggacagccaccgaacuuguuaauauacugggcaucuacucgcgaaucgggugugcccgaccgauuuucaggcagcgggaguggaacggauuucacccugacaaucuccucucuacaagccgaggacguagcgguguauuacugucagcaguauuacacuaccccuuauacauuuggccaggguaccaagcucgaaauuaaacguacugucgcugccccaagcguguucaucuuucccccuuccgaugagcaacugaagucagggacagcaaguguugugugccuucugaauaacuucuacccaagagaagccaaaguccaguggaagguggacaaugcuuugcagagcggaaacucucaggaguccguaaccgagcaagauucaaaggacagcacguacagucucucuuccacucugacccugagcaaagcagauuaugaaaagcacaaaguuuacgccugugaggugacacaucagggccucucgucucccgucacuaaguccuuuaauaggggcgaaugc

SEQ ID NO: 22960 - RNA, 735 nt, Artificial Sequence
  derived and/or modified sequence opt3 from ALX-0061_HeavyChain1
gaggugcagcuggucgaaagcggcgggggacucguucaacccgguggcucccuuagacugucuugcgccgcuucagggaguguguucaagaucaacguaauggcaugguacaggcaggccccuggaaaaggccgggaguugguggcggguauuauaagcgggggauccaccucuuaugcugacucggucaagggccgcuuuacaaucucacgagauaaugccaaaaacacuuuauaccugcagaugaauagccuacguccagaagacacggcaguguauuacugugccuucauuaccacagagagugauuaugaccucggcagaagguacugggggcagggaacucugguuaccguguccucugguggcgggggaagcggcgguggguccgaaguccaacuuguggagucaggaggcggccugguacagccggggaacaguuugcggcucagcugcgcugcaucuggauuuacauucuccucauuugguaugagcuggguucgccaggcccccggcaaggggcuggagugggugaguucuaucuccggaagcggcucggauacccuguaugcugacucugucaaagguagauucacuauuuccagggauaaugccaagacaacccucuacuuacagaugaacucacugcggccugaagacacggcgguguacuauuguacuaucgggggcagucuuagccgcuccucucaaggaaccuuggugacagucagcuca

SEQ ID NO: 22961 - RNA, 1347 nt, Artificial Sequence
  derived and/or modified sequence opt3 from Amatuximab_HeavyChain1
caggugcaacugcagcagagcggccccgagcucgaaaagccuggggccuccgucaaaaucucuugcaaggcuucaggauacaguuucaccgguuauacaaugaacuggguuaaacagagccacggcaagucccuugaguggauugggcugauaacuccauacaauggagcaucuucguauaaccaaaaauuuagaggcaaggccacguugaccguggacaagucaagcaguacagcguacauggauuuacugucccuaacuucugaagacagcgcuguauauuucugugccagggguggguacgauggacggggcuuugacuauuggggcuccgggaccccggugacagucucaagugcaagcaccaaaggacccucuguguucccucucgccccauccucaaagagcaccagugguggcacagcugcacuggggugccuuguuaaagauuacuuucccgagccugugaccgucucuuggaacuccggagcccugacgagcggcgugcauacuuucccagcuguauugcagucgucuggucucuacucccugucaaguguugugaccguccccagcuccucucuggggacacagacuuauaucuguaaugugaaucacaagccuagcaacaccaaaguggacaagaaggucgaaccaaaaucaugcgauaagacacauaccuguccgcccugcccugccccagagcucuuaggaggccccaguguuuuucuguucccuccaaaacccaaggacacgcuuaugauuucccgcacuccggaggugacauguguaguggucgaugugagccacgaagacccugagguuaaauuuaauugguacguggauggcgucgaagugcauaacgcgaagaccaaaccccgagaggagcaguauaauucuacuuaccguguaguuucaguguugacaguccugcaccaagacuggcuaaacgggaaggaauauaagugcaaagugaguaauaaggcacucccagccccuaucgagaaaaccauuagcaaggcuaaaggacagcccagagaaccacaggucuacacgcugcccccuuccagggaugagcuuaccaagaaccaggugucucugacauguuugguuaaggguuucuauccaucggacaucgccguggaaugggagagcaauggccaaccggagaacaauuacaaaacuacucccccuguacucgacuccgaugggucauuuuuccuguacaguaaguuaacagucgacaaaucucgguggcagcagggaaacguguuuagcugcuccguuaugcacgaagcacugcauaaccacuauacucaaaagucacucagccuuucuccaggcaaa

SEQ ID NO: 22962 - RNA, 639 nt, Artificial Sequence
  derived and/or modified sequence opt3 from Amatuximab_LightChain1
gacaucgagcugacccagagccccgccauuauguccgcuucuccuggcgaaaaggugacaaugacuugcucagcaaguagcuccgucucuuacaugcacugguaucaacagaaaucggggacgucaccaaagagauggauauacgauaccagcaaacucgccaguggaguuccggguagguucuccggcucugggagcggaaacuccuauucacuuacaaucaguagcguggaggcggaagacgaugcuacuuacuauugucagcaguggucuaagcauccccugaccuuuggcuccgguacaaaaguagagauuaagcggaccguggccgcaccuucagucuucaucuuuccacccagcgacgaacaauugaagagugggacugccucugugguuugcuuacugaauaacuucuacccucgcgaggcuaaagugcaguggaaggucgauaaugcacuacaguccggaaacagccaggagucggugacagaacaagacucuaaagauuccaccuauucacucaguagcacgcugacucuuuccaaggccgacuacgagaaacacaagguauacgcuugugaaguuacccaucagggccugucuagcccagugacaaagucauuuaaucgaggcgagugc

SEQ ID NO: 22963 - RNA, 1350 nt, Artificial Sequence
  derived and/or modified sequence opt3 from Anetumab_ravtansine_HeavyChain1
cagguggagcugguccaaagcggcgccgaaguuaagaaacccggggagucccucaagaucucuugcaaaggaucagguuacaguuucaccagcuauuggauuggcugggugagacaggcuccugggaagggacuugaauggaugggcauaaucgacccaggugauuccaggacacgguacucuccgucguuucaggggcagguaacuauuucagcagacaaaagcaucaguacggccuaucugcaaugguccucuuugaaggcgagcgauaccgcuauguacuauugugcccgcggacaguuauacggcggcacauauauggacggguggggacaggguacucuggugaccgucuccucagcaaguacaaagggccccagcguguucccucuagccccaucuuccaaaucaaccagcgggggaacugcugcacucggcugccugguuaaggauuacuuucccgagccugugacagucaguuggaacucuggugcccuuaccuccggggugcacacguucccagcuguacugcagagcucgggauuguacucucucuccucaguugugacuguccccaguagcucccugggcacccaaacauauauuuguaaugugaaccauaaaccuucuaauacuaagguggacaaaaaggucgaaccaaagagcugcgauaaaacccacacauguccgcccugcccugccccagagcugcucggcgggcccucaguuuuucucuucccuccaaagcccaaagacacccugaugaucagucgaacgccggaggugacuuguguaguggucgaugugucccaugaagacccugagguuaaguuuaacugguacguggauggagucgaagugcacaaugcgaaaacaaagccccgugaggagcaguauaacagcaccuacagaguaguuucugugcuuacugucuugcaucaggacuggcugaaugguaaagaauauaagugcaaggugucaaacaaagcacuaccagccccuauagagaagacaaucaguaaagcuaagggccagcccagggaaccacaagucuacaccuuacccccuagccgggaugagcugacgaaaaaucaggugucccuuaccugucugguuaagggguucuauccaucugacauugccguggaaugggagucgaacggacagccggagaauaacuacaagacaacucccccuguauuggacagcgauggcuccuuuuuccucuacucaaaacugaccgucgacaagagucgcuggcaacaggguaauguguuuucuugcagcguuaugcacgaagcauuacacaaccauuauacacagaaaucccugucacucagcccagggaag

SEQ ID NO: 22964 - RNA, 651 nt, Artificial Sequence
  derived and/or modified sequence opt3 from Anetumab_ravtansine_LightChain1
gacaucgcccugacccagcccgcuagcguguccggcucuccugggcaaucaauuacaauaaguugcacuggaacgagcuccgauaucgguggcuacaacucugucucgugguaucagcagcacccagggaaggcaccgaaacucaugauuuacggaguuaauaacagacccucaggcgugagcaauagguucagugguuccaagucugggaacaccgccagccuuacaaucuccggacugcaggcggaggacgaagcugauuauuacuguucaaguuaugacauugagagcgccacuccuguauuuggcggcgggaccaaauugacaguguuaggacaaccaaaggcagcccccucugucacccuguucccuccauccucagaggaacuacaggcuaauaaagcaacucucgugugccugaucagcgauuuuuaccccggugccguuacaguggcuuggaagggcgacaguucuccugucaaggccgggguggaaaccacgacuccauccaaacagagcaacaauaaguaugcggcaucgucuuaccuuucccugaccccggagcaguggaaaucacaucggaguuacagcugucaaguaacacacgagggauccacuguugaaaagaccguggcccccacagagugcucu

SEQ ID NO: 22965 - RNA, 1341 nt, Artificial Sequence
  derived and/or modified sequence opt3 from Anifrolumab_HeavyChain1
gaggugcagcugguccaaagcggcgccgaaguuaagaaacccggggagucccucaagaucucuugcaaaggaucagguuacauuuucaccaacuauuggauagcuugggugagacagaugccuggcaaggggcuugaaaguaugggaaucauuuacccaggcgacagcgauaucagguauuccccgucuuuucagggucagguaacaauuucggcagacaaaucaaucacuacggccuaccugcaauggagcaguuugaaggcguccgauaccgcuauguauuacugugcccggcacgacauagagggguucgauuauuggggacgcggcacauuagugacugucucuagcgcauccaccaagggccccucaguguuuccucuggccccaaguagcaaaucuacauccgggggaaccgcugcacuagguugccucguuaaggacuacuuccccgaaccugugacugucucauggaauagcggcgcccugacaaguggggugcauaccuuuccagcuguacuucagucuuccggacuguacagcuugucgucuguugugacgguccccuccucaagucucggcacucagaccuauaucuguaacgugaaucacaaaccuagcaacacaaagguggauaaacgagucgagccaaaguccugcgacaagacucauaccuguccgcccugcccugccccagaguucgaaggugggcccucuguuuuucuguucccuccaaaacccaaggauacacugaugauuagccguaccccggaggugacguguguaguggucgacgugucacacgaagauccugagguuaaauuuaauugguacguggacggagucgaggugcauaacgcgaagacuaaacccagagaggaacaguauaauaguacauacaggguaguuuccgugcucaccgucuuacaccaagauuggcugaacggcaaggaauauaaaugcaaggugagcaauaaggcacuuccagccucuaucgagaaaacuauuucaaaggcuaaaggccagccucgggaaccccaggucuacacauugccacccagucgcgaggagaugaccaagaaccaggugagccugacgugucuaguuaaaggguucuauccuuccgacaucgccguggaaugggagucuaauggacaaccagaaaacaauuacaagaccacaccgcccguacucgacucggaugguagcuuuuuccuguacuccaaacuuacugucgacaagucaagauggcagcagggcaacguguuuaguugcucuguuaugcacgaggcacugcauaaucacuauacccaaaagagcuugucccucucaccugggaaa

SEQ ID NO: 22966 - RNA, 645 nt, Artificial Sequence
  derived and/or modified sequence opt3 from Anifrolumab_LightChain1
gagaucgugcugacccagagccccggcacacucucccuuucuccuggggaaagagccacucugucaugcagggcuagucaaagcgucuccucuucguucuuugcaugguaccagcagaagccaggacaggccccgcgguuguuaauuuauggugcgucaagccgcgcuacgggcauacccgaccgacugaguggguccggaucuggcaccgauuucacacuaacuaucacccgucucgagccugaagacuuugccguuuacuauugucaacaguacgauagcuccgcaauuacauucggucaggggaccagacuggagaucaaaaggacuguggccgcuccaucaguauuuauuuuucccccuagugacgaacagcuuaagagcggaacagcaucuguggucugccuguugaacaauuucuauccacgggaggccaaagugcaauggaagguugauaacgcucuccaguccggcaauucacaggagagcgugaccgaacaggacaguaaagauucuacguacucccugagcucgacucugacccucucuaaggccgacuaugagaagcacaaagucuacgcgugugaagugacacaucaaggcuuauccucacccguaacuaagaguuucaaccgcggggagugc

SEQ ID NO: 22967 - RNA, 1344 nt, Artificial Sequence
  derived and/or modified sequence opt3 from Anrukinzumab_HeavyChain1
gaggugcagcuggucgaaagcggcgggggacucguucaacccgguggcucccuuagacugucuugcgccgcuucaggguucaccuuuaucaguuacgcaaugagcugggugaggcaggccccuggaaagggcuuggaguggguagcguccauuucuucgggugggaacacauauuacccagacucagugaaaggacgguucacuauaagccgcgauaaugcuaagaacaguuuauaucugcagaugaacucccuacgagccgaagacacggcagucuacuauugugcccgucucgauggcuacuauuuuggcuucgcuuacugggggcagggaacccuggugacaguuucuagcgcauccacuaaagguccgucaguguuuccccuugccccuaguagcaagucuaccuccggcgggacagcugcccugggaugcuuggucaaagacuacuucccagagcccgugaccguaucauggaauagcggcgcgcucacaagugguguucacacauuuccugcagugcugcaaucuuccgggcuguauagccucucgucugucgugaccgugccauccucaaguuuaggaacgcagacuuacaucuguaaugucaaccauaagcccagcaauaccaagguugauaaaaagguggaaccuaaauccugcgacaagacacacacuuguccaccgugccccgccccugaggcucugggcgccccaucuguauuccuuuuucccccuaaaccaaaggauaccuugaugauuagcagaacacccgaggugaccugugucgugguugacgugucacaugaagauccggaggucaaguucaacugguauguggacggcguagaaguucacaaugcaaaaacgaagccuagggaggagcaguacaacaguacuuaucggguggucuccgugcugacaguccuacaucaggauuggcucaaugggaaagaauacaagugcaaagugagcaacaaggcucugcccgccccaaucgagaaaaccauuucuaaggcgaagggacaaccucgcgaaccccagguuuauacucuuccacccucaagagaggaaaugacuaaaaaucaggugagucugaccuguuugguaaaggguuuuuacccuagcgacaucgccgucgagugggaguccaacggccagccagaaaauaacuacaaaacgaccccgcccgugcucgauucugacgggucguucuuucuguauagcaaguuaacaguugacaaauccagguggcaacagggaaacguguucucaugcagugucaugcacgaggcacugcacaaucauuacacucagaagucucucagccuuuccccuggcaag

SEQ ID NO: 22968 - RNA, 654 nt, Artificial Sequence
  derived and/or modified sequence opt3 from Anrukinzumab_LightChain1
gacauccagaugacccaaagccccuccucucugucagccagugugggcgauagagucacaauuacuugcaaggcuagcgaguccguugacaacuacgggaaaucucucaugcacugguaucagcagaagccuggaaaagcaccaaaacuucugauauacagggccucgaauuuggaaucaggugugccgagccgguucaguggcuccgggucuggaacggauuuuaccuuaacaaucagcucccugcagcccgaggacuucgcgacuuauuacugucaacagucaaacgaagauccuuggaccuuuggcggugggacaaagguagagauuaagcgcaccguggcugccccaagugucuucaucuuucccccuagcgacgaacagcuaaagucuggaacugcauccgugguuugccuccugaauaacuucuauccacgagaggccaaagugcaguggaaggucgauaaugcacuucaaucaggcaacagccaggagagugugacagaacaggacucuaaagauuccaccuacagccugucgucuacguugacucucuccaaggcugacuaugagaaacauaagguauacgccugugaaguuacccaccagggccugucaagucccgugacaaagagcuuuaaucguggggagugc

SEQ ID NO: 22969 - RNA, 1338 nt, Artificial Sequence
  derived and/or modified sequence opt3 from Apolizumab_HeavyChain1
caggugcaacugcaggagagcggccccgggcucgucaagccuuccgaaacccuuucucugacaugcacuguuucaggauucaguuugacgaacuacggugugcacuggguaagacagagcccaggcaaaggguuagaguggaucggagugaagugguccggcgguucuaccgaauauaaugccgcuuuuauuucgaggcugacaauaucaaaagacacuagcaagaaccaggucagucuaaaacucaauucccugaccgcagccgauacagcgguguacuauugugcucggaacgaccgcuacgccauggauuauugggggcaaggaacccuuguuacugugucuagcgcauccacaaagggcccgucagucuucccccuggccccuaguagcaagucuaccuccggcgggacggcugcauugggaugccucgugaaagacuacuuuccagagcccguaacuguuucauggaauagcggugcccugaccaguggcgugcauacauucccugcuguccugcagucuuccgggcucuauagcuuaucgucuguggugacugucccauccucaagucugggaacccagacauacaucuguaacguuaaucacaagcccagcaacaccaaaguggauaagaaaguagaaccuaaguccugcgacaagacgcauacuuguccaccgugccccgccccugagcuuuugggcgguccaucuguguuucuguuucccccuaaaccaaaggauacacuaaugauuagccgaacccccgaggucacuugugugguuguggacgucucacacgaagauccggaggugaaauucaauugguacguagacgggguugaagugcauaacgcgaagacaaaaccucgugaggagcaguauaauaguaccuacagagucguguccguccucacggugcugcaccaagauuggcuuaacggaaaggaauauaaaugcaagguuagcaauaaggcacugcccgccccaaucgagaaaaccauuucuaaggcuaaaggccagccuagggaaccccagguguacacauugccacccucacgggacgagcucacuaagaaccagguaagucugaccuguuuagucaaaggcuucuauccuagcgauaucgccguggaaugggaguccaaugggcaaccagagaacaacuacaagacaacuccgcccguucuggacucugacggaucguuuuuccucuauagcaaacuuaccguggauaagucccgcuggcagcaggguaaugucuuuucaugcagugugaugcacgaagcacugcauaaccacuacacacaaaagucuuugagccuauccccuggcaaa

SEQ ID NO: 22970 - RNA, 642 nt, Artificial Sequence
  derived and/or modified sequence opt3 from Apolizumab_LightChain1
gacauccagaugacccaaagccccuccucucugucagccagugugggcgauagagucacaauuacuugcagggcuagcgagaacauauacuccuaucucgcaugguaccagcagaagccugggaaagccccaaaacuucugguuucuaaugcgaagacguuggcugaaggagugccgucgcgguucucagguagcggcagugggaagcaguuuaccuuaacaaucuccucucugcaacccgaggacuucgccacuuauuacugucagcaccauuauggaaacagcuacccuuuuggccaggguaccaaacuagaaauuaagcgcacaguagcagccccauccguguucaucuuucccccuucagaugagcagcucaagagugggaccgcuagcgucgugugccugcuuaauaacuucuauccacgagaagcaaaaguucaauggaagguggacaaugcccugcagucuggaaacucccaggagucagucacugagcaggauagcaaagacaguacauacucuuuguccagcacccucacgcugucgaaggcugauuacgaaaaacacaagguguaugccugugagguaacucaucaaggccugucuucccccguuaccaagucauuuaaucguggcgaaugc

SEQ ID NO: 22971 - RNA, 378 nt, Artificial Sequence
  derived and/or modified sequence opt3 from Apomab_HeavyChain
gaggugcagcugguccagagcggcgggggaguugaaagacccgguggcucccucaggcuuucuugcgccgcuucaggguucaccuuugacgauuacgcaaugugggugcggcaggccccuggaaagggccuggaguggguaagugguaucaauuggcaagggggaagcacaggcuaugcggacuccgugaaaggccgcgucacuauuucucgagauaaugcuaagaacucguuguacuuacagaugaacucacugcgugccgaagacacggcaguguauuacugugccaaaauacuaggggcuggaagagguugguauuucgauuacuggggcaaggggaccacaguuacugugagcagugcauccaccaaaggacca

SEQ ID NO: 22972 - RNA, 324 nt, Artificial Sequence
  derived and/or modified sequence opt3 from Apomab_LightChain
agcgagcugacccaggaccccgccguguccgucgcucucggccaaacaguuagaaucacuugcucuggggauucacuuaggaguuacuaugcaagcugguaccagcagaagccuggacaggccccagugcugguaauuuauggugcgaacaaucggccguccggcauacccgaccgcuucucugggucgucaagcggaaacacggcuaguuugaccaucacaggcgcccaagcagaagaugaggccgacuacuauuguaauuccgcugauucuagcgguaaccacguggucuuugggggaggcacuaaauuaaccgugcugggc

SEQ ID NO: 22973 - RNA, 645 nt, Artificial Sequence
  derived and/or modified sequence opt3 from Aquaporumab_LightChain
gagaucgugcugacccagagccccggcacacucucccuuucuccuggggaaagagccacucugucaugcagggcuagucaaacgguccggaccaacuacuuggcaugguuccagcagaagccaggacaggccccgcgcuuacugauuuuuggugcgagcucccgagcuacaggcauacccgaccguuucucugggucgggaucaggcacugauuuuacccuaacaaucagcagacucgagccugaagacuucgccguuuauuacugucaacaguaugguaguuccccauggaccuuugggcagggaacuaaaguggagauuaagaggacaguagcagcccccucuguguucaucuuuccuccaagcgaugaacagcugaaauccggcaccgcuucagucgugugccuucugaauaacuucuacccccgggaggcaaagguucaauggaaaguggacaaugccuugcagaguggcaacagccaggagucugucacggaacaggauuccaaggacucaacuuauagccucaguucuacccugacacuguccaaggcugauuacgagaaacacaagguguaugccugugaaguaacucaucaagggcucagcucgccuguuaccaaaucuuuuaaucgcggagagugc

SEQ ID NO: 22974 - RNA, 1326 nt, Artificial Sequence
  derived and/or modified sequence opt3 from Arcitumomab_99tc_HeavyChain
gaggugaagcuggucgaaagcggcgggggacucguucagcccgguggcucccuuagacugucuugcgccaccucaggguucacauuuacugacuacuauaugaacugggugaggcaaccuccaggaaaggcuuuggagugguuaggcuucaucgguaauaaagcaaacggguacacgaccgaauauagugccagcguaaaaggacgguuuacaauuucccgcgauaagucucagucgauacuguaccuacagaugaauacucuccgagcggaggacucagcuaccuauuacuguacacgugauagaggccugagguucuauuuugacuacuggggccaggggaccacucuuacagugagcagugccaaaaccacgccgcccuccgucuacccucuggcaccaggaucugccgcucaaacuaacagcauggugaccuuggguugccucguuaagggcuauuuccccgaaccugugacagucacuuggaacuccgggucacugaguagcggagugcacaccuuuccagcaguacugcagucugaucucuacacauuauccucaagcguuaccgugcccaguucuccucggccauccgagacggucacuuguaauguggcccauccggcuagcucgacaaagguggacaaaaagaucgucccccgcgauugcccuccauguaaaugccccgccccuaaucugcuuggcgguccaucuguuuucauuuuucccccgaagaucaaagacguguugaugauuucccugucaccuaucguaaccuguguggucguggauguuagugaggacgaucccgacgugcagauaagcugguucgucaacaauguggaaguacacacugcgcagacacaaacccauagagaggauuauaacuccacgcuaaggguugugucugcacucccaauccagcaccaggacuggaugagcgggaaggaauuuaagugcaaagucaauaacaaggaccugccugcccccauugagcggaccaucucaaaaccaaagggaagugugcgcgcuccccaggucuacgugcuuccuccaccggaggaagagaugacuaaaaagcaaguuacacugaccuguauggugacagauuucaugcccgaagacauuuauguagaguggacuaauaacggcaaaaccgaauugaauuacaagaacacagagccuguccucgauuccgacggcagcuauuuuauguacucuaagcugcgaguggagaaaaagaacuggguugaaagaaauucauacaguugcagcgugguccaugagggguuacacaaccaccauaccacuaaauccuucucuagg

SEQ ID NO: 22975 - RNA, 639 nt, Artificial Sequence
  derived and/or modified sequence opt3 from Arcitumomab_99tc_LightChain
cagaccgugcugagccaaucccccgccauccucucugcuucaccuggcgagaaagucacaaugacuugcagagcaaguagcuccguuacguacauucacugguaucagcagaaaccagggucuucgccgaagucauggauauacgccaccagcaaccuugcgaguggagugcccgcuagguucuccgguucuggcagcgggacauccuauucacugacuaucagucggguagaagccgaggacgcagccaccuacuauugucagcauuggagcucuaaaccuccaacauuuggaggcgguaccaaguuggaaauuaaacgcgcugaugcagcccccacuguguccaucuucccuccaucaagcgagcaauuaacaagugggggagcuucugucgugugcuuucugaauaacuucuaccccaaggacauuaauguuaaguggaaaaucgauggcuccgaacgacagaacggcgugcuaaauagcuggaccgaccaggauucgaaggacucuacguauuccaugucaaguacucucacccugacaaaagaugaguacgagcgucacaacagcuacacuugugaagccacccauaagacauccaccucuccuauagucaagagcuuuaauagaaacgagugc

SEQ ID NO: 22976 - RNA, 1329 nt, Artificial Sequence
  derived and/or modified sequence opt3 from Ascrinvacumab_HeavyChain1
caggugcaacugcaggagagcggccccgggcucgucaagccuucccagacccuuucucugacaugcacuguuucaggagguaguaucagcuccggcgaauacuauuggaacuggauuagacagcacccagggaaaggauuggaguggauaggcuacaucuauuacucugguucgacguauuacaauccgucauuaaagagcagggugaccauuaguguagacacauccaaaaaccaauucucucugaagcuaagcuccgugacugccgcugauaccgcagucuauuacugugcccgggaaucaguggcgggguuugacuacuggggacagggcacacucguuaccgugaguagcgcuucuacuaaaggccccuccgucuucccucuggccccaugcucacgcagcacaagugagucuaccgcagcccuugggugucuggugaaggauuauuuucccgaaccuguaacgguuuccuggaauagcggagcuuugacuucgggugugcauaccuucccagcaguccuccagucuuccggccuguacucacugaguagcguggugacaguccccuccucuaacuuugggacucagaccuauacaugcaauguugaccacaagccuagcaacaccaaaguggauaagacgguagagcgaaaauguugcguggaguguccaccgugccccgccccuccagucgcuggacccucaguguuccucuuuccuccaaagcccaaagacacuuuaaugaucagucguacaccggaaguuaccuguguggucguggauguaucccaugaggacccugaaguucaauucaauugguacguggauggcgucgaggugcacaacgccaagacuaagcccagagaggaacaguuuaauagcacauucagggucgugucuguucugaccgugguacaucaggacuggcuuaacgguaaagaguauaagugcaaagucucaaauaagggguugccagcgccuauugagaaaacgaucaguaagaccaaaggacagccccgggaaccacaaguguacacacugcccccuagccgcgaagagaugacuaagaaccagguuucccuaaccugucucgugaagggcuuuuauccaucugauauagcagucgagugggaaucgaauggccagccggagaacaauuacaaaacaacucccccuaugcuggacagcgauggguccuucuuucuuuacucaaagcugaccguggacaaaaguagauggcaacagggaaacguauucucuugcagcgugaugcacgaagccuugcacaaccauuauacacagaagucccucucacugagcccaggu

SEQ ID NO: 22977 - RNA, 645 nt, Artificial Sequence
  derived and/or modified sequence opt3 from Ascrinvacumab_LightChain1
gagaucgugcugacccagagccccggcacacucucccuuucuccuggggaaagagccacucugucaugcagggcuagucaaagcgucuccucuucguacuuggcaugguaucagcagaagccaggacaggccccgcgguuacugauuuacgguacgucaagccgcgcgaccggcauacccgaccgauucaguggguccggaucuggcacagauuuuacucuaaccaucagccgucucgagccugaagacuucgcuguuuauuacugucaacaguaugguuccucaccaauuacauuugggcagggaaccagacuggagaucaaaaggacuguggccgcacccaguguauucauuuuuccuccaagcgaugaacagcuuaagucuggcacagccuccguggucugccuguugaacaauuucuacccccgggaggcuaaagugcaauggaagguugacaacgcacuccagucaggcaauagccaggagagugugaccgaacaggauucuaaagacuccacguauagccugucgucuacucugacccucuccaaggccgauuacgagaagcacaaagucuacgcuugugaagugacacaucaaggguuaucaaguccuguaacuaagagcuuuaaccgcggagagugc

SEQ ID NO: 22978 - RNA, 1314 nt, Artificial Sequence
  derived and/or modified sequence opt3 from Aselizuab_HeavyChain1
gaggugcagcuggucgaaagcggcgggggacucguucaacccgguggcucccuuagacugucuugcgccgcuucaggguucaccuuuaguacauacgcaagcugggugaggcaggccccuggaaagggcuuggaguggguagcguccaucucuacuggugggucgacguauuacccagacucagugaaaggacgguucaccauuagccgcgauaacgcuaagaauacauuauaucugcagaacagucuacgagccgaagacacugcagucuacuauugugcccgugauuacgacggcuauuuugauuacuggggccaggggacccucgugacaguuuccucugcuagcaccaaaggaccguccguguucccccuggcaccuugcucaagaaguacuagcgagucuacagccgcucuugguugucuggucaaggacuacuuuccagaacccgugaccguauccuggaacucaggcgccuugacgagcgggguucacacuuucccugcggugcuccaaaguucuggacuguauucccugagcucggucgugaccgugccaucuuccucacucggcacaaaaacuuauaccugcaaugucgaucauaagcccaguaauacaaagguugacaaaaggguggagagcaaguacgguccuccauguccguccugccccgcaccugaguuuuuagggggaccaucuguauuccuguuucccccuaaaccaaaggauacccuuauaagccggacgcccgaagugacuugugucgugguugacgugucacaggaggauccggaaguccaguucaacugguacguggacggcguagagguucacaaugccaaaacaaagccucgcgaggaacaguuuaacaguaccuauagaguggucuccguguugacuguccugcaucaagauuggcuaaauggcaaggaguacaaaugcaaggugagcaacaaagggcuccccucuucaaucgaaaagacaauuaguaaagcuaagggacagccaagggagccucagguuuauacccugcccccaagccaggaagagacgaaaaaucaagugucccuuaccugucugguaaaggguuucuaccccucugacaucgccgucgagugggaaucgaacggccagccugagaauaacuacaagacaacuccaccgguguuggacagcgauggguccuuuuuccucuauucacggcugaccguugacaaaagucgcuggcaggaaggaaauguguucucuugcagcguccacgaggcauuacauaaccacuacacacaaaagucccugucacucagccuuggcaaa

SEQ ID NO: 22979 - RNA, 1311 nt, Artificial Sequence
  derived and/or modified sequence opt3 from Aselizuab_HeavyChain2
gaggugcagcuggucgaaagcggcgggggacucguucaacccgguggcucccuuagacugucuugcgccgcuucaggguucaccuuuaguacauacgcaagcugggugaggcaggccccuggaaagggcuuggaguggguagcguccaucucuacuggugggucgacguauuacccagacucagugaaaggacgguucaccauuagccgcgauaacgcuaagaauacauuauaucugcagaacagucuacgagccgaagacacugcagucuacuauugugcccgugauuacgacggcuauuuugauuacuggggccaggggacccucgugacaguuuccucugcuagcaccaaaggaccguccguguucccccuggcaccuugcucaagaaguacuagcgagucuacagccgcucuugguugucuggucaaggacuacuuuccagaacccgugaccguauccuggaacucaggcgccuugacgagcgggguucacacuuucccugcggugcuccaaaguucuggacuguauucccugagcucggucgugaccgugccaucuuccucacucggcacaaaaacuuauaccugcaaugucgaucauaagcccaguaauacaaagguugacaaaaggguggagagcaaguacgguccuccauguccguccugccccgcaccugaguuuuuagggggaccaucuguauuccuguuucccccuaaaccaaaggauaccauaagccggacgcccgaagugacuugugucgugguugacgugucacaggaggauccggaaguccaguucaacugguacguggacggcguagagguucacaaugccaaaacaaagccucgcgaggaacaguuuaacaguaccuauagaguggucuccgugcuuacugucuugcaucaagauuggcugaauggcaaggaguacaaaugcaaggugagcaacaaagggcuacccucuucaaucgaaaagacaauuaguaaagcuaagggacagccaagggagccucagguuuauacccugcccccaagccaggaagagacgaaaaaucaagugucccucaccugucuuguaaaggguuucuaccccucugacaucgccgucgagugggaaucgaacggccagccugagaauaacuacaagacaacuccaccggugcuggacagcgauggguccuuuuucuuguauucacggcucaccguugacaaaagucgcuggcaggaaggaaauguguucucuugcagcguccacgaggcacugcauaaccacuacacacaaaaguccuuaucacugagccucggcaaa

SEQ ID NO: 22980 - RNA, 648 nt, Artificial Sequence
  derived and/or modified sequence opt3 from Aselizuab_LightChain1
gacauccagacccaaagccccuccucucugucagccagugugggcgauagagucacaauuacuugcaaggcuagccaguccguugacuacgauggggacucuuauaacugguaccagcagaaaccuggaaaggcaccaaaacuccuuauauaugccgcgucgaaucuggagucagguaucccgagcagguucaguggcuccgggucuggaacggauuuuaccuugacaauuagcuccuuacaacccgaagacuucgcuacuuacuauugucagcagucaaacgaggauccuuggaccuuuggccaggguacaaagguggaaaucaaacggaccguagccgcaccaaguguguucauuuuucccccuagcgacgagcaacugaagucugggacugccuccgucgugugccuacucaauaacuucuacccacgcgaagcuaagguucaguggaaaguggauaaugcacugcagucaggaaacagccaggagagugucacagagcaagacucuaaggauuccaccuauagccuuucgucuacgcugacuuuguccaaagccgacuacgaaaagcacaaaguguacgcuugugagguaacccaucagggccucucaagucccguuacaaagagcuuuaaucgaggcgaaugc

SEQ ID NO: 22981 - RNA, 1344 nt, Artificial Sequence
  derived and/or modified sequence opt3 from Atezolizumab_HeavyChain1
gaggugcagcuggucgaaagcggcgggggacucguucaacccgguggcucccuuagacugucuugcgccgcuucaggguucaccuuuagugacagcuggauccacugggugaggcaggcaccuggaaagggcuuggaguggguagccuggauuuccccauacggugggucuacauauuacgcggauucggugaaaggacgguucacuauaucagcugacacgagcaagaacaccgccuauuuacagaugaauagucugcgcgcagaagauacagccgucuacuauugugcucgacgucauuggccgggcggcuuugacuacugggggcagggaacucuagugaccguuuccucugcaagcacaaaaggucccuccguguucccucucgccccaucaaguaagagcaccucuggcgggacugcugcccugggaugccuugucaaagauuauuuucccgagccugugacaguauccuggaacucaggcgcgcugaccagcgguguucacacguucccagcaguguugcaaaguucugggcucuacucccugagcucggucgugacugugcccucuuccucacugggaacccagacauacaucuguaaugucaaccauaagccuaguaauacuaagguugacaaaaagguggaaccaaaaagcugcgauaagacccacacauguccgcccugcccugccccagagcucuuaggcggccccuccguauuucuguucccuccaaaacccaaggacacccuuaugauuucuagaacgccggaggugacuugugucgugguugaugugagccaugaagacccugaggucaaguuuaacugguauguggaugggguagaaguucacaaugcuaaaacaaagcccagggaggagcaguacgccucaaccuaucggguggucaguguguugacuguccugcaccaggacuggcuaaacggaaaagaauacaagugcaaaguguccaauaaggcacucccagcuccuaucgagaaaacaauuagcaaggccaagggucaaccccgcgaaccacagguuuauacccugcccccuucuagagaggaaaugacgaaaaaccaggugucacuuaccugucugguaaagggcuucuacccaagugauaucgcggucgagugggagagcaaugggcagccggaaaacaauuauaaaacaacucccccuguguuggacuccgacggaucuuucuuucucuacucgaagcugaccguugauaaauccagguggcaacagggcaacguguuuagcugcucagucaugcaugaggccuuacacaaucauuacacacagaagagucugucucucagcccagguaag

SEQ ID NO: 22982 - RNA, 642 nt, Artificial Sequence
  derived and/or modified sequence opt3 from Atezolizumab_LightChain1
gacauccagaugacccaaagccccuccucucugucagccagugugggcgauagagucacaauuacuugcagggcuagccaggacguuuccacggcaguggccugguaccagcagaagccugggaaagcgccaaagcuccuuauauauucugcuucguuccuguacucaggaguaccgagccgguuuagugguuccggcucugggaccgauuucacauugacuaucagcuccuuacaacccgaggacuuugccaccuauuacugucagcaguaucuguaccacccugcaacauucggacagggcaccaaaguggaaauuaagcgcacugucgccgcuccaucaguguuuaucuuucccccuagugaugagcaacuaaaaagcgguacagcaucuguugugugccuccugaacaauuucuauccacgagaagccaagguccaguggaagguggacaacgcccuucaguccggaaauucacaggagagcguaaccgaacaagauaguaaagacucuacguacucccugagcucgacuuugacccucucuaaggcugauuacgagaaacauaagguuuaugcgugugaggugacacaccaggggcuguccucacccgucacuaaaaguuucaaccguggcgaaugc

SEQ ID NO: 22983 - RNA, 1323 nt, Artificial Sequence
  derived and/or modified sequence opt3 from Atinumab_HeavyChain1
gaggugcagcuggucgaaagcggcgggggacucguucaacccgguggcucccuuagacugucuugcgccgcuucaggguucaccuuuaguaacuacuggaugagcugggugaggcaggcaccuggaaagggcuuggaguggguagccacaaucaaacaggacgguucccagaagaauuauguggauucugucaaagggcgguucacuauuucgcgcgacaacgcgaaaaauucauuauaccugcgacuaaacagccuccgugcugaagauacggccguguauuacugugcaaccgagcuguuugaccuuuggggaagaggcagucugguuacaguguccucugccagcacuaagggcccauccgucuucccguuggcucccugcucaaggaguaccagcgaaucuacagcagcccucgggugucuggugaaggauuauuuuccugagccaguaaccguuuccuggaacucaggagcucugacuagcggugugcacacauuccccgccguccuccaaaguucuggcuuauacucccugagcucgguggugaccgucccuucuuccucacuugggacgaagacuuauaccugcaauguugaccauaaaccaaguaauacaaagguggauaaacggguagagagcaaguacggacccccuuguccauccugcccggcgcccgaauuuuugggcgguccuucuguguuccuguuuccacccaaaccuaaggacacucuaaugauaagccgcaccccagaggucacaugugugguuguggaugucucacaggaagaccccgaggugcaguucaacugguacguagaugggguugaggugcacaaugcaaagaccaaaccgagagaggaacaguuuaacaguacguauagggucguguccguccucacugugcugcaucaagacuggcuuaauggaaaggaauacaaaugcaagguuagcaacaaaggccugccuucuucaaucgagaagacaauuaguaaagccaagggccagccccgggaaccacagguguauaccuugccucccagccaggaggagaugacuaagaaucaaguaucccucacaugucuggucaaaggguucuacccaucugauaucgcuguggaaugggagucgaacggacagcccgaaaauaacuauaagaccacgccuccaguuuuagacagcgacgguuccuuuuuccuguacucacgccucaccguggauaaaagucgauggcaggagggcaacgucuucucuugcagcgugaugcacgaagcccuucauaaucacuauacacaaaagucccugucauugagccuagggaaa

SEQ ID NO: 22984 - RNA, 642 nt, Artificial Sequence
  derived and/or modified sequence opt3 from Atinumab_LightChain1
gagaucgugcugacccagagccccgccacacucucccuuucuccuggcgaaagagcuacucugucaugcagggcaagucaaagcgucuccucuuacuuggccugguaucagcagaagccagggcaggcgccgcgguuacugauuuacgacgcuucgaaccgcgccacgggaauacccgcacgauucucagguagcggcagugggaccgauuuuacacuaacuaucuccucucucgagccugaagacuucgccguuuauuacugucaacagcguagcaauuggccaauuaccuuuggacagggcacaaaacuggagaucaagagaaccguggcugcacccuccguauucauuuuuccuccaucagaugaacagcuuaaaagugguacugccagcguggucugccuguugaacaauuucuaucccagggaggcuaaggugcaauggaaaguugacaacgcccuccagucuggaaauucccaggagucagugacagaacaggauagcaaggacaguaccuacucucuguccagcacgcugacucucucgaaggcggauuaugagaaacacaaggucuacgcaugugaagugacccaucaaggguuaucuuccccuguaacaaaaucauuuaaccggggcgagugc

SEQ ID NO: 22985 - RNA, 1329 nt, Artificial Sequence
  derived and/or modified sequence opt3 from Atlizuab_HeavyChain1
gugcagcugcaagagagcggccccgggcucgucagaccuucccagacccuuucucugacaugcacuguuucaggauacaguaucacgagcgaccacgccugguccugggugaggcagccaccgggucggggcuuggaauggauuggguauauaucuuacucgggaaucaccacauauaaccccucauuaaaaagccgcguaacucugcgagauaccaguaaaaaucaguucucccuacgucucucuagcgugacagcugcagacaccgccgucuacuauugugcgagaucccuggcuaggacuacagccgauuacuggggccaagguucacuugugaccguuaguagcgcaucuacgaaggggccuuccguguuuccacuggcccccucaagcaaaaguacuucuggaggcaccgcugcauugggcugccucgucaaggacuauuucccugagccagugacaguauccuggaacagcggggcccugacuucgggaguucauaccuuucccgcugugcugcagucuuccggucucuacucauuaaguagcgucgugacagugccuuccucuagccugggcacccagacguacauuuguaaugucaaccacaaaccaucaaauacuaagguugauaagaaaguggaaccgaagaguugcgacaaaacacauaccugucccccuugcccagcccccgagcuuuugggagggccuuccguauuccuguuuccacccaagccgaaagauacucuaaucagccggacaccugaagugaccugugucgugguugacgugucucacgaggaucccgaggucaaguucaacugguauguggacggcguagaaguucauaaugcgaagacgaaaccacgcgaggaacaguacaacucaaccuauagaguggucagugugcucacaguccugcaccaagauuggcuuaaugguaaggaguacaaaugcaaggugagcaacaaagcacugccugcccccauugagaagacuaucuccaaagcuaaggggcagccaagggaaccccagguuuauaccuugccuccaucucgggacgagcucacaaagaaucaggugucgcugacuuguuuaguaaaaggauuuuacccgagcgauauagccgucgaaugggaguccaacggccaacccgaaaauaacuauaagaccacaccuccagugcuggacucagacggcaguuucuuucucuacucuaaacuuaccguugauaagagccgcuggcagcaggggaauguguucuccugcucaguccacgaggcacugcauaaccacuacacucaaaagagcuugucucuaucccccgga

SEQ ID NO: 22986 - RNA, 639 nt, Artificial Sequence
  derived and/or modified sequence opt3 from Atlizuab_LightChain1
gacauccagacccaaagccccuccucucugucagccagugugggcgauagagucacaauuacuugcagggcuagccaggacauauccucuuaccucaacugguaucagcagaagccugggaaagcaccaaaacuucugaucuacuauacgucgcgguugcacucaggaguuccgagccgcuucagugguuccggcucugggaccgauuuuacauucacuauuagcuccuuacaacccgaggacaucgccaccuacuauugucagcagggaaauacacugccuuacaccuuuggccaggguacuaagguggaaauuaagcgaacaguagcggcuccaucaguguucaucuuucccccuagugaugagcaacuaaaaagcgggaccgccucugucgugugccuccugaacaauuucuauccacgugaagcaaagguucaguggaagguggacaacgcccuucaguccggaaauucacaggagagcgucacggaacaagauaguaaagacucuacuuacucccugagcucgaccuugacacucucuaaggcugauuacgagaaacauaagguguaugcaugugagguaacucaccagggccuguccucacccguuaccaaaaguuuuaacagaggcgaaugc

SEQ ID NO: 22987 - RNA, 792 nt, Artificial Sequence
  derived and/or modified sequence opt3 from Aurograb_SingleChain
auggccaaggugcagcugcuccaaagcgcuaccgaggucaaaaagcccggcgcauccguuaaagugucuugcaaggccuacggguauacauucacugacuacggaaucacguggguaagacaggcgccuggucagggccuugaauggaugggguggauuucagcuuauaacggauacaccaauuaugcccagaaauuucaagauaggauaacaaugacuaccgacgcaaguacaagcaccgccuacauggagcugcgguccuugcgcccagaugacacugcuguguuauauugugcacgagaucgugaagacgccucucugcuaagagauggccacuggggucaggggacacucgucaccgugucgucaggaggcggcgggagcggagguggcgggaguggaggcgguggguccggaggcggcgggucugagacgacucugacccagagcccgggaacacuuucccugucacccggugaaagggcuacuuugaguugccgggccagccagaucguuucuuccucauaccucgcgugguaccaacagaagccuggccaggcaccacgccugcugauuuauggggccagcaguagagcuaccggaauccccgacagguucucuggcuccgguagcgggacagauuuuacccucacgauuucgaaguuagagccugaggacuucgccguguacuauugucagcauuacggcaguuccucaccauggacuucucggccccgcgaucaaagcgacaucaaacgagcagcugcccuggaacaccaucaccaucaccac

SEQ ID NO: 22988 - RNA, 1350 nt, Artificial Sequence
  derived and/or modified sequence opt3 from Avelumab_HeavyChain1
gaggugcagcugcucgaaagcggcgggggacuuguccaacccgguggcucccugagauugucuugcgccgcuucaggguucaccuuuaguagcuacaucaugauguggguuaggcaggcaccuggaaagggcuuagaguggguguccucuauuuauccaucgggugggauaacauucuacgccgacacuguaaaaggacgguuuacgaucucacgcgauaacagcaagaauacccuguaucuacagaugaacagucuccgagcggaagacacagcuguguacuauugugcccguauuaaacugggcacugucaccacaguggauuacuggggccaggggacccuuguuacuguguccucugcaagcacaaagggaccguccgucuucccccuggccccuucaaguaaaagcaccucugguggcacggcugcauuggggugccucgugaaggacuauuuuccagagcccguaacuguuuccuggaauagcggagcccugaccagcggcgugcacacauucccugcuguccugcaaaguucuggucucuacuccuuaagcucgguggugacugucccaucuuccucacuggggacccagacauacaucuguaacguuaaucauaagcccaguaacaccaaaguggauaagaaaguagaaccuaagagcugcgacaaaacgcacacuuguccaccgugccccgccccugagcuuuugggaggcccauccguguuucuguuucccccuaagccaaaggauacacuaaugauuucuagaacccccgaggucacuugugugguuguggacgucagccaugaagauccggaggugaaauuuaauugguauguagacggcguugaagugcacaacgcgaagacaaaaccuagggaggagcaguacaauucaaccuaucgggucgugaguguccucacggugcugcaucaggauuggcuuaacgggaaggaauacaaaugcaagguuuccaauaaagcacugcccgccccaaucgagaagaccauaagcaaggcuaaaggacaaccucgcgaaccccagguguauacauugccacccucuagagacgagcucacuaagaaccagguaucacugaccuguuuagucaaagguuucuacccuagugauaucgccguggaaugggagagcaauggccagccagagaacaauuauaagacaacuccgcccguucuggacuccgacgggucuuucuuccucuacucgaaacuuaccguggauaagucaagguggcaacagggaaacgucuuuuccugcucagugaugcacgaagcacugcacaaccauuacacacagaagaguuugucucuaagcccuggcaaa

SEQ ID NO: 22989 - RNA, 648 nt, Artificial Sequence
  derived and/or modified sequence opt3 from Avelumab_LightChain1
cagagcgcccugacccaacccgcuuccgugucuggcucaccugggcagaguaucacaauuagcugcacuggaacguccucugacgucgguggcuacaacuauguuucgugguaccagcagcacccagggaaggcaccgaaacucaugauauaugaugugucaaauagacccagcggaguaaguaacagguucuccggcucuaagagcgguaauaccgccucccuuacaaucucagggcugcaagcggaggacgaagcugauuacuauuguaguagcuacacuucuuccucaacccggguguuuggaacaggcaccaaagucacuguguugggccagccuaaggccaacccaacaguuaccuuauuucccccuagcagugaggaacugcaggcaaauaaagccacgcuagugugccucauuucugacuucuauccaggggcugucacuguggcauggaaggccgauggaucccccguaaaggcugguguugagaccacaaaaccuagcaagcagucgaacaauaaauacgccgcgucuuccuaccugucacuuacuccagaacaauggaagagucaucgcagcuauuccugucaggugacccacgagggcucuacagucgagaaaaccguggcaccgacggaaugcagc

SEQ ID NO: 22990 - RNA, 1344 nt, Artificial Sequence
  derived and/or modified sequence opt3 from Bapineuzumab_HeavyChain1
gaggugcagcugcucgaaagcggcgggggacuuguccaacccgguggcucccugagauugucuugcgccgcuucaggguucaccuuuaguaacuacggaaugagcuggguuaggcaggcaccuggcaaggguuuagaguggguggccuccauccggucugggggaggccgcacauauuacucggacaauguaaaaggccgauucacuauuucacgugauaacagcaagaauacgcuguaucuacagaugaacagucucagagcggaagacaccgcuguguacuauugugucagguacgaucacuauuccgggucuagcgacuacuggggacaggguacacuggugacuguuuccucagccaguaccaaaggcccaagcguguuuccgcuugcacccucuuccaagucaacaagcgggggaaccgccgcucugggcugcuuggucaaagauuacuucccugagccagugacuguaaguuggaacucuggugcacucacauccgggguucauaccuuucccgccgugcugcaaagcucgggacuguauucucucuccucagucgugacggugccuaguagcuccuuaggcacucagaccuacauauguaaugucaaucacaagccaucuaacacaaagguugacaaaaagguggaacccaaaagcugcgauaagacucauaccuguccuccaugcccggcucccgagcugcuuggcgggccuucaguauucuuguuuccacccaaaccuaaggacacacugaugaucagucggaccccagaggugacgugugucgugguugaugugucccacgaagaccccgaggucaaguucaauugguauguggauggaguagaaguucauaacgccaaaacuaagccgcgcgaggagcaguacaauagcacauauagaguggucucugugcuaaccguccuccaccaggacuggcugaacgguaaagaauacaagugcaaagugucaaauaaggcgcuuccugcacccauugagaaaacuaucaguaaggccaagggccaaccaagggaaccucagguuuauacacugcccccaagccgggaggaaaugaccaaaaaccagguguccuugacgugucucguaaagggguuuuaccccucugauauugcugucgagugggagucgaauggacagccugaaaacaacuacaaaaccacaccaccggugcuggacagcgacggcuccuucuuuuuauauucaaagcugacuguugauaaaagucgcuggcaacaggguaauguguucucuugcagcgucaugcacgaggcccuccauaaccacuacacccagaagucccuuucacugagccccggg

SEQ ID NO: 22991 - RNA, 657 nt, Artificial Sequence
  derived and/or modified sequence opt3 from Bapineuzumab_LightChain1
gacguggucaugacccagagcccccugucccucccuguuacaccaggcgagccggccucuaucucaugcaagaguagccaaucccuucuggauucugacgggaaaacuuacuugaacugguuacugcagaagcccggacagucgccucagagacuaauuuaucucgugucaaaacuggauagcgguguaccagacagguucaguggcuccgggucuggaacggauuuuacccuuaagauaagccggguggaagcugaggacgucggcguguacuauuguuggcaagguacacacuucccccgcacuuuugggcagggaaccaaaguugaaaucaagcgaacaguggcagccccuuccgucuucauuuuuccacccucagaugagcagcugaagaguggcaccgcgagcgugguaugcuugcucaauaacuucuacccucgugaagcuaaaguucaguggaagguggacaaugcccugcaaucuggcaacucccaggagucagucacugagcaggauagcaaagacaguacauauucucuguccagcacccucacguuaucgaaggcagauuacgaaaaacauaagguguaugccugugaggugacucaccaggggcugucuuccccagucaccaagucauuuaauagaggagaaugc

SEQ ID NO: 22992 - RNA, 1338 nt, Artificial Sequence
  derived and/or modified sequence opt3 from Basiliximab_HeavyChain
cagcugcaacagagcggcaccgugcucgccagacccggggcuuccgucaagaugucuugcaaagcaucaggauacaguuucacaagguauuggaugcacuggaucaagcagcggccuggucagggccuugaguggauuggggccauauacccaggaaacagcgacacuuccuauaaucaaaaauuugaaggcaaggcgaaacugacggcuguuaccucugccucgacagcauacauggaguugucaagccucacucaugaagauagugccguguauuacuguucccgcgacuaugguuacuacuucgauuuuugggggcagggaaccacacugaccguaucuagcgcuuccacuaagggcccgucaguguucccccuagcaccuaguagcaagucuacauccggcgggaccgccgcucucggaugccuggucaaagacuauuuuccagagcccgugacgguuucauggaacagcggugcccuuacaaguggcgugcacaccuucccugcgguccugcagucuuccggguuguacagccucucgucugugguaacaguuccauccucaagucugggaacucagaccuauaucuguaaugugaaccauaagcccagcaauacaaaagucgauaagcgaguggaaccuccaaaauccugcgacaagacccacacguguccgcccugcccugcaccagagcugcucggcggucccucuguguuuuuauucccuccaaagcccaaagauacucugaugauuagccguacaccggaggucaccuguguugugguagacgugucacaugaagauccugaggucaaguuuaacugguacguggacgggguugaagugcacaaugccaaaacuaagcccagagaggagcaauauaacaguacauacagggucguguccguacuuaccguuuugcaccaggauuggcugaauggaaaagaauauaagugcaaagugagcaacaaggcucuaccagccccuaucgagaagacgauuucuaaagcaaagggccagccccgggaaccacaggucuacaccuuacccccuucacgcgacgagcugacuaaaaaucaagugagucuuacuugucuggucaagggcuucuacccaagcgauaucgcuguggaaugggaguccaacgggcagccggagaauaacuauaaaaccacacccccuguuuuggacucugacggaucguuuuuccucuacagcaagcugacuguggauaaguccagauggcagcaagguaauguauuuucaugcagugucaugcaugaagccuuacacaaccauuauacccagaaaucucugagccucuccccaggcaag

SEQ ID NO: 22993 - RNA, 630 nt, Artificial Sequence
  derived and/or modified sequence opt3 from Basiliximab_LightChain
cagaucgugagcacccaaucccccgccauuaugucugcuucaccuggcgagaaggucacaaugacuugcagugcaagcuccucuagaucguacaugcagugguaucagcagaaaccagggacgucaccgaagagguggauauacgacaccagcaaacuggccaguggaguucccgcgcgguucuccgguucuggcagcgggacauccuauucacucacuaucaguagcauggaagcugaggaugccgcaaccuacuauugucaccaacgaucuuccuacacauuuggaggcgguaccaaacuugaaauuaagcgcacuguggccgcuccuucaguauucaucuuuccacccagcgacgagcagcugaagagugggacagcaucuguggucugcuuguuaaacaauuucuauccucgugaagccaaggugcaguggaaaguugauaacgcucugcaguccggaaauagccaagagucggugaccgagcaggacucuaaggauuccacguacucacuaaguagcacucucacccuguccaaagccgacuacgaaaagcauaaagucuaugcgugugaggugacacaccagggccuuucuagcccaguaacuaagucauuuaacagaggcgaa

SEQ ID NO: 22994 - RNA, 1350 nt, Artificial Sequence
  derived and/or modified sequence opt3 from Bavituximab_HeavyChain
gaggugcagcugcaacagagcggccccgaacucgagaagccuggggccuccgucaaacuuucuugcaaggcuucaggauacaguuucaccgguuauaacaugaauuggguuaaacagagccacggcaagucccuggaauggaucgggcauauugacccauacuauggagauacaucuuacaaccagaaauuuagaggcaaggcaacuuugacgguggacaagucgucaagcaccgccuauaugcaauuaaaaagucugacauccgaggauucugcgguauacuauugugugaaggguggguacuacggacacugguauuucgacgucuggggcgcuggcacuaccgugacaguuagcuccgccucaaccaaagggccgaguguguuuccccuagcaccuagcucuaaguccacuucaggagguacagccgcucucggcugccuggucaaagauuacuucccagaacccgugaccguaagcuggaauaguggggcacuuacgucuggaguucauacuuuuccugccgugcugcaguccagcggcuuguauucgcucucuuccgucgugaccgugccaucaaguagccuggguacacagacuuacauauguaacgucaaucacaagcccuccaacaccaagguugacaaaaagguggagccuaaaucuugcgauaagacacauaccuguccaccgugccccgcuccugagcugcucgggggaccaagcguauucuuauuucccccuaaaccaaaggacacgcugaugaucucaaggacucccgaagugacaugugucgugguugaugugagucacgaggacccggaagucaaauucaauugguauguggauggcguagagguucacaacgccaagaccaagccucgggaggaacaguacaauuccacuuaucgcguggucagcgugcuuacagucuugcaucaagacuggcugaacggcaaagaguacaagugcaaagugucuaauaaggcgcuacccgcaccaauugagaaaaccaucucaaaggccaaggggcagccucgagaaccccagguuuacacgcucccacccagucgugaugaacugaccaaaaaccaggugagccuuacaugucugguaaagggauuuuauccuuccgacauugcugucgagugggagucuaauggucaaccagaaaacaauuacaaaacuaccccgcccguguuggacucggauggcagcuucuuucucuauuccaagcugacaguugacaaaucaagauggcagcaggggaacguguucaguugcucugucaugcacgaggccuuacauaaccacuacacucaaaagagccugucccucucaccuggaaag

SEQ ID NO: 22995 - RNA, 642 nt, Artificial Sequence
  derived and/or modified sequence opt3 from Bavituximab_LightChain
gacauccagaugacccaaagccccuccucucugucagccagucucggcgagagagugagccuuacaugcagggcuucccaggauauugggucuucgcugaacugguugcagcagggaccugacgguacuauaaagcgguuaaucuacgcaacgucaagccuggauaguggcgucccaaaacgcuucuccgggucucgaagcggauccgacuauucacuaaccauuaguagccucgaaucugaggauuuuguugacuacuauugucugcaauacguguccucaccgcccacauucggcgccgguacuaaacuugaacugaagcgugcggaugcugccccuagcguauuuaucuucccacccagugacgagcaguugaagucugggaccgcauccguggucugccuccugaauaacuuuuauccuagagaagccaaagugcaguggaagguugauaaugcucugcagagcggaaacucgcaagagucugugacagagcaggacuccaaggauucaaccuacagucucagcuccacuuuaacacugucuaaagcagacuaugaaaagcacaaagucuacgccugugaggugacccaucagggccuuagcucaccaguaacgaagaguuucaauaggggcgaaugc

SEQ ID NO: 22996 - RNA, 624 nt, Artificial Sequence
  derived and/or modified sequence opt3 from Bavituximab_LightChain_variant_8734_L
gacauccagaugacccaaagccccuccucucugucagccagucucggcgagagagugagccuuacaugcagggcuucccaggauauugggucuucgcugaacugguugcagcagggaccugacgguacuauaaagcgguuaaucuacgcaacgucaagccuggauaguggcgucccaaaacgcuucuccgggucucgaagcggauccgacuauucacuaaccauuaguagccucgaaucugaggauuuuguugacuacuauugucugcaauacguguccucaccgcccacauucggcgccgguacuaaacuugaacugaagcgugcggaugcugccccuagcguauuuaucuucccacccagugacgagcaguugaagucugggaccgcauccguggucugccuccugaauaacuuuuauccuagagaagccaaagugcaguggaagguugauaaugcucugcagagcggaaacucgcaagagucugugacagagcaggacuccaaggauucaaccuacagucucagcaaagcagacuaugaaaagcacaaagucuacgccugugaggugacucaucagggcuuauccucuccaguaacaaagagcuucaauaggggcgaaugc

SEQ ID NO: 22997 - RNA, 1368 nt, Artificial Sequence
  derived and/or modified sequence opt3 from Begelomab_HeavyChain1
caggugcaacugcagcagagcggcgccgagcucgucaagcccggggcuuccguuaaacuuucuugcaaggcaucaggauacaccuucagaaguuaugacaucaacugggugaggcagcggccugaacaaggucuggaguggauuggcuggauauuuccaggggauggaagcacaaaauacaaugaaaaguucaaaggcaaggccacuuugacgaccgacaaguccucuucgacagcguauaugcaguuaucacgccugacuagcgaggauagugcuguauacuuuugugcccgauggaccguggucgguccgggguauuucgacguguggggagcaggcacaaccguuacuguguccucugccaaaacaacgcccccuagcgucuacccacuagcucccggcugcggggauaccacuggauccucagugacccucgguugucugguaaagggcuauuuuccugaaaguguuacagugacuuggaacagcgggucucuuuccucaagcguccacaccuucccagcacuguugcagaguggacucuacacaaugucuuccagcgugaccgugcccucgucuacguggccuucccagacugucacaugcucaguugcccauccagcuaguagcaccacuguggacaaaaagcuggagccguccggccccaucucuacaauuaauccuuguccacccugcaaagagugucacaagugcccugccccaaaccuggaaggugggcccagcguauuuaucuucccgccuaauauuaaggaugugcucaugaucucauuaacccccaaagucacgugugugguuguggacgucagugaggaugacccagaugugcaaauauccugguuuguaaacaauguugaagugcauaccgcgcagacacagacucaccgugaggacuacaacagcaccaucagagucgugucuacacugccuauucagcaucaagauuggaugucaggaaaggaguucaaaugcaaggucaauaacaaagaccuucccaguccaaucgaaaggacuauuagcaagaucaaaggcuuggugcgggcaccccagguuuauauacugccuccaccggccgagcagcuaucccgcaaggacgugucucucaccugucugguagucggcuuuaaucccggggauauuucgguggaauggacaagcaacggacacaccgaggaaaauuacaaggacacugcuccuguucuugauuccgacgguucauauuucaucuacaguaaacugaacaugaagacgucuaaaugggagaagacagauagcuuuuccugcaaugugagacacgagggcuugaaaaacuauuaccucaagaagaccauuucaaggagcccagggaaa

SEQ ID NO: 22998 - RNA, 639 nt, Artificial Sequence; identical to SEQ ID NO: 22936
  derived and/or modified sequence opt3 from Begelomab_LightChain1

SEQ ID NO: 22999 - RNA, 1353 nt, Artificial Sequence
  derived and/or modified sequence opt3 from Benralizumab_HeavyChain1
gaggugcagcugguccaaagcggcgccgaaguuaagaaacccggggcuuccgugaagguaucuugcaaagcaucaggauacaccuucacaaguuaugugauccacugggucagacagaggccuggucagggccucgccuggaugggguacauuaacccauauaaugacggaacuaaguacaacgagcgguuuaaaggcaaggugacgauaaccagcgaucgcuccacaucuacuguuuauauggaacuuucgucacugcgaagcgaggacaccgcgguguacuuguguggucgugaagggaucagauauuacggauuacugggcgauuacuggggccaggggacccuagucacagugaguuccgcuucuacuaagggaccgagcguauucccccucgccccuuccucaaaaaguacaagcgguggcaccgcagcccuggggugccuuguuaaggacuauuuuccagagcccgugacggucucuuggaacuccggagcucugacuucaggcgugcauaccuucccugcaguguugcaaagcaguggucucuacucucuguccagcgucguuacagugccaucgucuucccuggggacucagaccuauauuuguaauguaaaucacaaacccucaaacacaaagguggauaaaaaggucgagccuaagaguugcgacaaaacccauacguguccaccgugccccgccccugaacucuuaggaggcccaagcguguuucuguuucccccuaagccaaaagauacucuuaugaucuccaggacacccgagguuaccuguguggucguggacguaucucacgaagauccggagguuaaguucaauugguacguggacggcgucgaggugcauaacgcuaaaacuaagccucgggaggaacaguauaauagcacauaccgcgucgugucaguuuugaccgugcugcaccaggauuggcuaaacgggaaagaauauaagugcaagguaaguaauaaagcccuccccgcgccaauugagaagacgaucuccaaagcaaagggacaaccuagagaaccccaggucuacacccugccacccagcagggacgagcuuacuaaaaaccaggugucucugacauguuugguuaaggguuucuacccuucagauauagccguggagugggaaaguaauggccagccagagaacaauuauaagaccacaccgcccguccucgacagcgacggguccuuuuuccuguacucuaaauuaacuguggauaagucgcgguggcaacagggaaacguauuuagcugcuccgugaugcacgaagcucugcauaaccacuauacccagaaaucacucagucuuucuccuggcaag

SEQ ID NO: 23000 - RNA, 642 nt, Artificial Sequence
  derived and/or modified sequence opt3 from Benralizumab_LightChain1
gacauccagaugacccaaagccccuccucucugucagccagugugggcgauagagucacaauuacuugcgggacgagcgaggacauaaucaacuaccucaauugguaucagcagaagccuggaaaagcuccaaaacuucugauuuaccacaccuccagguugcagucugguguuccgucgcgguucucaggcagcgggaguggaacagauuuuacuuuaaccaucuccucucugcaacccgaagacuucgcaacauauuacugucagcagggcuauacccuaccuuacacuuuuggucaggggacaaagguggagauuaagcgcaccguagccgcgccaagcguguucaucuuucccccuuccgaugaacaacucaaaucaggaacggcuagugucgugugccugcuuaacaauuucuauccacgagaggccaagguucaguggaagguggacaacgcacugcagagcggcaauucucaggaauccgucacugagcaagauucaaaagacagcaccuacaguuugucuuccacacucacucugagcaaggccgauuacgagaaacauaagguguaugcuugugaaguaacccaccagggccugucgucucccguuacaaaauccuuuaaccguggggagugc

SEQ ID NO: 23001 - RNA, 1329 nt, Artificial Sequence
  derived and/or modified sequence opt3 from Betalutin_HeavyChain1
gaaauccagcugcaacagagcggccccgaacucgugaagccuggggccuccgucaaaguuucuugcaaggcuucaggauacaguuucaccgacuauaacauguacugggugaaacagagccacgguaagucccuugaguggauuggcuauauagauccauacaauggggacacaacuuauaaccagaaauuuaagggaaaggcaacgcugaccguagauaaaucuucgucaacagccuucauccauuugaauagcuuaacuuccgaagacuccgcgguguacuauugugcuagaucuccguacggccacuacgccauggauuauuggggucaagggaccagcgucacaguguccucagcaaagaccacucccccuaguguuuacccacuggcccccggaagcgcugcacagacaaacucuauggugacccuaggcugccucgucaaaggcuauuuuccugagccagugacgguaacuuggaauagugggucacugagcaguggaguucauaccuuccccgccgugcuucagucugaccuguacacauuguccagcucggucacugugccuucuuccaccuggccaucagaaacagugaccuguaacgucgcucacccggccaguagcacgaagguugauaaaaagauugugcccagggacugcgguuguaagccuugcaucuguacuguaccagagguguccucugucuuuauuuuucccccuaaaccaaaggaugugcucacaaucacccugacucccaaaguuacaugcguggucguggacauaagcaaggaugacccggagguacaguucucaugguucguugaugacguggaaguccauaccgcgcaaacgcagccucgggaggaacaguuuaauaguaccuuccgcuccgugagcgagcugcccaucaugcaccaggacuggcucaacggcaaagaguuuaagugucgagucaauucugcagccuucccagcuccuauugagaaaacaaucucaaagacuaaggggcgucccaaagccccacaaguguauaccauucccccuccaaaggaacagauggcaaaagauaagguuaguuuaacaugcaugaucacugacuuuuucccggaagauauaaccguggaguggcaguggaacggacaacccgcugaaaauuacaaaaacacacagccuauuauggacaccgauggcagcuauuucguauacuccaagcugaauguccagaagucuaacugggaggccgguaauacuuuuacguguucggugcuucacgagggguugcauaaccaccauacagagaaaagccugucccacucaccaggaaag

SEQ ID NO: 23002 - RNA, 642 nt, Artificial Sequence
  derived and/or modified sequence opt3 from Betalutin_LightChain1
gacaucgugaugacccagagccacaagcugcucuccacaucugucggcgauagaguuucaauuacuugcaaagccagucaagacgugagcacggcuguagauugguaccagcagaagcccgggcaguccccuaaacuucugauaaacugggcaucuaccaggcauacaggagugccagaccgguucacugguucgggcucagggaccgauuauacauugaccaucagcaguaugcaagccgaggacuuagcgcuguacuauugucgccagcacuacuccacuccguuuacauucggaucuggcaccaagcuagaaauuaaacgagcugaugccgcacccacggucagcaucuuuccuccauccucagagcagcucaccagugguggggccagcgugguuugcuuccugaauaacuuuuaucccaaggacauuaaugugaaguggaaaaucgauggaucugaacgucagaacggcguccuuaauuccuggacugaccaagauucaaaggacagcacauacaguaugucuuccacucugaccuugacaaaagaugaguaugaaagacauaacagcuacaccugugaggcuacgcacaagacuucgacaucuccuauagugaaauccuucaauaggaacgagugc

SEQ ID NO: 23003 - RNA, 1344 nt, Artificial Sequence
  derived and/or modified sequence opt3 from Bevacituzuab_HeavyChain1
gaggugcagcuggucgaaagcggcgggggacucguucaacccgguggcucccuuagacugucuugcgccgcuucaggguacaccuucacaaacuauggaaauugggugaggcaggcaccuggcaaggguuuggaguggguaggguggaucaacacuuacacgggagaaccaaccuaugccgcggacuuuaaacggcgcuucacauuuaguuuagauacuagcaaguccaccgcuuaccugcaaaauucucuacgagccgaggacacagcaguguauuacugugccaaauauccgcacuacuacggcucgucacauugguauuucgaugucuggggccaggggacccucgugacuguuagcagugcuuccacaaagggacccucuguguuuccucuggcaccaagcuccaaaucaaccagugguggcacggccgcucuugggugccuggucaaggacuacuuccccgaaccugugacuguaagcuggaacucuggagccuugaccuccggcguucacacauuuccagcggugcuccagucaagcggucuguauagucugucuuccgucgugacugugcccagcucgucucucgggacccagacauacauuuguaaugucaaccauaagccuuccaauaccaaaguugauaagaaaguggagccaaagucaugcgacaaaacgcacacuuguccgcccugcccugcaccagaguuacugggaggccccaguguauuccuuuuuccuccaaagcccaaggauacauugauaagccguaccccggaagugacuugugucgugguugacgugucccaugaggauccugaagucaaauucaacugguauguggacggcguagagguucacaaugccaagacaaaacccagagaggaacaguacaacucuaccuauaggguggucagcgugcugacgguccuacaccaggauuggcucaaugggaaggaguacaaaugcaaggugucaaacaaagcucugccagccccuaucgaaaagaccauuaguaaggcaaaaggacaaccccgggagccacagguuuacacacuucccccuucccgcgaagagacuaagaaucaggugagccugaccuguuugguaaaagguuuuuauccaucugacaucgcugucgagugggaaucaaacggccagccggagaauaacuacaagacaacucccccugugcucgauagugacgggagcuucuuucuguauuccaaauuaaccguugacaagucuagauggcaacagggaaacguguucucgugcagcguccaugaagcccugcacaaucauuacacacagaagucccucucacuuaguccaggcaaa

SEQ ID NO: 23004 - RNA, 639 nt, Artificial Sequence
  derived and/or modified sequence opt3 from Bevacituzuab_LightChain1
gacauccagacccaaagccccuccucucugucagccagugugggcgauagagucacaauuacuugcagcgcuucccaggacauaucuaacuaccucaauugguaucagcagaagccugggaaagcaccaaagguucuuaucuacuucacgucgucacugcacagcggagugccgaguagguuuuccgguucuggcagcgggaccgauuucacauugacuauuuccucauuacaacccgaggacuuugccaccuauuacugucagcaguauaguacaguaccuuggaccuucggacagggcacuaaaguggaaaucaagcggacagucgcggcuccaagcguguuuauuuuucccccuucugaugagcaacugaaauccgguaccgccucaguugugugccuacucaacaauuucuacccacgcgaagcaaagguccaguggaagguggacaacgcccugcagagcgggaauagucaggagucuguaacggaacaagauuccaaagacagcacuuauucgcuuucuuccacccugacauugucaaaggcugauuacgagaaacauaagguuuacgcaugugaggugacucaccagggacucaguagccccgucaccaaauccuucaaccgaggcgaaugc

SEQ ID NO: 23005 - RNA, 639 nt, Artificial Sequence
  derived and/or modified sequence opt3 from Bevacizumab_154-aspartic_acid_LightChain
gacauccagaugacccaaagccccuccucucugucagccagugugggcgauagagucacaauuacuugcagcgcuucccaggacauaucuaacuaccucaauugguaucagcagaagccugggaaagcaccaaagguucuuaucuacuucacgucgucacugcacagcggagugccgaguagguuuuccgguucuggcagcgggaccgauuucacauugacuauuuccucauuacaacccgaggacuuugccaccuauuacugucagcaguauaguacaguaccuuggaccuucggacagggcacuaaaguggaaaucaagcggacagucgcggcuccaagcguguuuauuuuucccccuucugaugagcaacugaaauccgguaccgccucaguugugugccuacucaacaauuucuacccacgcgaagcaaagguccaguggaagguggacaacgccgaucagagcgggaauagucaggagucuguaacggaacaagacuccaaagauagcacuuauucgcugucuuccacccuuacacugucaaaggcugacuacgagaaacauaagguuuacgcaugugaggugacucaccagggauugaguagccccgucaccaaauccuucaaccgaggcgaa

SEQ ID NO: 23006 - RNA, 639 nt, Artificial Sequence; identical to SEQ ID NO: 23005
  derived and/or modified sequence opt3 from Bevacizumab_154-substitution_deriv_LightChain

SEQ ID NO: 23007 - RNA, 672 nt, Artificial Sequence
  derived and/or modified sequence opt3 from Bevacizumab_180-serine_HeavyChain
gaggugcagcuggucgaaagcggcgggggacucguucaacccgguggcucccuuagacugucuugcgccgcuucaggguacaccuucacaaacuauggaaugaauugggugaggcaggcaccuggcaaggguuuggaguggguaggguggaucaacacuuacacgggagaaccaaccuaugccgcggacuuuaaacggcgcuucacauuuaguuuagauacuagcaaguccaccgcuuaccugcagaugaacucucuacgagccgaggacacagcaguguauuacugugccaaauauccgcacuacuacggcucgucacauugguauuucgaugucuggggccaggggacccucgugacuguuagcagugcuuccacaaagggacccucuguguuuccucuggcaccaagcuccaaaucaaccagugguggcacggccgcucuugggugccuggucaaggacuacuuccccgaaccugugacuguaagcuggaacucuggagccuugaccuccggcguucacacauuuccagcggugucacaaagcaguggucucuauucucuguccagcgucgugacugugcccucgucuucccuggggacccagacauacauuuguaaugucaaucauaagccuucaaauaccaaaguugauaagaaaguggagccaaag

SEQ ID NO: 23008 - RNA, 672 nt, Artificial Sequence; identical to SEQ ID NO: 23007
  derived and/or modified sequence opt3 from Bevacizumab_180-substitution_deriv_HeavyCahin

SEQ ID NO: 23009 - RNA, 1359 nt, Artificial Sequence
  derived and/or modified sequence opt3 from Bevacizumab_beta_HeavyChain1
gaggugcagcuggucgaaagcggcgggggacucguucaacccgguggcucccuuagacugucuugcgccgcuucaggguacaccuucacaaacuauggaaugaauugggugaggcaggcaccuggcaaggguuuggaguggguaggguggaucaacacuuacacgggagaaccaaccuaugccgcggacuuuaaacggcgcuucacauuuaguuuagauacuagcaaguccaccgcuuaccugcagaugaacucucuacgagccgaggacacagcaguguauuacugugccaaauauccgcacuacuacggcucgucacauugguauuucgaugucuggggccaggggacccucgugacuguuagcagugcuuccacaaagggacccucuguguuuccucuggcaccaagcuccaaaucaaccagugguggcacggccgcucuugggugccuggucaaggacuacuuccccgaaccugugacuguaagcuggaacucuggagccuugaccuccggcguucacacauuuccagcggugcuccaaucaagcggucuguauagucugucuuccgucgugacugugcccagcucgucucucgggacccagacauacauuuguaaugucaaucauaagccuuccaauaccaaaguugauaagaaaguggagccaaagucaugcgacaaaacgcacacuuguccgcccugcccugcaccagaguuacugggaggccccaguguauuccuuuuuccuccaaagcccaaggauacauugaugauaagccguaccccggaagugacuugugucgugguugacgugucccaugaggauccugaagucaaauucaacugguauguggacggcguagagguucacaaugccaagacaaaacccagagaggaacaguacaacucuaccuauaggguggucagcgugcugacgguccuacaccaggauuggcucaaugggaaggaguacaaaugcaaggugucaaacaaagcucugccagccccuaucgaaaagaccauuaguaaggcaaaaggacaaccccgggagccacagguuuacacacuucccccuucccgcgaagagaugacuaagaaucaggugagccugaccuguuugguaaaagguuuuuauccaucugacaucgcugucgagugggaaucaaacggccagccggagaauaacuacaagacaacucccccugugcucgauagugacgggagcuucuuucuguauuccaaauuaaccguugacaagucuagauggcaacagggaaacguguucucgugcagcgucaugcaugaagcccugcacaaucauuacacacagaagucccucucacuuaguccaggcaaa

SEQ ID NO: 23010 - RNA, 642 nt, Artificial Sequence
  derived and/or modified sequence opt3 from Bevacizumab_beta_LightChain1
gacauccagaugacccaaagccccuccucucugucagccagugugggcgauagagucacaauuacuugcagcgcuucccaggacauaucuaacuaccucaauugguaucagcagaagccugggaaagcaccaaagguucuuaucuacuucacgucgucacugcacagcggagugccgaguagguuuuccgguucuggcagcgggaccgauuucacauugacuauuuccucauuacaacccgaggacuuugccaccuauuacugucagcaguauaguacaguaccuuggaccuucggacagggcacuaaaguggaaaucaagcggacagucgcggcuccaagcguguuuauuuuucccccuucugaugagcaacugaaauccgguaccgccucaguugugugccuacucaacaauuucuacccacgcgaagcaaagguccaguggaagguggacaacgcccugcagagcgggaauagucaggagucuguaacggaacaagauuccaaagacagcacuuauucgcuuucuuccacccugacauugucaaaggcugauuacgagaaacauaagguuuacgcaugugaggugacucaccagggacucaguagccccgucaccaaauccuucaaccgaggcgaaugc

SEQ ID NO: 23011 - RNA, 687 nt, Artificial Sequence
  derived and/or modified sequence opt3 from Bevacizumab_FcDomain
agcugcgacaagacccacacaugucccccuugcccagccccggagcugcucggcgggcccuccguguuccuuuuuccuccaaaacccaaggauacucugaugaucucuagaacgccugaagucaccuguguugugguagacgugucacaugaggauccagaagucaaauucaacugguacguggacggaguugaggugcacaaugcuaagacaaaacccagggaagaacaguauaacaguacuuaccgggucgugagcguauugaccguuuuacaucaggauuggcugaaugguaaggaguauaagugcaaaguguccaacaaggcacuaccugccccaauugagaaaacaauaucuaaggcgaaaggccagccgcgcgagccccaggucuacacccucccuccaucgcgagacgaacugacuaagaaucaggugucacuuacaugucuggugaagggguuuuaucccagcgauaucgcugucgagugggagaguaacggacaaccugaaaauaacuacaaaaccacgccacccguuuuggacuccgauggcucuuucuuucucuauagcaagcugacuguggacaaaucccguuggcagcaggguaauguauucucaugcagugugaugcacgaggcccugcauaaccacuacacccaaaagagccucucuuuauccccggggaaa

SEQ ID NO: 23012 - RNA, 672 nt, Artificial Sequence
  derived and/or modified sequence opt3 from Bevacizumab_HeavyChain
gaggugcagcuggucgaaagcggcgggggacucguucaacccgguggcucccuuagacugucuugcgccgcuucaggguacaccuucacaaacuauggaaugaauugggugaggcaggcaccuggcaaggguuuggaguggguaggguggaucaacacuuacacgggagaaccaaccuaugccgcggacuuuaaacggcgcuucacauuuaguuuagauacuagcaaguccaccgcuuaccugcagaugaacucucuacgagccgaggacacagcaguguauuacugugccaaauauccgcacuacuacggcucgucacauugguauuucgaugucuggggccaggggacccucgugacuguuagcagugcuuccacaaagggacccucuguguuuccucuggcaccaagcuccaaaucaaccagugguggcacggccgcucuugggugccuggucaaggacuacuuccccgaaccugugacuguaagcuggaacucuggagccuugaccuccggcguucacacauuuccagcggugcuccaaucaagcggucuguauagucugucuuccgucgugacugugcccagcucgucucucgggacccagacauacauuuguaaugucaaucauaagccuuccaauaccaaaguugauaagaaaguggagccaaag

SEQ ID NO: 23013 - RNA, 1428 nt, Artificial Sequence
  derived and/or modified sequence opt3 from Bevacizumab_HeavyChain_variant1
gccagcgcuaccaugggcugguccugcaucauucuguuccucguggcaacagccacugggguccacucugagguucagcuuguggaaucaggagguggccugguacaacccgggggaaguuugagauuaagcugugcggcuuccggcuacacguuuaccaacuaugguaugaauugggugaggcaggccccugggaagggacuggagugggucggcuggauaaacacauacacuggcgaaccaaccuaugcagccgacuucaaacggcgcuuuacauucucucuagauaccucgaagucaacugcuuaccuccagaugaauagccugcgagcagaggacacagccguguauuacugcgcuaaauauccgcauuacuacgggaguucccacugguauuuugauguuuggggacaggguacccuugugacggucucuagcgccuccacuaagggccccucaguguucccucuggcgccaaguagcaaaucuaccuccgggggaacagcagccuugggcugucucguaaaggacuacuuucccgaaccuguuacugugucauggaacagcggugcucugaccagugggguccauacauucccagccgugcugcaaucuuccggacucuauagcuuaucgucuguggucaccguucccuccucaagucugggcacgcagacuuacaucugcaaugugaaccacaagccuagcaauacaaaaguagauaagaaaguggagccaaaguccugugacaaaacccauacuugcccgcccuguccugcaccagagcuuuugggcgggcccucugucuuucuguucccuccaaagcccaaggauacacuaaugauuagccguaccccggaagugacgugcguuguggucgacgugucacacgaggauccugaaguaaaauuuaacugguauguugacggaguggagguccacaaugcuaagaccaaacccagagaggaacaguacaacaguacauauaggguggucuccgugcucacuguucugcaucaggauuggcuuaaugguaaggaguacaaauguaaggugagcaacaaagcccugccagcgccuaucgaaaagaccauuucuaaggccaaaggccaaccccgggagccacagguauacacauugcccccuucacgcgaagagaugacuaagaaucaggucagucuuaccugccuggugaaaggguucuauccaagcgacaucgcaguugagugggaauccaacggacagccggagaauaacuacaagacaacucccccuguguuagauucugacggcucguuuuuccuguauagcaaacucaccgucgacaaguccagauggcaacaggguaacguguucucauguaguguaaugcacgaagcucuccauaaucacuacacgcagaagucucugagcuuguccccagggaaa

SEQ ID NO: 23014 - RNA, 369 nt, Artificial Sequence
  derived and/or modified sequence opt3 from Bevacizumab_HeavyChain_V-Region
gaggugcagcuggucgaaagcggcgggggacucguucaacccgguggcucccuuagacugucuugcgccgcuucaggguacaccuucacaaauuauggaaugaauugggugaggcaggcaccuggcaaggguuuggaguggguaggguggaucaacacuuacacgggagaaccaaccuaugccgcggacuuuaaacggcgcuucacauuuaguuuagauacuagcaaguccaccgcuuaccugcagaugaacucucuacgagccgaggacacagcaguguauuacugugccaaauauccgcacuacuacggcucgucacauugguauuucgaugucuggggccaggggacccucgugacuguuagcagu

SEQ ID NO: 23015 - RNA, 717 nt, Artificial Sequence
  derived and/or modified sequence opt3 from Bevacizumab_LightChain1
gccagcaagcuggcuaccaugggcugguccugcaucauucucuuccuuguggcaacagccacugggguccacucugacauacagaugacgcaaucacccaguagccuguccgcgucuguuggagauagagugaccaucacauguagggcuucgcaggacauuucaagcuacuugaacugguaucagcagaaaccugguaaggccccaaaauuacugaucuacuauaccagucggcuacauuccggcguaccgucucgcuuuagcggguccggaucaggcacugauuucacauuuaccauuaguagccuccaacccgaggacaucgcaacuuacuauugccagcaggguaauacacugccuuacaccuucgggcagggaacgaagguggaaauaaaacgaacugucgccgcuccaucuguguuuaucuuucccccuuccgaugagcaacuuaagucaggcaccgcaagcguugugugucuguugaacaauuucuauccacgugaagccaagguccaguggaaaguggacaacgcucuccagaguggcaauucucaggaguccguaacagaacaagauagcaaggacucgacuuacucucuguccucaacccugacacucaguaaagccgauuacgagaagcacaaaguuuaugcgugcgaggugacccaucagggguuaagcucccccgucacgaagucuuucaacagaggagaaugu

SEQ ID NO: 23016 - RNA, 711 nt, Artificial Sequence
  derived and/or modified sequence opt3 from Bevacizumab_LightChain2
gccagcgcuaccaugggcugguccugcaucauucuguuccucguggcaacagccacugggguccacucugacauacagaugacgcaaucacccaguagccuuuccgcgucuguuggagauagagugaccaucacauguucggcuucacaggacauuagcaacuaccugaauugguaucagcagaagccugguaaagccccaaagguauugaucuacuuuaccaguuccuuacauucuggcgugccgagcagguucuccgggucaggaaguggcacugauuuuacacugaccauuagcucucuacaacccgaggacuucgcaacuuauuacugccagcaguauuccacagucccuuggaccuuuggucaggggacgaaaguggaaaucaagcggacuguugccgcuccaucaguguucauauuucccccuagcgaugagcaacucaaaaguggaaccgcaucugucgugugucugcuuaacaauuucuacccacgcgaagccaagguacaguggaagguugacaacgcucugcaguccggcaauagccaggagucggugacagaacaagauucuaaagacuccacuuauucauugaguagcacccucacacuguccaaggccgauuacgagaaacacaaggucuacgcgugcgaggugacccaucagggccugucuagccccgugacgaaaucauuuaaccgaggggaaugu

SEQ ID NO: 23017 - RNA, 642 nt, Artificial Sequence; identical to SEQ ID NO: 23010
  derived and/or modified sequence opt3 from Bevacizumab_LightChain

SEQ ID NO: 23018 - RNA, 324 nt, Artificial Sequence
  derived and/or modified sequence opt3 from Bevacizumab_LightChain_VJ-Region
gacauccagaugacccaaagccccuccucucugucagccagugugggcgauagagucacaauuacuugcagcgcuucccaggacauaucuaacuaccucaauugguaucagcagaagccugggaaagcaccaaagguucuuaucuacuucacgucgucacugcacagcggagugccgaguagguuuuccgguucuggcagcgggaccgauuucacauugacuauuuccucauuacaacccgaggacuuugccaccuauuacugucagcaguauaguacaguaccuuggaccuucggacagggcacuaaaguggaaaucaagcgg

SEQ ID NO: 23019 - RNA, 321 nt, Artificial Sequence
  derived and/or modified sequence opt3 from Bevacizumab_LightChain_V-Region
gacauccagaugacccaaagccccuccucucugucagccagugugggcgauagagucacaauuacuugcagcgcuucccaggacauaucuaacuaccucaauugguaucagcagaagccugggaaagcaccaaagguucuuaucuacuucacgucgucacugcacagcggagugccgaguagguuuuccgguucuggcagcgggaccgauuucacauugacuauuuccucauuacaacccgaggacuuugccaccuauuacugucagcaguauaguacaguaccuuggaccuucggacagggcacuaaaguggaaaucaag

SEQ ID NO: 23020 - RNA, 369 nt, Artificial Sequence; identical to SEQ ID NO: 23014
  derived and/or modified sequence opt3 from Bevacizumab-rhuMAb-VEGF_HeavyChain_gamma1-Chain_VDJ-Region

SEQ ID NO: 23021 - RNA, 321 nt, Artificial Sequence; identical to SEQ ID NO: 23019
  derived and/or modified sequence opt3 from Bevacizumab-rhuMAb-VEGF_LightChain_VJ-Region

SEQ ID NO: 23022 - RNA, 1341 nt, Artificial Sequence
  derived and/or modified sequence opt3 from Bevacizumab_gamma1-Chain
gaggugcagcuggucgaaagcggcgggggacucguucaacccgguggcucccuuagacugucuugcgccgcuucaggguacaccuucacaaacuauggaaugaauugggugaggcaggcaccuggcaaggguuuggaguggguaggguggaucaacacuuacacgggagaaccaaccuaugccgcggacuuuaaacggcgcuucacauuuaguuuagauacuagcaaguccaccgcuuaccugcagaugaacucucuacgagccgaggacacagcaguguauuacugugccaaauauccgcacuacuacggcucgucacauugguauuucgaugucuggggccaggggacccucgugacuguuagcagugcuuccacaaagggacccucuguguuuccucuggcaccaagcuccaaaucaaccagugguggcacggccgcucuugggugccuggucaaggacuacuuccccgaaccugugacuguaagcuggaacucuggagccuugaccuccggcguucacacauuuccagcggugcuccaaucaagcgguagucugucuuccgucgugacugugcccagcucgucucuggggacccagacauauauuuguaaugucaaucauaagccuuccaauaccaaaguugauaagaaaguggagccaaagucaugcgacaaaacgcacacuuguccgcccugcccugcaccagagcucuuaggaggccccaguguauuccuguuuccuccaaagcccaaggauacacuuaugauaagccguaccccggaagugacuugugucgugguugacgugucccaugaggauccugaagucaaauucaacugguacguggacggcguagagguucacaaugccaagacaaaacccagagaggaacaguauaacucuuacguggucagcguguugaccguccugcaccaggauuggcuaaaugggaaggaguauaaaugcaaggugucaaacaaagcucucccagccccuaucgaaaagacgauuaguaaggcaaaaggacaacccagggagccacagguuuacacccugcccccuucccgggacgaacuuacaaagaaucaggugagccugacuuguuugguaaaagguuuuuacccaucugauaucgcugucgagugggagucaaacggccagccggaaaauaacuauaagaccacacccccugugcucgacagugacgggagcuucuuuaaaaagcugacuguugauaagucccgcuggcaacagggaaacguguucucuugcucggucaugcaugaggccuuacacaaucauuacacccagaaaagccugucccucucaccaggcaag

SEQ ID NO: 23023 - RNA, 1359 nt, Artificial Sequence
  derived and/or modified sequence opt3 from Bevacizumab_gamma1-Chain_CH3-Region_mutein
gaggugcagcuggucgaaagcggcgggggacucguucaacccgguggcucccuuagacugucuugcgccgcuucaggguacaccuucacaaacuauggaaugaauugggugaggcaggcaccuggcaaggguuuggaguggguaggguggaucaacacuuacacgggagaaccaaccuaugccgcggacuuuaaacggcgcuucacauuuaguuuagauacuagcaaguccaccgcuuaccugcagaugaacucucuacgagccgaggacacagcaguguauuacugugccaaauauccgcacuacuacggcucgucacauugguauuucgaugucuggggccaggggacccucgugacuguuagcagugcuuccacaaagggacccucuguguuuccucuggcaccaagcuccaaaucaaccagugguggcacggccgcucuugggugccuggucaaggacuacuuccccgaaccugugacuguaagcuggaacucuggagccuugaccuccggcguucacacauuuccagcggugcuccaaucaagcggucuguauagucugucuuccgucgugacugugcccagcucgucucucgggacccagacauacauuuguaaugucaaucauaagccuuccaauaccaaaguugauaagaaaguggagccaaagucaugcgacaaaacgcacacuuguccgcccugcccugcaccagaguuacugggaggccccaguguauuccuuuuuccuccaaagcccaaggauacauugaugauaagccguaccccggaagugacuugugucgugguugacgugucccaugaggauccugaagucaaauucaacugguauguggacggcguagagguucacaaugccaagacaaaacccagagaggaacaguacaacucuaccuauaggguggucagcgugcugacgguccuacaccaggauuggcucaaugggaaggaguacaaaugcaaggugucaaacaaagcucugccagccccuaucgaaaagaccauuaguaaggcaaaaggacaaccccgggagccacagguuuguacacuucccccuucccgcgacgaacugacuaagaaucaggugagcuugucuugcgcuguaaaagguuuuuacccaucagauaucgccgucgagugggagaguaacggccagccggaaaauaacuauaagaccacacccccugugcucgacagcgacggguccuucuuucugguuucuaaauuaacuguggauaagucgagauggcaacagggaaacgucuucagcuguuccgugaugcaugaggcgcugcacaaucauuacacccagaagucacucagucuuucuccaggcaaa

SEQ ID NO: 23024 - RNA, 1347 nt, Artificial Sequence; identical to SEQ ID NO: 22937
  derived and/or modified sequence opt3 from Bezlotoxumab_HeavyChain1

SEQ ID NO: 23025 - RNA, 645 nt, Artificial Sequence; identical to SEQ ID NO: 22938
  derived and/or modified sequence opt3 from Bezlotoxumab_LightChain1

SEQ ID NO: 23026 - RNA, 1335 nt, Artificial Sequence
  derived and/or modified sequence opt3 from Bimagrumab_HeavyChain1
caggugcaacugguccagagcggcgccgagguuaagaaacccggggcuuccgugaagguaucuugcaaagcaucaggauacaccuucacaaguagcuauaucaacugggugagacaggccccuggucagggccucgaauggauggggacuauuaauccagucuccggaucuacgucguacgcgcaaaaguuucagggcagggugaccaugacacgggacacuucaauaagcaccgcuuauauggagcuuagucgccugcgauccgaugacacagccguuuacuauugugcacguggugggugguucgauuacuggggacagggcaccuuggugacugucucuagcgccuccacaaaaggcccgucaguguuucccuuagcuccuaguagcaagucuaccuccgggggaacggcagcccuggguugccuaguaaaggacuauuucccagaacccguuacugugucauggaacagcggcgcucucaccagugggguccacacauuuccugccgugcugcagucuuccggacuuuacagccugucgucuguggucacuguuccauccucaaguuugggcacccaaacauacaucuguaaugugaaccauaaacccagcaauaccaagguagauaaaagaguggagccuaaguccugcgacaaaacgcacacuuguccaccgugccccgcgccugaagcagccggugggccaucugucuuccucuuucccccuaagccaaaggauacacugaugauuagcaggacccccgaggugacuuguguuguggucgacgugucacaugaggauccggaaguaaaauucaacugguauguugacggaguggagguccacaaugcuaagacaaaaccucgggaggaacaguacaacaguaccuaucgcguggucuccgugcugacgguucuccaucaggauugguuaaauggcaaggaguacaaaugcaaggugagcaacaaagcccugcccgcaccaaucgaaaagaccauuucuaaggcuaaaggccagccuagagagccccaaguauauacacuuccacccucaagggaagagaugacuaagaaucaggucaguuugaccugucuggugaaaggguuuuacccuagcgacaucgccguugaaugggaguccaacggacagccagagaauaacuauaagacaacuccgcccgugcuagauucugacgguucguucuuucucuacagcaaacugaccgucgacaagucccgguggcaacagggcaauguguucucaugcaguguaaugcacgaagcgcuucacaaccauuacacacagaagucucugagcuuguccccugggaaa

SEQ ID NO: 23027 - RNA, 1332 nt, Artificial Sequence
  derived and/or modified sequence opt3 from Bimagrumab_HeavyChain
caggugcaacugguccagagcggcgccgagguuaagaaacccggggcuuccgugaagguaucuugcaaagcaucaggauacaccuucacaaguagcuauaucaacugggugagacaggccccuggucagggccucgaauggauggggacuauuaauccagucuccggaucuacgucguacgcgcaaaaguuucagggcagggugaccaugacacgggacacuucaauaagcaccgcuuauauggagcuuagucgccugcgauccgaugacacagccguuuacuauugugcacguggugggugguucgauuacuggggacagggcaccuuggugacugucucuagcgccuccacaaaaggcccgucaguguuucccuuagcuccuaguagcaagucuaccuccgggggaacggcagcccuggguugccuaguaaaggacuauuucccagaacccguuacugugucauggaacagcggcgcucucaccagugggguccacacauuuccugccgugcugcagucuuccggacuuuacagccugucgucuguggucacuguuccauccucaaguuugggcacccaaacauacaucuguaaugugaaccauaaacccagcaauaccaagguagauaaaagaguggagccuaaguccugcgacaaaacgcacacuuguccaccgugccccgcgccugaagcagccggugggccaucugucuuccucuuucccccuaagccaaaggauacacugaugauuagcaggacccccgaggugacuuguguuguggucgacgugucacaugaggauccggaaguaaaauucaacugguauguugacggaguggagguccacaaugcuaagacaaaaccucgggaggaacaguacaacaguaccuaucgcguggucuccgugcugacgguucuccaucaggauugguuaaauggcaaggaguacaaaugcaaggugagcaacaaagcccugcccgcaccaaucgaaaagaccauuucuaaggcuaaaggccagccuagagagccccaaguauauacacuuccacccucaagggaagagaugacuaagaaucaggucaguuugaccugucuggugaaaggguuuuacccuagcgacaucgccguugaaugggaguccaacggacagccagagaauaacuauaagacaacuccgcccgugcuagauucugacgguucguucuuucucuacagcaaacugaccgucgacaagucccgguggcaacagggcaauguguucucaugcaguguaaugcacgaagcgcuucacaaccauuacacacagaagucucugagcuuguccccuggg

SEQ ID NO: 23028 - RNA, 651 nt, Artificial Sequence
  derived and/or modified sequence opt3 from Bimagrumab_LightChain1
cagagcgcccugacccaacccgcuuccgugucuggcucaccugggcagaguaucacaauuagcugcacuggaacguccucugacgucgguucguacaacuauguuaauugguaccagcagcacccaggcaaggcaccgaaacucaugauauauggggugucaaagagacccagcggaguaaguaacagguucuccggcucuaaaagcgguaauaccgccucccuuacaaucucagggcugcaagcggaggaugaagcugacuacuauuguggaacuuuugccggcggcaguuacuaugggguguucggagguggcaccaaguugacagucuuagggcagccuaaagcagccccaagcgugacccuguuucccccuucuuccgaggaacuacaggcuaacaaggcaacucucguuugccugauuucagauuucuacccaggagccgugacagucgcuuggaaggccgacagcagucccgugaaagcgggcguagagaccacgacuccuucuaagcaguccaauaacaaauacgcagccagcucguaucuuucucugaccccagaacaauggaagucccaucggucauacaguugucagguuacacacgaggguagcacuguggagaaaaccgucgcuccgacagaaugcucc

SEQ ID NO: 23029 - RNA, 1365 nt, Artificial Sequence
  derived and/or modified sequence opt3 from Bimekizumab_HeavyChain1
gaggugcagcuggucgaaagcggcgggggacucguucaacccgguggcucccuuagacugucuugcgccgcuucaggguucaccuuuagugacuacaacauggcaugggugaggcaggccccuggaaagggcuuggaguggguagcgacaaucacuuaugaaggucggaauacguacuaucgcgauagcgugaaagggcgauucaccauuucccgugacaacgcuaaaaauucuuuauaccugcagaugaacucgcuaagagccgaggauacagcagucuauuacugugccucaccaccgcaguauuacgaaggaagcauauacaggcucugguuugcucacuggggccaaggcacucuggugaccguuaguuccgcaucuacaaaggggcccagcguguucccucuugccccauccucaaagaguaccagcggagguacugcugcccugggcugcuuggucaaagacuauuuucccgagccugugacaguaucuuggaacuccggggcgcucaccucaggaguucauacguucccagcagugcugcagagcaguggccuguacucucucuccagcgucgugacugugcccucgucuuccuuagguacccagacauauaucuguaaugucaaucacaagccuucaaacacuaagguugauaaaaagguggagccaaaaaguugcgacaagacccauacauguccgcccugcccugccccagaacugcuugggggacccagcguauuuuuguucccuccaaaacccaaggauacccugaugauuucccggacgccggaggugacuugugucgugguugacgugucucacgaagauccugaggucaaguuuaauugguacguggacggcguagagguucauaacgcuaaaacaaagccccgcgaggaacaguauaauagcaccuacagaguggucucagugcuaacuguccuccaccaagauuggcugaacggcaaagaauauaagugcaaagugaguaauaaggcccuuccagcaccuaucgagaaaacaauuuccaaggcuaaggggcagcccagggaaccacagguuuacacccugcccccuagccgggacgaguugacgaaaaaccaggugucucucaccugucugguaaagggauucuacccaucagauaucgccgucgagugggaaaguaauggucaaccggagaacaacuauaaaacaacucccccuguguuagacagcgacggcuccuuuuuccuguacucuaagcucaccguugauaaaucgcgcuggcagcaggggaauguguuuagcugcuccgucaugcacgaagcgcuucauaaccacuauacacaaaagucacugaguuugucuccaggaaag

SEQ ID NO: 23030 - RNA, 642 nt, Artificial Sequence
  derived and/or modified sequence opt3 from Bimekizumab_LightChain1
gccauccagcugacccaaagccccuccucucucucagcuagugugggcgacagagucacaauuacuugcagggcagaugagagcguucggacgcuuaugcacugguaccagcagaagccugggaaagccccaaagcuguugauauauuuaguguccaacucugaaaucggaguaccggaccgcuucucggguucaggcagcgggaccgauuuucgacugacaauuaguucccuacagcccgaggacuucgcgacuuacuauugucaacagaccuggucugauccuuggacauuuggacagggcaccaaaguggaaaucaagcguacugucgcugccccaagcguguucauuuuucccccuuccgacgagcagcucaaaucagguacagcaaguguugugugccugcuuaauaacuucuacccaagagaagccaagguccaauggaagguggauaaugcucugcagagcgggaacucucaggaguccguaaccgagcaggacucaaaagauagcacguauaguuugucuuccacucucacccugagcaaggcagacuacgaaaaacauaagguuuaugccugugaggugacacaccaaggacugucgucucccgucacuaaauccuuuaauaggggcgaaugc

SEQ ID NO: 23031 - RNA, 1344 nt, Artificial Sequence
  derived and/or modified sequence opt3 from Bleselumab_HeavyChain1
cagcugcaacuccaggagagcggccccgggcuucugaagccuuccgaaaccuugucuuuaacaugcacugugucaggagguaguaucagcuccccaggcuacuaugggggauggauuagacagccgcccggcaaaggucuggaguggauagggucuaucuacaagucgggaucaacguaucacaacccuagccuaaaaaguagggucaccauuuccguugacacaucuaagaaucaguucagccucaaacuguccucagugacugccgcugauaccgcaguauacuauuguacacggccagugguccgcuacuuuggcugguucgaccccuggggccaagggacccuugugacuguuaguagcgccucuacaaagggaccuuccguguuuccacuggcgcccugcucacgaagcaccagugaaucuacggcugccuuggguugucucgucaaggauuauuucccugagccagugacuguauccuggaacagcggcgcacugaccucggggguucauacauuuccggccgugcugcagucuuccggacucuacucauuaaguagcgucgugacugugcccuccucuagccugggcaccaaaacauacacaugcaaugucgaccacaagccuucaaacacgaaaguugauaagcguguggaaaguaaauaugguccacccuguccuccaugccccgcuccggaguucgaagggggaccuuccguauuucuuuuucccccaaagccuaaggacacuuugaugaucagcagaacacccgaagugaccugugucgugguugaugugucucaggaggacccagaaguccaguucaauugguacguggauggcguagagguucauaacgcaaaaacuaagcccagggaggaacaauucaauucaacauaucggguggucagugugcugaccguccuacaccaggacuggcucaacggcaaagaguacaagugcaaagugagcaauaaggggcugccuuccucuauugagaaaacgaucucgaaggccaagggacagccacgcgagccgcagguuuauacccuucccccuagccaagaagagaugaccaaaaaccaggugucccugacuuguuugguaaaggguuuuuacccaucagauauagcugucgagugggaaaguaauggccagcccgagaacaauuauaaaaccacaccuccagugcucgacucugaugggagcuucuuucuguacuccagauuaacuguugacaagucaagguggcaagaaggaaacguguucagcugcucugucaugcaugaggcccugcacaaucacuacacccagaaaucccucagucuuagccugggcaag

SEQ ID NO: 23032 - RNA, 639 nt, Artificial Sequence
  derived and/or modified sequence opt3 from Bleselumab_LightChain1
gccauccagcugacccaaagccccuccucucucucagcuagugugggcgacagagucacaauuacuugcagggcaagccaggggauauccucugcccuugcgugguaccagcagaaaccuggaaaagcuccaaagcuguugaucuaugaugccucgaacuuagagucagguguuccgagccgguucaguggcuccgggucuggaacggacuuuacccugacaauuagcucccuacaacccgaagauuucgcaacuuacuauugucagcaguuuaauucauacccuaccuucggccaggguacaaaaguggagaucaagcgcaccguagccgcuccaaguguguuuauuuuucccccuagcgacgaacaacucaaaucugggacugcauccgucgugugccugcuuaacaauuucuauccacgagaggccaagguucaguggaagguggauaacgcucugcagucaggaaauagccaggaaagugucacagagcaagacucuaaagauuccaccuacagcuugucgucuacgcucacucuguccaaggccgacuaugagaaacacaagguguacgcgugugaaguaacccaucagggccugucaagucccguuacaaagagcuucaaccguggcgagugc

SEQ ID NO: 23033 - RNA, 1512 nt, Artificial Sequence
  derived and/or modified sequence opt3 from Blinatumomab_HeavyChain1
gacauccagcugacccaaagccccgccucccucgcugugucucuuggccagagagcaacaauuucaugcaaggccagucagagcgucgauuacgacggggauuccuaucugaacugguaccagcaaauaccuggacagccaccgaaauuguuaaucuaugacgcgucuaaucugguuucggguauucccccuagguucucaggcagcgggaguggaacugauuuuacgcuaaacauccacccaguggagaagguagacgcugccaccuaccauugucagcaguccacagaagaucccuggacuuucggcggugggaccaaacucgagauuaagggaggcggcgggucuggagguggcgggagcggaggcggugggucccaagugcagcugcagcagucaggagcagaacuuguccggccuggcaguagcgugaaaaucucuugcaaggccuccggcuaugcuuuuucaagcuacuggaugaauuggguuaagcaacgcccagggcagggacuggaguggauaggucagaucuggcccggcgacggggauacaaacuauaauggaaaauucaagggcaaagcaaccuugacugccgacgaaaguucuuccacagcuuacaugcaacucagcucgcuggccucugaggauuccgcgguguacuuuugugcacgacgugagaccacgacugucgguagauauuacuaugccauggacuacugggggcagggcaccacagugacuguaucaaguggaggcgggggaagcgauauuaagcugcagcaguccggugcugaacucgccaggccuggcgcaucuguuaaaaugagcugcaagaccucaggguauacauucacccgguacacgaugcacugggugaagcaacgcccaggacagggcuuagaguggaucgguuauauuaacccgaguagaggguacacuaauuacaaccagaaauuuaaggacaaagcuacacugaccacugacaaguccagcucuacagccuauaugcagcuuucaaguuugaccagcgaagauuccgcggucuacuauugugccagguacuaugacgaucauuacugccuggacuauuggggccaaggaacgacccuaacagugucuucgguggagggcgggagcggagguuccggcgggucaggaggcagugguggggucgaugacauccagcucacucagucucccgcaauaaugagcgcuuccccuggcgagaaaguuaccaugacaugucgggccucaagcucuguguccuacaugaauugguaccagcaaaagaguggaacuagcccaaaacgcuggauuuaugauaccucuaagguagcuuccggcgugcccuaccgauucucagggaguggaagcggcacaucguauucccugaccaucucuagcauggaagccgaggacgcagccacuuacuauugccagcaguggucaaguaacccucuuacguuuggugcugggacaaagcuggaauugaaacaccaucaccaccaucac

SEQ ID NO: 23034 - RNA, 1512 nt, Artificial Sequence; identical to SEQ ID NO: 23033
  derived and/or modified sequence opt3 from Blinatumomab_SingleChain

SEQ ID NO: 23035 - RNA, 1512 nt, Artificial Sequence; identical to SEQ ID NO: 23033
  derived and/or modified sequence opt3 from Blinatumumab_SingleChain_variable_fragment_fusion_protein_(bite)

SEQ ID NO: 23036 - RNA, 1344 nt, Artificial Sequence
  derived and/or modified sequence opt3 from Blontuvetmab_HeavyChain
caggugcaacugcagcagagcagagccgagcucgucaggcccggcgcuuccguuacccuuucuugcaagccuucaggguacacauucacugacuaugaagugcacuggguaaaacagacgccagugcauggacuggaguggaucggugcaauugauccggaaaccggcgggacagccgacaaccaaaaguuuaaaggaaaggcgauauugacugcugauaaaaguagcuccaccgccuacauggaguuacggucucugacaucggaagacucagcagucuauuacuguaccaauuucguggauguuuggggcacugguacaaccgugacggucagcagugccuccacuaccgcucccucuguguuuccucuagcaccaagcugcgggucccagucaggaaguacaguagcccucgcuugucugguuagcggcuauuuccccgagccugugacugucucuuggaacuccggcucacuuaccagcggggugcacacauuuccaagugugcugcagucuuccggauuguacagccucucgucuauggucaccguucccuccucacgcuggccuagugagacguucacuugcaauguggcccauccagcgagcaagacaaagguagacaaaccggugcccaagcgagaaaacggucgugucccuagaccacccgauuguccuaaaugcccagcacccgagaugcugggcgggccguccguguuuaucuucccucccaagccaaaagacacccugcucauugccaggacuccugaaguuacauguguggucguggauuuagaccccgaggauccagagguacagaucucuugguuuguugacggaaagcaaaugcagaccgcuaagacgcagccccgggaggaacaguucaauggcaccuaucgcguggucagcgugcugccuauuggucaccaagauuggcuuaaagggaagcaguuuacaugcaaagucaacaauaaggccuugccaucaccgaucgaaagaacuauaaguaaagcaaggggacaggcucaucaacccuccguguacguucugccuccaagccgggaggaacuaucuaagaacaccgugucacucacaugucugaucaaagacuucuuucccccugacauugauguagaguggcagaguaauggccagcaggagccagaaagcaaguaccgcacuacacccccgcaacuugacgaggauggcuccuauuuccuguacucuaaguugucggucgacaaaagccgauggcagagaggggauaccuucaucugcgccgugaugcacgaagcgcuccacaaccauuauacccagaagucccugucacacaguccuggaaaa

SEQ ID NO: 23037 - RNA, 657 nt, Artificial Sequence
  derived and/or modified sequence opt3 from Blontuvetmab_LightChain
gacguggucaugagccagucccccucuucacuggccguuagugugggcgagaagguaaccaugagcugcaaauccucucaaucgcuccuuuacucagggaaccagaagaauuaucuggcuugguaccagcagaaaccuggacaaagcccaagauuguuaaucuauugggcaaguacaagggaauccggugugccggaucgguucacuggcucugggagcggaacggacuuuacccugacaauuuccucagucaaggccgaggaucuagcgguguucuacugucagcaguauuacaacuauccccucacuuuuggcggugggacccaccugacaguucuuggacagccuaaagcuaguccaagcgugacccuguuucccccuucuuccgaagaguugggcgccaauaaggcaacucucgucugccugauaucagacuucuacccaagcggcgugacaguagccuggaaggcugaugggagucccaucacccaaggaguugaaacgacuaaaccuucuaagcaguccaacaauaaauacgcagccagcucguaucugucucucaccccagacaaguggaaaucccauucaaguuucagcuguuuagugacacacgaggguuccacugucgagaagaagguggcuccggccgaaugcucu

SEQ ID NO: 23038 - RNA, 1332 nt, Artificial Sequence
  derived and/or modified sequence opt3 from Blosozumab_HeavyChain1
caggugcaacugguccagagcggcgcugagguuaagaaacccggggcuuccgugaagguaucuugcaaagugucaggauucccuaucaaggacaccuuucagcacugggucagacaggcaccagguaaaggccucgaauggaugggguggagugauccggagauuggagacacagaauacgccagcaaguuccaaggcagggugacuaugacggaggauaccuccacagacacugcguauauggaacuuucuucgcugcggucagaggauaccgcuguuuacuauugugccacaggugacaccacuuacaaguuugauuucugggggcagggaacaaccgugacggucagcagugcauccacuaaaggccccucuguguuuccuuuggccccaugcagccgcuccaccucagagaguacagcugcauuaggcugucugguaaaggacuauuuccccgaaccuguuacugugagcuggaacucuggggcccuaaccuccggaguccauacauuuccagcugugcuccagucaagcggucuguacagucuuucuuccguggucaccguucccagcucgucucugggcacgaaaacuuauacaugcaauguggaucacaagccuuccaacaccaaaguagacaagcgaguggagucaaaguacgggccaccgugucccccuugcccagcccccgaguucuugggaggcccuagugucuuucucuucccacccaaaccgaaggauacucugaugauaagccguacaccugaggugaccuguguuguggucgacgugucccaggaggaucccgaaguacaauuuaauugguacguugacgguguggagguccauaacgcgaaaacgaagccaagagaagaacaguucaauucuaccuauaggguggucagcgugcugacaguucuccaccaggacugguuaaacgggaaagaauacaagugcaaagugucaaauaagggacugccuaguuccaucgagaagacuauuagcaaagcaaagggccagccccgggagccacaaguauauacccuucccccuucucaggaagagaugacuaaaaaccaggucucauugacaugucuggugaagggcuuuuacccaagugauaucgccguugaaugggagagcaaugggcaaccggaaaacaauuauaaaaccacacccccugugcuagacuccgauggaucuuucuuccucuacucgcgccugaccgucgacaagagcagauggcaggaggguaacguguuuuccugcucaguaaugcaugaggcccuucacaaucacuauacucagaagagucugucuuugagccucggc

SEQ ID NO: 23039 - RNA, 642 nt, Artificial Sequence
  derived and/or modified sequence opt3 from Blosozumab_LightChain1
gacauccagaugacccaaagccccuccucucugucagccagugugggcgauagagucacaauuacuugcaaggcuagccaggacguucacacggcaguggccugguaccagcagaaaccugggaaggcgccaaaacuccuuauauauugggcuuccaccagguggacaggaguaccgucucgguucucggguucaggcagcgggacugauuuuacccugacaaucaguuccuugcaacccgaggacuucgccaccuacuauugucagcaguacucugauuauccuuggacuuuuggaggcgguacaaagguggaaauuaaacgcaccgucgcagccccaagcguguucaucuuucccccuuccgacgagcaguuaaagucagggacggcuaguguugugugccugcuaaacaauuucuacccacgagaagcaaagguccaauggaaaguggauaacgcccuccagagcggaaauucucaggaguccguaacugaacaggacucaaaggauagcaccuauagucugucuuccacacuuacucugagcaaagcugacuacgagaagcauaaaguuuacgccugugaggugacccaccaaggcuugucgucucccgucacaaaguccuuuaaccguggcgaaugc

SEQ ID NO: 23040 - RNA, 1332 nt, Artificial Sequence
  derived and/or modified sequence opt3 from Bococizumab_HeavyChain1
caggugcaacugguccagagcggcgccgagguuaagaaacccggggcuuccgugaagguaucuugcaaagcaucaggauacaccuucacaaguuauuacaugcacugggugagacaggccccuggucagggccucgaauggaugggggagaucagcccauuuggaggcaggacuaacuauaaugaaaaguucaaaucccgggucacgaugacccgcgacacaucuacuucgaccguguacauggagcuuucaagccugcgaagugaagauacagcgguuuauuacugugcucgugagagaccguuguaugccuccgacuuauggggucaagggaccacugugacagucucuagcgcauccaccaagggacccucaguguuuccucuggccccaugcaguaggagcacgucugaguccacugcugcacuaggcugucucguaaaggauuacuuccccgaaccuguuaccgugucauggaacagcggcgcccugacaagugggguccauacuuuuccagcugugcuucagucuuccggacuguacagcuugucgucuguggucaccguucccuccucaaauuucgguacacagaccuauacgugcaacguggaccacaaaccuaguaauacuaagguagauaaaacaguggagcggaaguguugcgucgaauguccaccgugccccgccccuccaguggcgggccccagcguuuuucucuucccuccaaaacccaaggacacccugaugauuucccgcacuccggaggugacaugugucgugguagauguuucucaugaggacccugaagugcaguuuaacugguacgucgaugggguggagguccacaaugcaaagaccaaacccagagaggaacaauucaacagcacguuuagggugguuucagugcugaccguaguccaucaggacuggcucaauggaaaggaauauaaaugcaaggugaguaacaaaggcuuaccauccagcauagagaagacaaucucuaaaacuaagggucagccucgggagccccagguuuacacccugccacccucacgcgaagagaugacaaagaaucaagugagucuuacuuguuuggucaaaggguucuauccuagcgauauugccguggaaugggaguccaacggacagccagaaaauaacuacaagaccacaccgcccaugcuggacucugauggcucguuuuuccuauauagcaaacucaccguagacaagucccgauggcagcaaggcaauguguucucaugcaguguuaugcacgaggcucugcacaaccauuacacucagaaaucucuuagccuguccccugggaag

SEQ ID NO: 23041 - RNA, 642 nt, Artificial Sequence
  derived and/or modified sequence opt3 from Bococizumab_LightChain1
gacauccagaugacccaaagccccuccucucugucagccagugugggcgauagagucacaauuacuugcagggcuagccaggggauauccucugcacucgccugguaccagcagaagccuggaaaagcgccaaaacuucugaucuauucggcuucauaccgguauacggguguuccgagccgcuucaguggcuccgggucuggaaccgacuuuacauucacuauuagcuccuugcaacccgaggauaucgccaccuacuauugucagcagcgauacucauuauggcguacauuuggccaggguaccaaacuggaaauuaagagaacuguggcagccccuaguguauucaucuuuccacccagcgacgagcaacuaaaaucugggacagcuuccguggucugccuccugaacaauuucuauccuagggaagcaaaggugcaguggaagguugauaacgcccuucagucaggaaauagccaggagagugugaccgaacaagacucuaaagauuccacguacagccugucgucuacuuugacccucuccaaggcugacuacgagaaacacaaggucuaugccugugaggugacacaucagggccugucaaguccaguaacuaagagcuuuaaccggggcgaaugc

SEQ ID NO: 23042 - RNA, 1338 nt, Artificial Sequence
  derived and/or modified sequence opt3 from Brentuximab_vedotin_HeavyChain1
cagauccaacugcagcagagcggccccgagguggucaagccuggggccuccguuaaaauuucuugcaaggcuucaggauacaccuucacagacuauuacauaacuugggugaaacagaagccaggucaaggccucgaauggaucggguggauuuauccgggaaguggcaacacgaaauacaaugagaaguuuaaggguaaagcaacccuuacaguagauacuagcuccucuaccgccuucaugcagcugucgucauugacaagcgaagacaccgcgguguauuuuugugcuaacuacgggaauuauugguucgccuacuggggacagggcacucaggucacagugagugcagccuccaccaagggccccucuguuuuuccuuuagcuccaagcuccaaaucaacgagugggggaacugcagcccuggguugccuagugaaggauuacuuccccgagccugucaccgugagcuggaacucuggcgcucucacauccgggguacacacuuuuccagccguucugcaaucaagcggacuuuauagucugucuuccguggucaccgugcccagcucgucuuugggcacacagaccuacaucuguaaugugaaccauaaaccuuccaauacgaaggucgacaagaaaguugaaccaaagucaugcgauaaaacucacacauguccgcccugcccugcgccagagcuccugggugggcccaguguguuccuguuuccuccaaagcccaaagacacccucaugauuagcagaacuccggagguaacauguguggucguggauguuucccaugaagacccugaggugaaguucaacugguaugucgauggaguggaaguacacaaugcaaaaaccaagcccagggaggagcaguacaacucuacguaucggguugugagcgucuuaaccgugcugcaucaggacuggcuuaauggcaaggaauacaaaugcaaggucucaaacaaagccuugccagcuccuaucgagaagacaauaaguaaagccaagggccaaccccgcgaaccacagguguauacucugcccccuucccgagaugagcuaaccaagaaucagguuagccucacaugucuggugaaaggguuuuacccaucugacaucgcaguagaaugggagucaaacggacaaccggagaauaacuacaagacuacacccccuguccuugauagugacgguagcuucuuucuguauuccaaauugaccguggacaagucucguuggcagcagggcaacguuuucucgugcagcgugaugcacgaagcucuccacaaucauuacacccagaaaucccugucauuaaguccaggg

SEQ ID NO: 23043 - RNA, 654 nt, Artificial Sequence
  derived and/or modified sequence opt3 from Brentuximab_vedotin_LightChain1
gacaucgugcugacccagagccccgccucccucgcugucucucuuggccaaagagcaacaauuucaugcaaggccagucagagcguugauuucgacggggauuccuacaugaacugguaucagcagaaaccuggacaaccaccgaaggugcugauauacgcggcuucuaauuuggagucggguauccccgccagguuuucaggcagcgggaguggaacugacuucacguuaaacauucacccuguagaagaggaagaugcagccaccuauuacugucagcaguccaaugaggacccauggacauuuggcggugggacuaaacuggaaaucaagcggaccguggcugcacccucugucuucauuuuuccuccaagcgaugagcagcuaaaauccggaacagccucagugguuugccuccugaacaauuucuauccccgcgaggcuaaggugcaauggaaggucgacaacgcccuucagaguggcaauagccaggaaucugugaccgagcaggauuccaaagacucaacuuacagccugaguucuacauugacccucuccaaggcggauuaugaaaaacauaagguauacgcaugugagguuacgcaccaaggccugagcucgccugugacuaaaucuuuuaaccgaggggagugc

SEQ ID NO: 23044 - RNA, 1335 nt, Artificial Sequence
  derived and/or modified sequence opt3 from Briakinumab_HeavyChain1
caagugcaacuggucgagagcggcgggggaguugugcagcccgguagaucccucaggcuuucuugcgccgcuucaggcuucaccuuuaguagcuacgggaugcacuggguacggcaggcaccuggaaagggccuggaauggguggccuucauccgcuaugacgguuccaacaaauacuaugcggauucugucaaggggcgauuuacaauuucgcgugacaauucuaaaaacacuuuguacuuacagaugaauagccugagagcugaggauacggccguguauuacuguaagacccauggaagucacgacaacuggggccaaggcacaaugguuacuguguccucugcaagcaccaaagggccauccgucuucccgcuagcccccucaaguaagagcacaucuggagguaccgcugcacucggcugccuggugaaggauuauuuuccugaaccaguaacuguuuccuggaacucaggggcccuuacaagcggagugcauaccuuccccgcuguccugcagaguucuggcuuguacucccucagcucgguggugacggucccuucuuccucacuggguacucagaccuacauauguaauguuaaucacaaaccaaguaacacaaagguggacaaaaagguagagcccaaaagcugcgauaagacucauaccuguccuccaugcccggcccccgaacugcucgggggaccuuccguguuuuuauucccacccaagccuaaagacacacugaugaucucuaggaccccagaggucacgugugugguuguggaugucagccacgaggaccccgaagugaaguuuaauugguauguagauggcguugaggugcacaacgcgaaaacuaagccgcgggaggaacaguacaauucaacauaucgcgucgugaguguccuuaccguguugcaucaagacuggcugaacggcaaagaguacaagugcaaaguuuccaauaaggcacuaccugcccccauugaaaagacuaucagcaaagcuaaggggcagccaagagagccucagguguauacacugcccccaucuagggaagagaugaccaaaaaccagguaucacucacgugucuugucaagggauucuaccccagugauauugccguggaaugggagagcaauggucaaccugagaacaacuauaaaaccacaccaccgguucuggacuccgacggcucauuuuucuuguacucgaagcucacuguggauaagagccgguggcagcaggggaaugucuuuuccugcucagugaugcacgaagcacugcauaaccacuacacccagaaaaguuuaucucugagccccggaaag

SEQ ID NO: 23045 - RNA, 651 nt, Artificial Sequence
  derived and/or modified sequence opt3 from Briakinumab_LightChain1
cagagcgugcugacccaacccccuuccgucucuggcgccccagggcagagaguuacaaucucaugcaguggaagcagguccaacauugguucuaauacugugaagugguaccagcagcucccgggcacggcucccaaacuucugauauauuacaacgaccaacggccuucggggguaccagaucgcuucucaggaagcaagaguggcaccuccgcaucuuuggccaucacagguuuacaggcggaggacgaagcugauuauuacugucagagcuaugaccgauacacucaccccgcccugcuauuugggaccggaacaaaagugaccguccucggccagccuaaggcagccccauccgugacucuguuucccccuucaagugaggaacuucaagcuaauaaagcaacacugguuugcuugauuagcgauuucuauccaggcgccgugaccgucgcuuggaaggccgacucuuccccggugaaggcggggguagagacgacuacccccucaaaacagagcaacaauaaguacgcagccaguucuuaccucucccugacaccugaacaguggaaaagccaucguucguauucuugucagguuacucacgagggauccaccguggagaagacagucgcuccaaccgaaugcuca

SEQ ID NO: 23046 - RNA, 1326 nt, Artificial Sequence
  derived and/or modified sequence opt3 from Brodalumab_HeavyChain1
caggugcaacugguccagagcggcgccgagguuaagaaacccggggcuuccgugaagguaucuugcaaagcaucaggauacaccuucacaagauaugguaucaguugggugaggcaggccccuggccaggggcucgaauggaugggauggauuagcacuuacuccggcaacacgaauuaugcgcaaaaacuucagggucgggucaccaugacaacugacaccucuacaucgaccgcuuacauggagcugcgcucauugcgaagcgaugacacugccguguauuacugugcacguagacaguuauauuuugauuacugggggcagggaacacugguuaccgugaguuccgccucuacgaagggcccaagcgucuucccgcuagcucccugcuccaggucaaccagugaaagcacugcagcccucggcugucuggugaaggacuacuuuccugagccaguaacaguuucuuggaacuccggggcucuuacuucaggagugcacaccuuccccgccguccugcaaagcagugguuuguauucucucuccagcguggugacagucccuucgucuaauuuuggcacccagacguacacuugcaacguugaucauaagccauccaauacaaaaguggacaagaccguagaacggaaauguugcguggagugucccccuugcccagcgccgcccgucgcagggccuucaguguuccuguuuccacccaagccuaaagauacucugaugauaagucgcacaccagagguuaccuguguggucguggacguaagccacgaagaucccgagguucaguucaacugguauguggacggagucgaagugcauaaugccaagacgaagccgagagaggagcaguuuaacuccaccuucagggucgugucuguucucacagugguacaccaagauugguuaaauggcaaagaauacaagugcaaagucagcaacaagggucugccugcucccaucgagaaaacuauuucaaagaccaaagggcagccacgggaaccucagguguauacacuucccccaagucgcgaggaaaugacuaagaaucaaguuuccuugaccugucuggugaagggauuuuaccccagcgacaucgccgucgagugggagucuaacggccagccugaaaauaacuauaaaacaaccccaccgaugcuagauucagacggcaguuucuuucucuacagcaagcugacuguggacaaaucccgauggcagcaggggaauguauucucuugcucggugaugcaugaggcacuucacaaccacuacacgcaaaagagccuguccuugucacccggaaaa

SEQ ID NO: 23047 - RNA, 642 nt, Artificial Sequence
  derived and/or modified sequence opt3 from Brodalumab_LightChain1
gagaucgugaugacccagagccccgccacacuguccgucucuccuggcgaaagagcuacucucucaugcagggcaagucaaagcguuuccucuaaccuugccugguuccagcagaagccagggcaggcgccgcggccccugauuuacgacgcuucgacgcgcgccaccggagugccugcacgauuuucagguagcggcagugggacagauuucacuuugaccauauccucuuuacaaagcgaggacuuugccguauauuacugucagcaguaugauaauuggccacugacauucggaggcgguaccaaaguggaaaucaagcguacugucgcugcacccuccguguuuauuuucccuccaucagacgagcagcuaaaaagugggacagccagcguugugugccuccugaacaauuuuuaccccagagaagcuaagguccaauggaaaguggauaacgcccuucagucuggaaauucccaggagucaguaaccgagcaggacagcaaggauaguacguauucucuguccagcacuuugacccucucgaaggcggacuacgaaaaacacaagguuuaugcaugugaggugacacaucaaggccugucuuccccugucacuaaaucauucaacaggggcgaaugc

SEQ ID NO: 23048 - RNA, 756 nt, Artificial Sequence
  derived and/or modified sequence opt3 from Brolucizumab_HeavyChain1
auggagaucgugaugacccagagccccuccacacugucugccucagucggcgacagaguuauuauaacuugccaagcuagugaaaucauucacagcuggcucgcaugguaccagcagaagccugggaaagccccaaaacuucugaucuauuuggcguccacguuagcuucuggagugccgucgagguucucagguagcggcaguggggccgaguuuacccugacaauuuccucucuacagcccgaugacuucgcaacuuacuauugucaaaacguauaccucgccagcaccaauggagcuaacuuuggccaggguacaaagcugaccgugcuugggggaggcggcggguccggagguggcgggucaggaggcggugggaguggaggcggcgggagcgaaguccagcugguggagucuggagguggcuugguucagccugggggaucccuccggcugucaugcacugcaagcggcuucagucugacagauuauuacuauaugaccugggugcgccaagccccagguaaggggcucgaaugggucggcuuuaucgaccccgaugacgauccuuacuacgcuacgugggccaaaggacgauucacuauaucucgugacaauuccaagaacaccuuauaucugcagaugaauagccuuagagcggaggauacagcaguguacuauugugccggcggggaccauaacucgggaugggguuuggauaucuggggccaggggacucugguaaccguuucuucc

SEQ ID NO: 23049 - RNA, 756 nt, Artificial Sequence; identical to SEQ ID NO: 23048
  derived and/or modified sequence opt3 from Brolucizumab_scFv_fragment

SEQ ID NO: 23050 - RNA, 1341 nt, Artificial Sequence
  derived and/or modified sequence opt3 from Brontictuzumab_HeavyChain1
caggugcaacugguccagagcggcgccgagguuaagaaacccggggcuuccgugaagaucucuugcaaaguaucaggauacacccucagagguuauuggauugaaugggugaggcaggcaccuggcaaggggcuugaguggauaggacagauccugccaggcacaggucggacuaacuacaaugaaaaauucaaggggcgcgucacgaugaccgccgacacaaguacugauaccgcguauauggaguugagcuccuuacgaucugaagacacagcuguguacuauugugcccguuuugauggaaacuacggcuauuacgcaauggacuacuggggccaagggaccacuguuacagugucgucagccagcaccaagggaccgagugucuucccccuggcuccuugcuccagaucuacgagcgaguccacugcagcccuagguugucucgugaaagauuauuuuccagagcccguaaccguuucauggaauaguggcgcucugacaagcggggugcacacuuucccugccguccuucagucuuccggacuguacucauugagcaguguggugaccgucccaucuuccaacuuuggcacacagaccuauacgugcaauguugaccauaagcccagcaacacuaaaguggauaagacaguagaaaggaaauguugcguggaguguccuccaugcccggcgcccccugucgcagguccaucgguguuccucuuucccccuaagccaaaggacacccugaugauuucucggacucccgaaguuacauguguggucguggauguaucccacgaggacccggagguucaguucaauugguacguggauggggucgaagugcauaacgccaaaaccaagccucgcgaggaacaauuuaauucaacguucagagucgugaguguucugaccgugguacaccaggacuggcucaacggaaaagaguauaagugcaaagucagcaauaagggcuuacccgcuccaaucgagaaaacaauuuccaagacuaagggccagccuagggaaccccagguguacacccugccacccucucgggaggaaaugacuaaaaaccaaguuagccuuacauguuuggugaagggguuuuauccuucagauaucgccgucgagugggaaaguaauggacagccagagaacaauuacaaaaccacaccgcccaugcuggacuccgacgguagcuucuuucuauacucuaagcucaccguggauaaaucacgcuggcagcaaggcaacguauucaguugcagcgugaugcaugaagcacugcacaaccacuauacucagaagucccuuucucugucgccugggaag

SEQ ID NO: 23051 - RNA, 645 nt, Artificial Sequence
  derived and/or modified sequence opt3 from Brontictuzumab_LightChain1
caggccguggucacccaagagcccagccugacaguuuccccuggcgggacugugacgcuuaccugcagaucuucaacaggagcuguaacuaccaguaacuacgcaaauugguuccagcagaagccaggucaggccccgaggacacucaucggcgggaccaacaaucgggcgcccggagugccugcucgcuuuagcggcucccuguugggugggaaagccgcauuaacucugucuggagcccaaccagaagacgaggcugaauauuacugugcacuaugguauucgaaccacugggucuucggcggcgggacaaagcucaccgugcugggacagcccaaagccgcuccuucaguuacgcuuuuuccacccagcagugaggaacugcaggccaauaaggcgacuuuggugugccucgucuccgauuucuacccuggugcagugaccguagccuggaaagcugacggcucuccaguuaaggugggggucgagacaacuaagccgagcaaacaguccaacaauaaguaugccgcaucaaguuaccugagccugacccccgagcaauggaaaucucaucgauccuauucaugucgugugacacacgaaggaagcaccguggagaagacggucgcuccugccgaaugcagu

SEQ ID NO: 23052 - RNA, 1332 nt, Artificial Sequence
  derived and/or modified sequence opt3 from BTT-1023_HeavyChain1
caggugcaacuggucgagagcggcgggggaguugugcagcccgguagaucccucaggcuuucuugcgccgcuucaggcuucaccuuuuucaguuacgcaaugcacuggguacggcagacaccugggaagggacuggaauggguggccgucaucugguuugacggcagcaacgagaauuauguggauuccguuaaaggucgcuucacuauuucucgagacaacucgaagaauacguuguacuuacagaugaacacccugcgugcggaagauacagcuguguauuacugugccagagacgcauggucauauuuugauuacugggggcaaggaacucuagucaccgugagcagugccuccacaaaaggcccaucuguauucccgcucgcucccugcagcagguccaccucagagaguacugcagcccugggcugucuuguuaaggacuauuuuccugaaccagugacagucagcuggaacucuggggcucugaccuccggagugcauacguuccccgccguguugcagucaagcggucucuacagucugucuuccgucguuacugugccuagcucgucucugggcaccaaaacauacacuugcaauguagaucacaagccauccaauaccaagguggacaaacgggucgagucaaaguaugggcccccuuguccaccgugccccgcgccugaguuugcaggaggcccaaguguguuccucuuucccccuaaaccaaaggauacauuaaugauaagccgcacccccgaaguuacguguguggucguggacguaucccaggaggauccggaaguucaguucaacugguacguggacggugucgaggugcauaaugccaaaacuaagccuagagaggaacaauuuaacucuacauauagggucgugagcguucugaccgugcuucaccaggauugguugaaugggaaggaguacaaaugcaagguaucaaacaaaggacugcccaguuccaucgaaaagacuauuagcaaagcuaagggccagccacgggagccucaggucuauacacuacccccaucucaagaagagaugaccaaaaaucaggugucacucacgugucugguuaagggcuucuaccccagugacaucgccguggagugggaaagcaacgggcagccugagaauaacuauaagaccacaccaccgguccuugacuccgauggaucuuucuuucuguacucgcgcuugacuguggacaaaagccgauggcaagaagguaacguauucuccugcucagugaugcaugaggcacuccacaaucacuacacccagaagagucugucuuuaagccugggcaaa

SEQ ID NO: 23053 - RNA, 642 nt, Artificial Sequence
  derived and/or modified sequence opt3 from BTT-1023_LightChain1
gugauccagcugacccaaagccccuccucucucucagccagugucggcgacagaguuacaauuacuugcagggcuagccaggggauaucccgggcacuugccugguaccagcagaaaccuggaaaagguccaaagcuguugaucuaugaugcgucuucguuagagucaggcgugccgagccgcuucaguggguccggaucuggcacggacuuuacccugacaauuagcucccuacaacccgaagauuucgcuacuuacuauugucagcaguuuaacucauacccucucaccuucggugggggaacaaaaguagagaucaagcgaaccguggccgcaccaagugucuuuauuuuucccccuagcgacgaacagcugaaaucuggcacugccuccgugguuugccuucugaauaacuucuauccacgugaggcuaaggugcaauggaaggucgauaaugcauugcagucaggcaacagccaggaaagugugacagagcaggacucuaaagauuccaccuacagccucucgucuacgcugacucuguccaaggccgacuaugagaaacacaagguauacgcuugugaaguuacccaucaagggcucucaagucccgugacaaagagcuucaauagaggagagugc

SEQ ID NO: 23054 - RNA, 1341 nt, Artificial Sequence
  derived and/or modified sequence opt3 from Burosumab_HeavyChain1
caggugcaacugguccagagcggcgccgaaguuaagaaacccggggcuuccgugaagguaucuugcaaagcaucaggauacaccuucacaaaccacuauaugcauugggugagacaggccccuggucagggccucgaauggauggggaucauuaauccaauaaguggaagcacuuccaacgcgcaaaaguuucagggcagggucacgaugacccgggacacaucuacuucgaccguguacauggagcuuucaagccugcgcagugaagauacagcuguuuauuacugugcccgagacaucguggaugcauucgacuuuuggggucaggggaccauggucacuguguccucugccagcacaaaaggaccguccguauuccccuuggcuccuucaaguaagagcaccucuggcggcacggcagccuuagggugccugguuaaggauuauuuuccagagcccgugacugucuccuggaacucaggagcucuaaccagcggugugcacacauucccugccgugcuccagaguucuggccuguacucccuuagcucggucguuacugugccaucuuccucacuggggacccaaacauauauuuguaauguaaaucauaaacccaguaacaccaagguggacaaaaaggucgaaccuaaaagcugcgauaagacgcacacuuguccaccgugccccgcgccugaguugcucggaggcccauccguguuucuguuucccccuaagccaaaagacacacugaugaucucucguacccccgagguuacuuguguggucguggauguaagccaugaagacccggagguuaaguuuaauugguacguggauggugucgaagugcacaacgcaaaaacaaagccuagagaggagcaguacaauucaaccuauagggucgugaguguucucacgguguuacaccaggacuggcugaacgggaaagaauacaagugcaaaguauccaauaaggcccuucccgcuccaauugagaagaccaucagcaaagccaagggacagccucgggaaccccaagucuauacauugccacccucucgcgaugagcugacuaaaaaccaggugucacuaaccugucucguuaagggcuucuacccuagugacauagcaguggaaugggagagcaauggccagccagagaacaauuauaaaacaacuccgcccguccuggacuccgaugggucuuucuuccuuuacucgaagcugaccguggacaagagcagauggcaacagggaaacguauuuuccugcucagugaugcaugaggcuuugcacaaccauuauacacagaaaagucucucucugagcccugguaag

SEQ ID NO: 23055 - RNA, 639 nt, Artificial Sequence
  derived and/or modified sequence opt3 from Burosumab_LightChain1
gccauccagcugacccaaagccccuccucucucucagcuagugugggcgacagagucacaauuacuugcagggcaagccaggggauauccucugcccuuguuugguaccagcagaaaccuggaaaagcgccaaagcuguugaucuaugaugcuucgucauuagagagcggugugccgagucgguucuccggcucugggagcggaacggacuuuacccugacaauuuccucacuacaacccgaagauuucgccacuuacuauugucagcaguuuaacgacuacuucaccuuuggcccugguacaaaaguagauaucaagcgcaccguggcagccccaagugucuucauuuuucccccuagcgacgagcagcucaaaucugggacugcuuccgugguuugccugcuuaauaacuucuauccacgagaagcaaaggugcaauggaaggucgauaaugcccugcagucaggaaacagccaggagagugugacagaacaggacucuaaagauuccaccuacagcuugucgucuacgcucacucuguccaaggcugacuaugagaaacacaagguauacgccugugagguuacccaucaaggccugucaagucccgugacaaagagcuuuaaucguggcgaaugc

SEQ ID NO: 23056 - RNA, 1344 nt, Artificial Sequence
  derived and/or modified sequence opt3 from Canakinumab_HeavyChain1
caggugcaacuggucgagagcggcgggggaguugugcagcccgguagaucccucaggcuuucuugcgccgcuucaggcuucaccuuuaguguauacgggaugaacugggugcggcaggcaccuggaaagggccuggaaugggucgccaucauuugguaugacggugauaaucaguacuaugcggacagcgugaaagggcgcuucacaauaucccgagauaacucuaagaauacuuuguacuuacaaaugaacggacugcgugcugaggacacggccguuuauuacugugcaagagaucuaaggaccggcccauuugacuauuggggccaggggacacucgugacugucucgucagccagcaccaaaggaccgaguguguucccccuggcuccuuccucuaagagcacauccgguggcaccgcagcccuugggugccugguaaaagauuacuuuccagaacccguuacugugucauggaauaguggagcuuugacaagcggcguccacaccuucccugccgugcuccagucuuccggucuguacucacugagcaguguggucacgguuccaucuuccagccucgggacucagaccuauaucuguaacgugaaucauaagcccucgaacacaaagguagacaaacggguggagccuaagucuugcgauaaaacucacaccuguccaccgugccccgcgccugaauuacugggaggcccauccgucuuucuuuuucccccuaagccaaaagacacauugaugauuucacgcacccccgaggugacguguguuguggucgaugugagucaugaggacccggaaguaaaguucaauugguacguugauggcguggagguccacaacgcaaagacuaaaccuagagaggaacaauauaauagcacauacaggguggucuccgugcugaccguucuacaucaggacuggcucaacgggaaggaguauaaaugcaaggugucuaauaaagcccugcccgcuccaaucgaaaagacuauuagcaaagccaagggacagccucgggagccccagguauacacacuuccacccucacgcgaagagaugaccaagaaccaagucagucugacguguuuggugaaagguuucuauccuuccgacaucgcaguugaaugggagagcaauggccagccagagaacaacuacaagaccacaccgcccgugcucgauucugacgggucauuuuuccuguacaguaaauuaacugucgauaagagccgauggcagcaaggaaauguguuuuccugcucuguaaugcacgaagcucugcacaaccauuauacccagaaaucgcucagccuuuccccuggcaag

SEQ ID NO: 23057 - RNA, 1344 nt, Artificial Sequence; identical to SEQ ID NO: 23056
  derived and/or modified sequence opt3 from Canakinumab_HeavyChain

SEQ ID NO: 23058 - RNA, 642 nt, Artificial Sequence
  derived and/or modified sequence opt3 from Canakinumab_LightChain1
gagaucgugcugacccagagccccgacuuccaauccgucacaccuaaggaaaaaguuacuauuacgugcagagccucucagucaauaggcaguagccuccacugguaccagcagaagccagaucaauccccgaaacuucugaucaaguaugcuucucagucguuuucaggggugcccagcagguucaguggauccgguucuggcaccgacuuuacauugacuauuaacagcuuagaggcagaagaugccgcggcuuacuauugucaucaguccucaagucugccuuucaccuuugggccaggaacaaaaguagacaucaagcggaccguggccgcacccagcgucuucauuuuuccuccaucugaugagcagcuaaaguccggcacugccucagugguuugccuccugaauaacuucuacccccgcgaagcuaaagugcaauggaaggucgacaaugcacuucagagcgguaacagucaggagucugugacagagcaggauuccaaagacagcaccuauucgcugucuuccacguugacucucucaaaggccgauuacgaaaaacacaagguauaugcuugugagguuacccaucaagggcugaguagcccugugacaaaguccuuuaaucgaggagaaugc

SEQ ID NO: 23059 - RNA, 642 nt, Artificial Sequence; identical to SEQ ID NO: 23058
  derived and/or modified sequence opt3 from Canakinumab_LightChain

SEQ ID NO: 23060 - RNA, 1182 nt, Artificial Sequence
  derived and/or modified sequence opt3 from Canakinumab_LightChain_variant_8836_L
caggugcaacuggucgagagcggcgggggaguugugcagcccgguagaucccucaggcuuucuugcgccgcuucaggcuucaccuuuaguguauacgggaugaacugggugcggcaggcaccuggaaagggccuggaaugggucgccaucauuugguaugacggugauaaucaguacuaugcggacagcgugaaagggcgcuucacaauaucccgagauaacucuaagaauacuuuguacuuacaaaugaacggacugcgugcugaggacacggccguuuauuacugugcaagagaucuaaggaccggcccauuugacuauuggggccaggggacacucgugacugucucgucagccagcaccaaaggaccgaguguguucccccuggcuccuuccucuaagagcacauccgguggcaccgcagcccuugggugccugguaaaagauuacuuuccagaacccguuacugugucauggaauaguggagcuuugacaagcggcguccacaccuucccugccgugcuccagucuuccggucuggagaucgugcugacgcagucaccagacuuucaaagcgucacucccaaggaaaagguuaccauuacaugucgggcgagucagucuaucggguccagccuccauugguaccagcagaaaccugaucaaucgccaaaguuacugauuaaauaugcaucucaguccuucucaggagugccgagucgcuuuagcggcuccggcucugggacugacuucacccuuacaaucaacagcuuggaggccgaggaugcugccgcauacuauugccaccagucaaguucccugcccuuuaccuucggaccugguacgaagguagacauaaaaagaacuguggcugccccaagcgucuuuaucuuucccccuucugaugaacaacuaaagucaggcacagcgagugugguuugucuccugaauaacuucuacccaagggaggccaaggugcaguggaaagucgacaaugcacuucagagcgggaacucccaggaaucugugaccgagcaagacucgaaggauagcacuuauucccugucaaguacauugacccucucuaaagcugacuacgagaagcauaaaguauaugccugcgaaguuacgcaccagggacugagcucccccgugaccaagucauucaaucggggcgagugu

SEQ ID NO: 23061 - RNA, 1197 nt, Artificial Sequence
  derived and/or modified sequence opt3 from Cantuzumab_HeavyChain1
aucgacaccacaacuggcgagcccacguacgcccagaaguuccaagggagaauugcuuuuagccuggaaaccuccgcaucuacagccuaucuccagauaaaaucacuuaagagugaggauacugcgaccuacuucugcgcuaggcggggaccuuauaacugguacuuugacguguggggucagggcacaaccgucacuguuagcuccgccucuacaaaagggccaucgguguucccgcuggcacccucaagcaagaguaccuccggaggcacggccgcuuuggguuguuuaguaaaagauuauuuuccugaaccagugacugucucuuggaauagcggggcacugaccuccggagugcacacauuccccgccguucuacagucaaguggccucuacagccugucuuccguggucacugugccuucaagcagucuuggcacccaaacauauaucugcaacguaaaucauaagccaucuaacaccaagguugacaaaaagguggagcccaaauccugugauaagacgcacacuugcccuccauguccggcucccgaacugcuugggggaccuagcgucuuucucuucccacccaaaccuaaggacacacugaugauuucgcgcaccccagaggugacuugcguggucguugaugugucucaugaggaccccgaaguaaaguuuaauugguacguggauggugucgaggugcacaacgccaaaacaaagccgcgagaagaacaguacaauuccaccuaucguguugugucaguccugacggugcuccaucaggacugguuaaacggcaaagaguacaaguguaaaguaaguaauaaggcgcugccugcacccaucgagaaaaccauuagcaaggccaaggggcagccaagagagccucaaguuuauacacuucccccauccagggaugaauugacuaaaaaccaggugucucugaccugccuagucaagggauucuaccccagcgacaucgcuguggagugggaaucaaauggccagccugagaacaauuauaaaacaacuccaccgguccucgauagugacgguuccuuuuuccuguacagcaaguugaccguggacaaaucucgguggcagcaagggaacguuuuuagcuguagugugaugcacgaggcccugcacaaucauuauacacagaagucauugucccucucucccggaaag

SEQ ID NO: 23062 - RNA, 1347 nt, Artificial Sequence
  derived and/or modified sequence opt3 from Cantuzumab_HeavyChain
caggugcaacugguccagagcggcgccgagguuaagaaacccggggaaaccgugaagaucuccugcaaggcuucugacuacacauucacuuauuacggaaugaacuggguaaaacaggcaccuggucagggccucaaauggaugggguggauugauacgaccacaggagagccaacuuaugcccaaaaguuucagggcagaauagcguucucacuugaaaccagugcuagcacagccuaccugcagaucaaguccuugaaaucugaggacaccgcaacuuauuuuugugccaggcgggguccguacaauugguauuucgaugugugggggcagggaacaaccgucacggugucgucagcuagcacuaagggccccaguguuuuuccuuuagcaccauccucuaaaagcaccuccggcgggacagccgcucugggaugccuagugaaggacuacuuccccgaaccugucacugugucauggaacaguggugcccucaccagcggcguacacacauuuccagcgguucugcaaucuuccgggcuuuacucacugagcaguguggucaccgugcccucuuccagcuugggaacgcagacuuauauuuguaaugugaaccauaaaccuucgaauacaaaggucgauaagaaaguugagccaaagucuugcgacaaaacccacacuuguccgcccugcccugcaccagagcuccugggcggucccuccguguuccuguuuccuccaaagcccaaagauacacucaugaucucacgcaccccggaaguaacguguguggucguggacguuagucaugaggauccugaagugaaguucaacugguacgucgacgggguggagguacacaaugccaaaaccaagccccgagaggaacaguauaacagcacauaccguguuguguccgucuuaacugugcugcaucaggauuggcuuaauggaaaggaguauaaaugcaaggucucuaacaaagccuugccagcuccuauugaaaagaccaucagcaaagcaaagggccaacccagagagccacagguguacacacugcccccuucaagggacgaacuaacuaagaaucagguuagucucaccugucuggugaaaggcuuuuauccauccgauauagcuguagagugggagagcaacgggcaaccggaaaauaacuacaagacaacucccccuguccuugacucugacggaucauucuuucuguacaguaaauugaccguggauaagagccgguggcagcaggguaauguuuucuccugcucugugaugcacgaggcccuccacaaccauuauacgcagaaaucgcugagcuuauccccaggcaag

SEQ ID NO: 23063 - RNA, 657 nt, Artificial Sequence
  derived and/or modified sequence opt3 from Cantuzumab_LightChain1
gacaucgugaugacccagagcccccuguccgucccuguuacaccaggcgagccggugucuauuucaugccggaguagcaagucccuccuucacucuaacgggaauacuuaccuguauugguucuugcaaaggcccggacagucgccucaguuacugauauaccggaugucaaaccuaguaagcggugugccagaucgcuuuaguggcuccgggucuggaacggccuucacccuccgaaucagccgugucgaagcugaggacgugggcguuuauuacugucugcagcaucuugaauaucccuuuacauucgguccugggacuaaacuggaguugaagagaaccguggcagccccauccgucuuuauuuuucccccuucagaugaacaacucaaaaguggaacagcgagcgugguaugccugcugaauaacuucuacccaagggaggcuaagguucaguggaaaguggacaaugcccuccagucuggcaacucccaggagucagucaccgaacaagauagcaaggacaguacuuauucuuuauccagcacacugacccuuucgaaggcagauuacgagaaacacaagguguacgccugugaagugacgcaucagggcuugucuuccccggucacuaaaucauucaauagaggggagugc

SEQ ID NO: 23064 - RNA, 1344 nt, Artificial Sequence
  derived and/or modified sequence opt3 from Cantuzumab_mertansine_HeavyChain1
gugcagcugguccaaagcggcgccgagguuaagaaacccggggaaaccgugaagaucuccugcaaggcuucugacuacacauucacuuauuacggaaugaacuggguaaaacaggcaccuggucagggccucaaauggaugggguggauugauacgaccacaggagagccaacuuaugcccagaaguuucaaggcagaauagcguucucacuugaaaccagugcuagcacagccuaccugcagaucaaguccuugaaaucugaggacaccgcaacuuauuuuugugccaggcgggguccguacaauugguauuucgaugugugggggcagggaacaaccgucacggugucgucagcuagcacuaagggccccaguguuuuuccuuuagcaccauccucuaaaagcaccuccggcgggacagccgcucugggaugccuagugaaggacuacuuccccgaaccugucacugugucauggaacaguggugcccucaccagcggcguacacacauuuccagcgguucugcagucuuccgggcuuuacucacugagcaguguggucaccgugcccucuuccagcuugggaacgcaaacuuauauuuguaaugugaaccauaaaccuucgaauacaaaggucgauaagaaaguugagccaaagucuugcgacaaaacccacacuuguccgcccugcccugcaccagagcuccugggcggucccuccguguuccuguuuccuccaaagcccaaagauacacucaugaucucacgcaccccggaaguaacguguguggucguggacguuagucaugaggauccugaagugaaguucaacugguacgucgacgggguggagguacacaaugccaaaaccaagccccgagaggaacaguauaacagcacauaccguguuguguccgucuuaacugugcugcaucaggauuggcuuaauggaaaggaguauaaaugcaaggucucuaacaaagccuugccagcuccuauugaaaagaccaucagcaaagcaaagggccagcccagagagccacaaguguacacacugcccccuucaagggacgaacuaacuaagaaucagguuagucucaccugucuggugaaaggcuuuuauccauccgauauagcuguagagugggagagcaacgggcagccggaaaauaacuacaagacaacucccccuguccuugacucugacggaucauucuuucuguacaguaaauugaccguggauaagagccgguggcaacaggguaauguuuucuccugcucugugaugcacgaggcccuccacaaccauuauacgcagaaaucgcugagcuuauccccaggcaag

SEQ ID NO: 23065 - RNA, 657 nt, Artificial Sequence; identical to SEQ ID NO: 23063
  derived and/or modified sequence opt3 from Cantuzumab_mertansine_LightChain1

SEQ ID NO: 23066 - RNA, 1347 nt, Artificial Sequence; identical to SEQ ID NO: 23062
  derived and/or modified sequence opt3 from Cantuzumab_ravtansine_HeavyChain1

SEQ ID NO: 23067 - RNA, 657 nt, Artificial Sequence; identical to SEQ ID NO: 23063
  derived and/or modified sequence opt3 from Cantuzumab_ravtansine_LightChain1

SEQ ID NO: 23068 - RNA, 777 nt, Artificial Sequence
  derived and/or modified sequence opt3 from Caplacizumab
gaggugcagcuggucgaaagcggcgggggacucguucaacccgguggcucccuuagacugucuugcgccgcuucagggaggaccuucaguuacaacccuaugggaugguuucggcaggcaccaggcaagggucgcgaguugguggccgcgaucagccgaacagggggauccacuuauuacccggacucuguagaaggccguuucacgauuucgagagauaaugcuaaaaggaugguguauuuacagaugaacucacugcgggccgaggacaccgcagucuacuauugugccgcugcaggcgugcgcgccgaagaugggagaguuaggacacuacccagcgaguacacuuuuuggggacaggguacccaagugacagucaguuccgcugccgcggaggugcagcucguagaaucuggcgggggacugguucagccuggcgguagccuucggcuguccugcgcagccucagggcgcaccuucaguuauaauccaaugggaugguuucgacaggcucccggcaagggcagagaguugguggccgcaauaagcaggacugggggaucuacauacuacccugacuccgucgaaggucgguucaccaucucacgugauaacgcuaaacgcaugguguaucuccaaaugaauagccugagagccgaggacacggcgguguacuauugugccgcagcuggcgucagggccgaggaugggcggguucgaacucugccaagugaauacaccuuuuggggacagggcacacaggugacuguaucuucc

SEQ ID NO: 23069 - RNA, 777 nt, Artificial Sequence; identical to SEQ ID NO: 23068
  derived and/or modified sequence opt3 from Caplacizumab_HeavyChain1

SEQ ID NO: 23070 - RNA, 777 nt, Artificial Sequence; identical to SEQ ID NO: 23068
  derived and/or modified sequence opt3 from Caplacizumab_HeavyChain1

SEQ ID NO: 23071 - RNA, 1347 nt, Artificial Sequence
  derived and/or modified sequence opt3 from Carlumab_HeavyChain1
caggugcaacugguccagagcggcgccgagguuaagaaacccggguccucugugaagguaucaugcaaagcuaguggagguaccuucagcuccuacggcaucucuugggugagacaggcaccugggcagggacucgaauggaugggcgguauuauaccaaucuuugggacagccaacuaugcgcaaaaguuccagggaagggucacuauuacggcugacgagucgaccucaacagccuacauggaacuuagcagucugcgguccgaggauacugcaguguauuacugugcccgcuaugacggcaucuacggcgaauuggauuuuugggggcagggaaccuuaguuacagugucuagcgcuuccaccaaagguccgucagucuucccccuggcaccuaguagcaagucuacuuccggcgggacagccgcucuaggaugccucgugaaggacuauuuuccagagcccguaaccguuucauggaauagcggcgcccugacgaguggugugcacacuuucccugcgguccuucagucuuccgggcuguacagcuugucgucuguggugaccgucccauccucaagucucggaacacaaacuuacauuuguaacguuaaucauaaacccagcaacaccaagguggauaaaaagguagagccuaaauccugcgacaagacacacaccuguccaccgugccccgcaccugaacugcugggcggcccaucuguguuucucuuucccccuaagccaaaagauacguuaaugaucagccgaacucccgaggucacaugugugguuguggacgucucacaugaagauccggaggugaaguucaauugguauguagacgggguugaggugcacaacgccaaaaccaagccucgugaggaacaguacaauaguacuuauagagucguguccguccugacagugcuucaucaggauugguugaacggaaaagaauacaagugcaaaguuagcaauaaggcucugcccgccccaauagagaagaccaucucuaaagcaaagggucagccuagggaaccccaaguguauacgcuaccacccucacgggacgagcucaccaaaaaccagguaagucugacaugucuugucaagggcuucuacccuagcgauauugcuguggagugggaauccaaugggcagccagagaacaauuauaaaacuaccccgcccguucuggacucugacggaucguuuuucuuguacagcaagcucacaguggauaagucccgcuggcaacagggcaacgucuuuucaugcagugugaugcacgaagcccugcacaaucauuacacucagaaaucuuuaagccuguccccugguaag

SEQ ID NO: 23072 - RNA, 648 nt, Artificial Sequence
  derived and/or modified sequence opt3 from Carlumab_LightChain1
gagaucgugcugacccagagccccgccacacucucccuuucuccuggcgaaagagcuacucugucaugcagggcaagucaaagcgucuccgacgccuacuuggcgugguaucagcagaagccagggcaggcuccgcgguuacugauuuacgaugccucuucgcgcgcaacgggaguucccgcccgauucucagguagcggcagugggaccgacuuuacacuaacuauauccucucucgagccugaagauuucgcuguguauuacugucaccaauauauccagcugcauagcuuuaccuucggacagggcacaaaaguagagauuaagcguaccguggcagccccauccgucuuuaucuuucccccuucagacgaacagcuuaaaagugguacugcuagcgugguuugccuguugaacaauuucuacccaagagaggccaaggugcaauggaaagucgauaacgcgcuccagucuggaaauucccaggagucagugacagaacaggacagcaaggauaguaccuauucucuguccagcacgcugacucucucgaaggcagacuacgagaaacacaagguauacgccugugaaguuacccaucaaggguuaucuucccccgugacaaaaucauucaacaggggcgagugc

SEQ ID NO: 23073 - RNA, 1353 nt, Artificial Sequence
  derived and/or modified sequence opt3 from Cergutuzumab_amunaleukin_HeavyChain1
caggugcaacugguccagagcggcgccgagguuaagaaacccggggcuuccgugaagguaucuugcaaagcaucaggauacaccuucacagaauuugguaugaacugggugagacaggccccuggccaggggcucgaguggaugggauggaucaauacuaagacgggcgaagcgaccuaugucgaggaguucaaagguagggugacauuuacuaccgacacaaguaccagcacugcuuacauggagcuucggucccugcgcucugaugacacagccguuuauuacugugcacgaugggauuucgccuauuacguggaggcuauggacuauugggggcaaggaaccacggucacugugucgucagcaagcaccaagggcccaaguguauuuccguuggcccccuccucuaagagcacauccggcgggacugcugccuuaggaugccugguuaaagauuacuucccugaaccagugaccgucucauggaacaguggugcgcuaacaagcggcgugcacaccuuucccgcagugcuccagucuuccgggcuguacucacuuagcagugucguuacggugccuucuuccagccugggaacucagacauauauuuguaauguaaaccauaagccaucgaauaccaaaguggacaagaaagucgagcccaagucuugcgauaagacucacacauguccuccaugcccggcccccgaagcugccggcgguccuuccguguucuuguuuccacccaaaccuaaggacacccucaugauaucacguacgccagagguuaccuguguggucguggauguaagucaugaggaccccgaaguuaaauucaacugguacguggauggggucgaggugcacaaugcaaagacaaaaccgagagaagaacaguauaacagcacuuacagggucguguccguucugaccgugcugcaucaagacuggcucaauggaaaggaauauaaaugcaagguaucuaacaaggcuuuaggcgccccuaucgagaaaacaauuagcaaggcgaaaggccagccccgggagccacaggucuguacucugccucccucacgcgaugaacuuaccaagaaucaggugaguuuguccugcgccguuaaaggguuuuacccaagcgacaucgcaguggagugggaaucuaacggacaacccgagaauaacuauaagacaaccccuccaguccuggacucagaugguaguuucuuucuagugagcaagcucacuguagacaaauccagauggcagcagggcaauguguucucuuguucgguuaugcacgaagcucugcacaaccauuacacgcaaaagagccuuucccugucaccggggaaa

SEQ ID NO: 23074 - RNA, 1794 nt, Artificial Sequence
  derived and/or modified sequence opt3 from Cergutuzumab_amunaleukin_HeavyChain2
caggugcaacugguccagagcggcgccgagguuaagaaacccggggcuuccgugaagguaucuugcaaagcaucaggauacaccuucacagaauuugguaugaacugggugagacaggccccuggccaggggcucgaguggaugggauggaucaauacuaagacgggcgaagcgaccuaugucgaggaguucaaagguagggugacauuuacuaccgacacaaguaccagcacugcuuacauggagcuucggucccugcgcucugaugacacagccguuuauuacugugcacgaugggauuucgccuauuacguggaggcuauggacuauugggggcaaggaaccacggucacugugucgucagcaagcaccaagggcccaaguguauuuccguuggcccccuccucuaagagcacauccggcgggacugcugccuuaggaugccugguuaaagauuacuucccugaaccagugaccgucucauggaacaguggugcgcuaacaagcggcgugcacaccuuucccgcagugcuccagucuuccgggcuguacucacuuagcagugucguuacggugccuucuuccagccugggaacucagacauauauuuguaauguaaaccauaagccaucgaauaccaaaguggacaagaaagucgagcccaagucuugcgauaagacucacacauguccuccaugcccggcccccgaagcugccggcgguccuuccguguucuuguuuccacccaaaccuaaggacacccucaugauaucacguacgccagagguuaccuguguggucguggauguaagucaugaggaccccgaaguuaaauucaacugguacguggauggggucgaggugcacaaugcaaagacaaaaccgagagaagaacaguauaacagcacuuacagggucguguccguucugaccgugcugcaucaagacuggcucaauggaaaggaauauaaaugcaagguaucuaacaaggcuuuaggcgccccuaucgagaaaacaauuagcaaggcgaaaggccagccccgggagccacaggucuacacucugccucccugucgcgaugaacuuaccaagaaucaggugucauuguggugccugguuaaaggguuuuauccaagugacaucgccguggagugggaauccaacggacaacccgagaauaacuacaagacaaccccuccaguccuagacagcgaugguucuuucuuucucuacucaaagcugacuguggacaaaaguagauggcagcagggcaauguauucagcuguuccgugaugcacgaagcacuucacaaccauuauacgcaaaagucucugucguugagcccagggggaggcgguggguccggcggaggcgggucaggagguggcgggagugcucccgccucuagcuccaccaaaaagacacagcuccagcuggagcacuuacugcucgaucuucagaugauucugaacggaaucaauaacuacaaaaauccuaaguugacuaggaugcuaaccgcuaaguucgccaugccgaaaaaggcaacagagcugaaacaucuccaaugccuggaagaggaacuuaagccccuggaggaaguuuugaacggcgcccagagcaaaaauuuucaccuccggccucgcgaccugauaucaaacaucaaugucauuguguuagagcugaaggguucugagaccacuuucaugugcgaauaugcugaugagacagcgacgaucguggaauuucuaaaccgauggauuaccuucgcacaguccaucauaaguacucucaca

SEQ ID NO: 23075 - RNA, 645 nt, Artificial Sequence
  derived and/or modified sequence opt3 from Cergutuzumab_amunaleukin_LightChain1
gacauccagaugacccaaagccccuccucucugucagccagugugggcgauagagucacaauuacuugcaaggcuagcgcagccguugggacguacguggcgugguaucagcagaaaccuggaaaggcuccaaaacuccuuauauacuccgccucuuauaggaagcgggguguaccgucgcgcuucucaggcagcgggaguggaaccgacuuuacacugacuaucuccucuuugcagcccgaggauuucgcaaccuacuauugucaccaauacuauacauacccuuuauuuaccuucggccaggguacuaaacuggaaauuaagcgaacaguggccgcuccaagcgucuuuaucuuucccccuuccgacgagcagcuaaagucagggaccgcaagugugguuugccuccugaacaauuucuacccacgugaagccaaagugcaguggaaggucgauaacgcccuucaaagcggaaauucucaggaguccgugacggaacaggacucaaaagauagcacuuauagucugucuuccaccuugacacucagcaaggcugacuacgagaaacauaagguauaugcgugugagguuacucaccagggccugucgucucccgugaccaaguccuucaacagaggcgaaugc

SEQ ID NO: 23076 - RNA, 687 nt, Artificial Sequence
  derived and/or modified sequence opt3 from Certolizumab_pegol_HeavyChain1
gaggugcagcuggucgaaagcggcgggggacucguucaacccgguggcucccuuagacugucuugcgccgcuucaggguacguguucaccgacuauggaaugaacuggguaaggcaggcaccuggcaaggguuuggaguggaugggguggaucaauacauacauuggagaaccaauauaugccgauagugugaaaggccgguuuacuuucagcuuagacacguccaagucuaccgcguaccugcagaugaacucgcuacgcgcugaggauacagccgucuauuacugugcacgaggcuaucguucauacgccauggacuacugggggcagggaacucucgugaccguuagcagugcuuccacaaaagguccgucuguguuuccccuggcaccuagcuccaagucaaccaguggcgggacugccgcucuuggaugccuggucaaagauuauuucccagaacccgugacaguaagcuggaacucuggcgccuugaccuccgguguucacacguuuccugcggugcuccaaucaagcgggcuguacagucugucuuccgucgugacugugccaagcucgucucucggaacccagacauauaucuguaaugucaaucauaagcccuccaacacuaagguugacaaaaagguggagccuaaaucaugcgauaagacccacacaugugcagcc

SEQ ID NO: 23077 - RNA, 687 nt, Artificial Sequence; identical to SEQ ID NO: 23076
  derived and/or modified sequence opt3 from Certolizumab_pegol_HeavyChain

SEQ ID NO: 23078 - RNA, 642 nt, Artificial Sequence
  derived and/or modified sequence opt3 from Certolizumab_pegol_LightChain1
gacauccagaugacccaaagccccuccucucugucagccagugugggcgauagagucacaauuacuugcaaggcuagccagaacguugggacgaauguggcaugguaccagcagaaaccuggaaaggccccaaaagcgcucauauauuccgcuucuuuccuuuacucggguguaccguauagguuuucaggcagcgggaguggaaccgacuucacacugacuaucuccucuuugcaacccgaggauuuugccaccuacuauugucagcaguacaacauuuauccuuuaacauucggccaggguaccaagguggaaaucaaacggacugucgcagccccaagcguguuuauuuuucccccuuccgacgagcaacugaagucagggacagcuaguguugugugccuacucaauaacuucuacccacgcgaagcaaagguccaguggaaaguggauaaugcccugcagagcggaaacucucaggaguccguaaccgaacaagacucaaaggauagcacguacagucuuucuuccacucugaccuugagcaaagcugacuaugagaagcacaaaguuuacgccugugaggugacacaucagggccucucgucucccgucacuaaguccuucaaucgaggcgaaugc

SEQ ID NO: 23079 - RNA, 642 nt, Artificial Sequence; identical to SEQ ID NO: 23078
  derived and/or modified sequence opt3 from Certolizumab_pegol_LightChain

SEQ ID NO: 23080 - RNA, 1356 nt, Artificial Sequence
  derived and/or modified sequence opt3 from Cetuximab_HeavyChain
caggugcaacugaagcagagcggccccgggcucguccagccuucccagucucuuucaauuaccugcacaguuaguggauucagccugacuaacuacggugugcacuggguaagacaauccccaggcaaaggguuggagugguuaggagugaucuggucuggcgguaauacggacuauaacaccccguuuacaucgaggcugucaauaaauaaggauaacagcaaaagucaggucuucuuuaagaugaauagccuacagucuaacgacacugcuaucuacuauugugcucgggcacucaccuacuaugauuacgaguucgccuauugggggcagggaacacuggugaccguuagcgcggcuuccacuaaaggccccucaguguuuccucuugccccaaguagcaagucuacauccggcgggaccgcagcccugggaugcuuggucaaggacuacuuccccgaaccugugacgguaucauggaauagcggugcucucacaaguggcguucauaccuuuccagcagugcugcaaucuuccgggcuguacagccucucgucugucgugacagugcccuccucaaguuuaggaacucagaccuauauuuguaacgucaaucacaaaccuagcaacacaaagguugauaaacgcguggaaccaaaguccccgaaaucuugcgacaagacccauacgugucccccuugcccagcccccgagcugcuuggcgguccuagcguauucuuguuuccacccaagccgaaagauacucugaugaucucacgaacaccugaagugaccugugucgugguugacgugagucacgaggaucccgaggucaaguucaauugguacguggacgggguagaaguucauaacgcuaaaacuaagccacgugaggaacaguauaauuccacauacagaguggucagcgugcuaaccguccuccaccaggauuggcugaacggaaaagaguauaagugcaaagugucuaauaaggcccuuccugcgcccauugagaagacgaucucaaaagcaaagggccaaccaagggaaccccagguuuacacccugccuccaagucgggacgaguugacuaaaaaccaggugagccucacuugucugguaaagggcuuuuauccguccgauauagccgucgaaugggagucuaacgggcaacccgaaaauaacuacaaaaccacaccuccaguguuagacucggacggauccuucuuucuguacuccaagcucacuguugauaagucacgcuggcagcaggguaauguguucaguugcucugucaugcacgaggcccuucauaaccacuauacccagaaaagccuguccuugucacccggcaag

SEQ ID NO: 23081 - RNA, 1347 nt, Artificial Sequence
  derived and/or modified sequence opt3 from Cetuximab_HeavyChain_variant
caggugcaacugaagcagagcggccccgggcucguccagccuucccagucucuuucaaucacaugcacaguuaguggauucagccugacuaacuacggugugcacuggguaagacaauccccaggcaaaggguuggagugguuaggagugauuuggucuggcgguaauacggacuauaacaccccguuuacaucgaggcugucaauaaauaaggauaacagcaaaagucaggucuucuuuaagaugaauagucuacagucuaacgacacugcuaucuacuauugugcucgggcacucaccuacuaugauuacgaguucgccuauugggggcagggaacacuggugaccguuagcgcggcuuccacuaaaggccccucaguguuuccucuugccccaaguagcaagucuacauccggcgggaccgcagcccugggaugcuuggucaaggacuacuuccccgaaccugugacgguaucauggaauagcggugcucucacuuccggcguucauaccuuuccagcagugcugcaaucuuccgggcuguacagccucucgucugucgugacagugcccuccucaaguuuaggaacucagaccuauauuuguaacgucaaucacaaaccuagcaacacaaagguugauaaaaagguggaaccaaaauccugcgacaagacccauacguguccgcccugcccugccccagagcugcuuggcggucccucuguauucuuguuuccuccaaagcccaaagauacucugaugaucagccgcacaccggaagugaccugugucgugguugacgugucacacgaggauccugaggucaaguucaauugguacguggacgggguagaaguucauaacgcuaaaacuaagccccgagaggaacaguauaauaguacauaccguguggucuccgugcuaaccguccuccaccaggauuggcugaacggaaaagaguauaagugcaaagugagcaauaaggcccuuccagcgccuauugagaagacgaucucuaaagcaaagggccaacccagagaaccacagguuuacacccugcccccuucaagggacgaguugaccaaaaaccaggugagucucacuugucugguaaagggcuuuuauccaagcgauauagccgucgaaugggaguccaacgggcaaccggaaaauaacuacaaaaccacacccccuguguuagacucugacggaucguucuuucuguacagcaagcucacuguugauaagucccgguggcagcaggguaauguguucucaugcagugucaugcacgaggcccuucauaaccacuauacccagaaaucucugagcuuguccccaggcaag

SEQ ID NO: 23082 - RNA, 639 nt, Artificial Sequence
  derived and/or modified sequence opt3 from Cetuximab_LightChain
gacauccugcucacccagagccccgugauucuuuccgucucuccuggcgagagaguuucauucaguugcagggccagccaauccauagggacaaacauccacugguaccagcagcggacuaauggaucuccacgccuguugauuaaguaugcuucggaaucaaucagcgguauuccgagucgauuuuccggcucugggagcggaacggauuucaccuuauccaucaacucaguggagagugaagacauagcagauuacuauugucagcaaaauaacaauuggcccacaacuuuuggcgccgguaccaaacuggagcuaaagcguacaguagcggcuccuagcguguucaucuuuccacccucugacgaacagcucaaauccgggaccgccucagucgugugccugcuuaacaauuucuacccuagagaggcaaagguucaguggaaaguggauaacgcccugcagagcggaaauagucaagagucugucacugaacaggacuccaaggauagcacauauucguugucuuccacccucacgcugucaaaggcugacuacgagaaacauaagguguaugcaugugaaguaacucaccagggccugaguagcccaguuaccaaauccuuuaacaggggcgcc

SEQ ID NO: 23083 - RNA, 642 nt, Artificial Sequence
  derived and/or modified sequence opt3 from Cetuximab_LightChain_variant
gacauccugcucacccagagccccgugauucuuuccgucucuccuggcgagagaguuucauucaguugcagggccagccaauccauagggacaaacauccacugguaccagcagcggacuaauggaucuccacgccuguugauuaaguaugcuucggaaucaaucagcgguauuccgagucgauuuuccggcucugggagcggaacggauuucaccuuauccaucaacucaguggagagugaagacauagcagauuacuauugucagcaaaauaacaauuggcccacaacuuuuggcgccgguaccaaacuggagcuaaagcguacaguagcggcuccuagcguguucaucuuuccacccucugacgaacagcucaaauccgggaccgccucagucgugugccugcuuaacaauuucuacccuagagaggcaaagguucaguggaaaguggauaacgcccugcagagcggaaauagucaagagucugucacugaacaggacuccaaggauagcacauauucguugucuuccacccucacgcugucaaaggcugacuacgagaaacauaagguguaugcaugugaaguaacucaccagggccugaguagcccaguuaccaaauccuuuaacaggggcgagugc

SEQ ID NO: 23084 - RNA, 675 nt, Artificial Sequence
  derived and/or modified sequence opt3 from Citatuzumab_bogatox_HeavyChain1
caccaucaccaucaccaugaggugcagcugguccaaagcggccccgggcucguucagccuggagguuccgugagaaucucuugcgccgcuucaggcuacaccuucacaaacuaugggaugaauuggguaaagcaggcaccaggaaaaggccuugaauggauggguuggauuaacacuuacacgggggagaguaccuaugccgacagcuuuaagggaagguucacauuuucccuggauacuucugcgucggcugccuacuugcagauaaauucauuacgggcagaagacaccgccguguauuacugugcucgcuucgcaaucaaaggcgauuauuggggccaagggacacugcuaaccgucagcagugccuccacuaagggaccgucuguguuuccccucgcuccuagcuccaaaucaacaagugguggcaccgccgcgcuggggugccuuguuaaggacuacuucccagagcccgugacggucagcuggaacucuggagcacugacuuccggcgugcacaccuuuccugccguauugcagucaagcggucucuacagucugucuuccguugugacagucccaagcucgucucuggggacucagaccuauauuuguaaugugaaccacaagcccuccaauacaaaaguggauaagaaagucgaaccuaagucaugc

SEQ ID NO: 23085 - RNA, 1443 nt, Artificial Sequence
  derived and/or modified sequence opt3 from Citatuzumab_bogatox_LightChain1
gacauccagaugacccaaagccccuccucucugucagccagugugggcgauagagucacaauuacuugcaggagcacgaagucccuccuucacucuaacgggauaaccuaccuguauugguaccagcagaaaccuggaaaggcuccaaaauuguuaaucuaucagaugucgaaucuggcaucagguguuccgagccgguucaguuccucuggcagcgggacagacuuuacucuaaccauuuccucacuccaacccgaggauuucgccacauacuauugugcgcagaaccuggaaaucccucgcaccuuuggacagggcacuaagguggagcuuaaacgaacaguagcugccccaaguguguucauuuuucccccuagcgacgaacagcugaagucugguaccgcauccgucgugugcuugcucaauaacuucuacccacgugaggccaagguucaauggaaaguggauaaugcucugcagucagggaacagccaggaaagugucacggagcaggacucuaaggauuccacuuauagccugucgucuacccucacauuauccaaagcagacuacgagaagcauaaaguguacgccugugaaguaacucaccaaggacugucaagucccguuaccaagagcuuuaauagaggcgagugcacaaggcaucggcagccucgcggcugggaacagcuuuauaacaccguguccuucaauuugggggaggcuuacgaguauccaacguuuauccaagaucugagaaacgaacuagccaagggaacuccggucugucagcuccccgugacacugcagaccauagcggacgauaaaagguucgugcuugucgacaucacuacaaccucuaagaaaacgguuaagguggcaauugauguaaccgacguguacgucguggguuaucaggacaaaugggauggcaaggaccgggccguuuuucuggauaaagugccuacagucgcuacuagcaaguuguucccaggggugaccaaucgcguaacacucacuuuugacggaucauaccaaaagcugguuaacgccgcaaaagcugaucgaaaggccuuagagcugggcgugaauaaacucgaguucaguaucgaagcgauucacgguaagaccaucaacgggcaggaagccgcaaaauucuuucuuauagucauucagaugguguccgaggcugccagauucaaguauaucgagacagaagucguggacaggggacuguacggcagcuuuaagcccaauuucaaaguuuugaaccuagagaacaauuggggcgauauuucugacgcuauccauaagucaaguccucagugcaccacuaucaacccagcccugcaacucauuagccccuccaaugauccgugggugguaaacaaagucucucagauaucgccugacauggggauccugaaguuuaaaagcuccaag

SEQ ID NO: 23086 - RNA, 1380 nt, Artificial Sequence
  derived and/or modified sequence opt3 from Cixutumumab_HeavyChain1
gaggugcagcugguccaaagcggcgccgaaguuaagaaacccggguccucugugaagguaucaugcaaagcuaguggagguaccuucagcuccuacgcaaucucuugggugagacaggccccuggccaggggcucgaguggaugggaggcauuauaccaaucuuugguacagcgaacuaugcucagaaguuccaagggagggucacuauuacggccgacaaaucgaccucaacagcauacauggaacuuagcagucugcgguccgaggauacugccguguauuacugugcucgcgcaccguugcgauuuuuagaauggucuacccaggaccacuauuacuauuacuacauggauguuuggggaaagggcacaaccgugacugucagcuccgccucaacaaagggccccaguguguucccucuggcuccaagcucuaaauccaccucagggggaacggccgcgcuagguugccucguaaaggacuauuuucccgagccuguuacugugagcuggaauaguggcgcacugaccucugggguccauacauucccagccgugcuucaguccagcggacuguacucguugucuuccguggucacuguucccucaaguagccucggcacccagacauauaucuguaacgugaaucacaaaccuuccaacaccaagguagauaaaaagguggagccaaagucuugcgacaaaacgcauacuuguccgcccugcccugcuccagaacugcugggugggcccagcgucuuucucuucccuccaaagcccaaagauacauuaaugauuucacguaccccggaggugacuuguguuguggucgacgugagucacgaagauccugagguaaaguuuaauugguacguugacggaguggagguccauaacgccaaaacaaagcccagagaggaacaauauaauuccaccuacaggguggucagcgugcugacgguucuucaccaggauugguugaacggcaaagaauauaagugcaaggugucuaauaaagcacugccagcuccuaucgagaagaccauaucaaaagccaagggccagccccgggaaccacagguauacacacuacccccuagucgcgaggagaugacuaaaaaccaagucagccucaccugucuggugaagggguucuacccauccgacaucgcgguugaaugggagucuaauggacagccggaaaacaauuauaagacaacucccccugugcuugauucggacgguagcuuuuuccuguacuccaaauugaccgucgacaagucaagauggcagcaaggcaacguguuuaguugcucuguaaugcacgaggcccuccauaaucacuauacacagaaaagccuguccuuaucaccagggaag

SEQ ID NO: 23087 - RNA, 642 nt, Artificial Sequence
  derived and/or modified sequence opt3 from Cixutumumab_LightChain1
agcuccgagcugacccaggaccccgccgugucugucgcucucggccaaacaguuagaaucacuugccagggggauucacuuaggaguuacuaugcaacgugguaccagcagaagccuggacaagccccaauucuggugauauauggugaaaacaaacggccgagcggcauccccgaccgcuucuccgggucuucgucaggaaauaccgcgagcuugacaauuacuggcgcucaggccgaggaugaagcagacuacuauuguaagagucgagaugguuccgggcagcacuuaguauuuggaggcggcaccaaacugacagugcuagggcagccuaaggccgcuccaucugucacccucuuucccccuagcuccgaggaacugcaagcaaacaaagccacucuugugugccugaucucagacuucuacccaggagcuguuacaguggccuggaaggcggauaguagccccgucaaggccgguguggagaccacgacuccuucuaaacaguccaauaacaaguaugcagcuucaagcuacuugagucucaccccagagcaguggaaaucucaucguuccuacagcugucagguaacacacgaaggcucgacuguugagaagaccguggccccggcagaaugcucu

SEQ ID NO: 23088 - RNA, 1350 nt, Artificial Sequence
  derived and/or modified sequence opt3 from Clazakizumab_HeavyChain1
gaggugcagcuggucgaaagcggcgggggacucguucaacccgguggcucccuuagacugucuugcgccgcuucaggguucaguuugagcaacuacuaugugaccuggguaaggcaggcaccuggaaagggcuuagaguggguggguaucauuuacggguccgacgaaacagccuaugcgacuucugcuauaggacgguuuacgaucucgcgcgauaauucaaagaacacccuguaccuacagaugaauagccuccgagccgaggacacagcagucuauuacugugcccgugaugacaguuccgauugggacgcuaaauucaaccuguggggccagggcacucuugugaccguuucuagcgcauccacaaaagggccaucaguguuuccgcuggcccccaguagcaagucuaccuccggagguacugcugccuugggcugccucgucaaagauuauuucccugaaccagugacaguaucauggaauagcggggcgcugaccaguggaguucacacguuucccgcagugcugcaaucuuccggccucuacagcuuaucgucugucgugacugugccuuccucaagucuggguacccagacauacauuuguaacgucaaucauaagccaagcaacacuaagguugacaaaagaguggagcccaaguccugcgauaaaacccacacauguccuccaugcccggcccccgagcuuuugggagggccuucuguauuccuguuuccacccaagccuaaagacacccuaaugaucagcaggacgccagaagugacuugugucgugguugaugugucacaugaggaccccgaagucaaguucaauugguauguggauggcguagagguucacaacgcuaagacaaaaccgcgggaggaacaguacgccaguaccuaucgcguggucuccgugcucacuguccugcaucaggacuggcuuaauggcaaggaguacaaaugcaaggugagcaacaaagcacugccugcucccauugaaaagacaaucucuaaagccaaggggcaaccaagagagccucagguuuauaccuugcccccaucaagggaagagaugacgaagaaucaggugagucucaccugucugguaaaaggauuuuaccccagcgacauagcggucgagugggaauccaacggucagccugagaauaacuauaagacaacuccaccgguguuagauucugacggcucguucuuucuguacagcaaacucaccguugauaagucccgguggcaacaggggaacguguucucaugcagugucaugcacgaagcccuucacaaucauuacacacagaaaucucugagcuugucccccggaaag

SEQ ID NO: 23089 - RNA, 651 nt, Artificial Sequence
  derived and/or modified sequence opt3 from Clazakizumab_LightChain1
gccauccagaugacccaaagccccuccucucugucagcuagugugggcgacagagucacaauuacuugccaggcaagccaguccauaaacaaugagcucucuugguaccagcaaaagccugggaaagccccaaaacuucugaucuauagggcgucgacguuggcuucaggaguuccgagccgguucagugguuccggcucugggaccgauuuuacauuaacuauuagcucccugcagcccgacgauuucgccaccuacuauugucagcagggauacucacuacgcaacaucgacaaugcauuuggcggugggacaaaaguggaaauuaagcgaaccguagccgcuccuaguguguucaucuuuccacccagcgaugagcaacucaaaucuggaacugcauccgucgugugccugcuuaacaauuucuauccucgugaagccaagguucaguggaagguggacaacgcucugcagucaggcaauagccaggagagugucacagaacaagauucuaaagacuccaccuacagcuugucgucuacgcucacucuguccaaggccgauuaugagaaacacaagguguacgcgugugagguaacccaucagggccugucaaguccaguuacaaagagcuuuaacagaggggaaugc

SEQ ID NO: 23090 - RNA, 1347 nt, Artificial Sequence
  derived and/or modified sequence opt3 from Clivatuzumab_tetraxetan_HeavyChain1
caggugcaacugcagcagagcggcgccgaggucaagaaacccggggcuuccguuaaggugucuugcgaagcaucaggauacaccuucccuaguuauguacuccacugggugaaacaggccccaggucaaggccuugaguggaucggguacauuaacccguauaaugacggaacacaguacaacgaaaaguuuaaaggcaaggcgacucugacgagagauaccagcauaaauacagcuuauauggaguuguccagguuacggucugacgauacugccgucuacuauugugcacgcgguuucgggggaucguacggcuuugccuacuggggccaggggacccuggugacaguuucaagcgcuaguaccaagggacccuccguguucccucuagcaccaucuagcaaauccacuucagguggcacagccgcucucgggugccuggucaaggacuauuuucccgaaccugugaccguaaguuggaacagcggagcccuuacgucuggcguucauacuuucccagcggugcugcaguccucagguuuguacagccucaguucugucgugaccgugcccuccagcucgcuggggacacaaacuuauaucuguaaugucaaccacaaaccuucuaauaccaagguugauaaacgaguggagccaaaguccugcgacaagacacauaccuguccgcccugcccugcaccagagcugcucggaggccccucaguauuuuuauucccuccaaaacccaaggauacgcugaugauuagucguacuccggaagugacaugugucgugguugacgugagccacgaggauccugaagucaaauuuaacugguacguggacggcguagagguucauaaugccaagaccaaacccagagaggaacaguauaacuccacuuacaggguggucucugugcuuacagucuugcaccaggauuggcugaaugggaaggaguauaaaugcaaggugagcaacaaggcucuaccagccccuaucgagaaaaccauuucaaaggcaaaaggacagccccgggaaccacaaguuuacacgcugcccccuagucgcgaagagaugaccaagaaucaggugucccucacaugucuuguaaaagguuucuacccaagcgacaucgcugucgagugggaaucuaacggccagccggagaauaacuauaagacuacacccccugugcuggauucagacgggagcuuuuucuuguacagcaagcucaccguugacaaauccagauggcaacagggaaacguguuuucuugcucggucaugcacgaagcccugcauaaucacuauacucagaagaguuuaucccugucaccaggcaaa

SEQ ID NO: 23091 - RNA, 645 nt, Artificial Sequence
  derived and/or modified sequence opt3 from Clivatuzumab_tetraxetan_LightChain1
gacauccagcugacccaaagccccuccucucucucagccagugugggcgauagagucacaaugacuugcagcgcuuccucuucgguuucaagcaguuaccuuuauugguaccagcagaagccugggaaagcaccaaagcuguggauuuauuccacgucuaacuuggccagcggagugccggcgagguucuccgguucaggcagugggaccgacuuuacauuaacuauaagcucucugcagcccgaggauuccgcuucauacuucugucaccaauggaaucgguauccuuacaccuuuggaggcgguacacgccuagaaaucaaacgaaccguagccgcaccaagcguguucauuuuucccccuagugacgagcagcucaagucugggacugccuccgucgugugccugcuuaacaauuucuauccacgugaagcuaaaguucaguggaagguggauaacgcacugcagagcggaaauucgcaagagucugucacagaacaggacuccaaggauucaaccuacaguuugagcuccacgcucacucugucuaaagccgacuacgagaagcauaaaguguaugcuugugagguaacccaccagggccugagcucacccguuacaaagaguuuuaacagaggcgaaugc

SEQ ID NO: 23092 - RNA, 1335 nt, Artificial Sequence
  derived and/or modified sequence opt3 from Codrituzumab_HeavyChain1
caggugcaacugguccagagcggcgccgagguuaagaaacccggggcuuccgugaagguaucuugcaaagcaucaggauacaccuucacagacuaugaaaugcacugggugagacaggccccuggucagggccucgaguggaugggggcgcuugauccaaagacuggagacacggcuuacagucaaaaauuuaagggcagggucacccugacagccgauaagagcacuuccaccgcauauauggaauugucuucguuaacaucagaggacaccgccguguacuauuguacucgguucuacagcuauacauacuggggucaggggacccugguuacggugaguuccgcuucuacuaaaggaccgagcgucuuuccccuagcaccuuccucaaagaguaccagcggcggcacagccgcucucgggugccuggugaaagauuacuucccagaacccguaacuguuucuuggaacuccggagcccuuaccucaggugugcauacauuuccugcgguccugcagagcaguggcuuguauucucucuccagcguggugaccgucccaucgucuucccuggggacgcagacuuacaucuguaauguuaaccacaagcccucaaauacaaaaguggacaagaagguagagccuaaaaguugcgauaagacccauacuuguccaccgugccccgcaccugagcugcucggaggcccaagcguguucuuauuucccccuaaaccaaaggacacacugaugauuucccgcacccccgaagucacgugugugguuguggaugucucucacgaggacccggaagugaaauucaacugguauguagaugguguugaggugcauaaugccaagaccaaaccucgagaggaacaauacaacagcacauaucgugucgugucaguccuuacuguguugcaccaggacuggcugaaugggaaggaguacaagugcaaaguuaguaacaaggcucuacccgccccaauagagaaaaccaucuccaaggcaaaaggacagccuagagaaccccagguguauacacucccacccagcagggaugaacugacuaagaaucaaguaucucuuaccugucuggucaagggcuuuuacccuucagacauugcuguggagugggagaguaacggccagccagaaaauaacuacaaaacaaccccgcccguuuuggacagcgauggguccuucuuucucuauucuaagcugacuguggacaaaucgcgguggcagcaaggaaaugucuucagcugcuccgugaugcacgaggccuuacauaaccacuacacgcagaagucacugagucucucuccugguaaa

SEQ ID NO: 23093 - RNA, 657 nt, Artificial Sequence
  derived and/or modified sequence opt3 from Codrituzumab_LightChain1
gacguggucaugacccagagcccccugucccucccuguuacaccaggcgagccggccucuaucucaugcagaaguagccaaucccuugugcacucuaacaggaauacuuaccugcauugguauuugcagaagcccgggcagucgccucaguuacugauuuacaaaguaucaaaccgguucagcggagugccagaucgcuuuagugguuccggcucugggacggacuucacccuaaagauaagccgagucgaagcugaggaugugggaguuuauuacuguucccaaaauacacacgugcccccuacuuuuggccaggguaccaaacucgaaaucaagcguacagucgcagccccaucaguguucauuuuucccccuagugacgagcagcugaaaagcgggaccgcgucuguaguuugccuucugaacaauuucuauccaagagaagcuaaggugcaguggaaggucgauaacgccuugcaauccggaaauucacaggagagcgugacugagcaggacaguaaagauucuacauacucccucagcucgacccugacgcugucuaaggcagacuaugaaaaacauaagguguacgccugugaggucacucaccagggccucuccucaccgguuaccaaaaguuuuaacaggggcgaaugc

SEQ ID NO: 23094 - RNA, 1350 nt, Artificial Sequence
  derived and/or modified sequence opt3 from Coltuximab_ravtansine_HeavyChain1
caggugcaacugguccagcccggcgccgagguugugaagccuggggcuagcguaaaacucuccugcaagaccucuggauacacauucacuucaaacuggaugcacugggugaaacaggcaccaggucagggccuugaauggaucggggagauugacccgagugauagcuauacgaauuacaaccaaaauuuucagggaaaggccaaacugaccgucgacaaguccacaucuacugcguauauggaagugucgucauugagaagcgaugacaccgcuguuuacuauugugccaggggcaguaaccccuacuauuacgcaauggauuacuggggucaggggacauccgugaccgucucuagcgccuccacuaagggaccuucaguguucccauuagcucccaguagcaaaucuacauccggcggcaccgcagcccuggggugccuaguaaaggacuauuuuccugagccaguuacggugucauggaauagcggagcucucacaagugguguccauaccuuccccgccgugcugcagucuuccggccuuuacagccugucgucuguggucacaguuccuuccucaaguuuggggacucaaaccuauauauguaacgugaaucacaaaccaagcaacacaaagguagauaaaaagguggaaccgaaguccugcgacaaaacccauacgugucccccuugcccagcgcccgagcuccugggaggcccuucugucuuucuguucccacccaagccgaaagauacucucaugaucagccggacaccugaggugaccuguguuguggucgacgugucacacgaagaucccgagguaaaguuuaauugguacguugacgguguggaaguccauaacgcaaaaacuaagccacgcgaggagcaguauaauaguacauaccgaguggucuccguguuaaccguucugcaccaggauuggcuuaacgggaaagaauauaagugcaaggugagcaauaaagccuugccugcucccauugagaagacgaucucuaaagccaagggacagccacgugaaccccaaguauacacccugccuccaucaagagacgagcuaacuaaaaaccaggucagucucacuugucuggugaagggcuucuacccgagcgacauugcaguugaaugggaguccaauggccagcccgagaacaacuauaagaccacaccuccagugcuugauucugacgggucguuuuuccuguacagcaaauugacugucgauaaguccagguggcaacagggaaauguguuuucaugcaguguaaugcacgaagcucuccauaaccacuauacccagaaaucucugagcuuaucccccgguaag

SEQ ID NO: 23095 - RNA, 633 nt, Artificial Sequence
  derived and/or modified sequence opt3 from Coltuximab_ravtansine_LightChain1
gagaucgugcugacccagagccccgccauuauguccgcuucuccuggcgaaagagucacaaugacuugcucagcaaguagcgggguuaacuacaugcacugguaucaacagaagccaggaacguccccgaggcgguggauauacgacaccucuaaacucgccucgggugugcccgcgcgcuucucaggcagcgggaguggaacagauuauucccuuacuaucucuagcauggagccugaagacgcugccaccuacuauugucaucagcgaggcuccuacacauuuggugggggaaccaagcuggagauuaaacguacuguagcagccccaucaguguucaucuuucccccuagugaugaacaguuaaagagcggcacagcuucugucgugugcuugcugaauaacuucuauccaagagaggcaaaaguucaauggaagguggacaaugcccuacaguccggcaacucacaggagagcgucaccgaacaggauaguaaggacucuacguacucccucagcucgacucugacccuuucuaaagcugauuacgagaagcacaaaguguaugccugugaaguaacacaucaagggcuguccucacccguuacuaagaguuuuaauaggggagagugc

SEQ ID NO: 23096 - RNA, 1356 nt, Artificial Sequence
  derived and/or modified sequence opt3 from Conatumumab_CV_HeavyChain
caggugcaacugcaggagagcggccccgggcucgucaagccuucccagacccuuucucugacaugcacuguuucaggagguaguaucagcuccggcgacuacuucuggucuuggauuagacaguugccagggaaaggauuagaauggauaggccacauccauaacucggguacgaccuauuacaauccgucacuaaagagcagggugacaauuaguguagauacuuccaaaaagcaauuuucucugcggcucagcuccgugaccgccgcugacacagcagucuauuacugugcccgcgaucgagggggagacuauuacuauggcauggauguguggggccaggggaccacuguuacagugucaagugcgagcaccaaaggacccucugucuucccucuggcuccauccucaaagagcacgagugguggcacugccgcacuugggugccuggugaaggacuacuuucccgagccuguaaccguuucuuggaacuccggagccuugacaagcggcgugcacacuuucccagcuguccuccagucgucuggucuguacucccugucaaguguggugaccguccccagcuccucucucgggacacagaccuauaucuguaauguuaaccauaaaccuagcaauacgaagguggauaaacguguagaaccaaagucaugcgacaaaacucacacauguccgcccugcccugcaccagaguuacugggaggccccaguguguuucuuuucccuccaaagcccaaggauaccuugaugauuuccagaacuccggaagucacaugugugguuguggacgucagccaugaggauccugaggugaaauuuaacugguacguagacggcguugaagugcacaaugccaagaccaaacccagggaggaacaauauaacucuacguaccgggucgugucaguccugaccgugcuacaccaggauuggcucaaugggaaggaguauaaaugcaagguuaguaacaaagcucugccagccccuaucgagaagacaauaagcaaggcgaaaggacagccccgcgaaccacagguguacacucuucccccuuccagagaggaaaugaccaagaaucaaguaucucugacauguuuggucaaagguuucuauccaucggacaucgcaguggagugggaaagcaacggccagccggagaauaacuacaagacuacacccccuguucucgacuccgaugggucauuuuuccuguacaguaaauuaaccguggacaagucuagguggcagcaaggaaaugucuuuagcugcuccgugaugcaugaggcccugcacaaccauuauacccagaagucacucagccuuucuccaggcaaa

SEQ ID NO: 23097 - RNA, 645 nt, Artificial Sequence
  derived and/or modified sequence opt3 from Conatumumab_CV_LightChain
gagaucgugcugacccagagccccggcacacucucccuuucuccuggggaaagagccacucugucaugcagggcuagucaaggaauuagccgguccuacuuggcaugguaucagcagaagccaggucaggccccgucuuuacugauauacggcgcgucgucacgcgcuacggggauccccgaccgauucagcggaaguggcuccgguaccgauuuuacacuaacuauuucucgucucgagccugaagacuucgccgucuauuacugucaacaguuugggagcuccccauggaccuucggacagggcacaaaaguugagaucaagagaaccguggcagcccccucaguauuuauuuucccuccaagugaugaacagcugaaaagcggcacugcuucuguggucugccuucugaacaauuuuuaucccagggaggcaaaggugcaauggaaaguugacaacgccuugcaguccggaaauucacaggagagcgugacagaacaggauaguaaggacucuaccuacucccucagcucgacgcugacucugucuaaggcugauuaugagaaacacaaggucuacgccugugaagugacccaucaagggcucuccucaccuguaacaaaaaguuucaaccggggugagugc

SEQ ID NO: 23098 - RNA, 1356 nt, Artificial Sequence; identical to SEQ ID NO: 23096
  derived and/or modified sequence opt3 from Conatumumab_HeavyChain1

SEQ ID NO: 23099 - RNA, 1356 nt, Artificial Sequence; identical to SEQ ID NO: 23096
  derived and/or modified sequence opt3 from Conatumumab_HeavyChain

SEQ ID NO: 23100 - RNA, 645 nt, Artificial Sequence; identical to SEQ ID NO: 23097
  derived and/or modified sequence opt3 from Conatumumab_LightChain1

SEQ ID NO: 23101 - RNA, 645 nt, Artificial Sequence; identical to SEQ ID NO: 23097
  derived and/or modified sequence opt3 from Conatumumab_LightChain

SEQ ID NO: 23102 - RNA, 1344 nt, Artificial Sequence
  derived and/or modified sequence opt3 from Concizumab_HeavyChain1
gaggugcagcuggucgaaagcggcgggggacucguuaagcccgguggcucccuuagacugucuugcgccgcuucaggguucaccuuuaguaacuacgcaaugagcugggugaggcaaacaccugagaaacgguuggaauggguagccacuaucucccgcucuggaucguauucauacuucccagacagcgugcagggccgauuuacgauuagucgugauaaugcgaagaacuccuuauaucugcagaugaauagccuaagagcugaggacaccgccgucuacuauugugcaaggcucgguggguacgaugaaggagacgccauggauucuuggggccagggcacaacugugaccguuuccucagcuaguacaaaagggccgagcguguucccccuggcaccuugcucucgguccaccucagagagcacugccgcucuuggaugucuggucaaggacuauuuuccagagcccgugacaguaaguuggaacucuggugccuugaccuccggcguucacacguucccugcggugcuccaaagcucggggcuguacucucuguccucagucgugacugugccaaguagcucccucggaaccaaaacauacacuugcaaugucgaucauaagcccucuaacaccaagguugacaaacgcguggaaagcaaguauggcccuccauguccgcccugcccugcaccagaguuuuuaggugggcccucaguauuccuguuuccuccaaaacccaaggauacacuuaugauaaguagaaccccggaagugacgugugucgugguugacgugucccaggaggauccugagguccaguucaauugguacguggacggaguagaaguucacaacgccaaaacuaagcccagggaggaacaguuuaauagcacauaucggguggucucuguguugaccguccugcaucaagauuggcuaaacggcaaggaguacaaaugcaaggugucaaauaaaggccucccaaguagcaucgaaaagacuauuuccaaagcuaaggggcagccucgcgagccccagguuuauacacugccacccucucaggaggaaaugaccaaaaaccaagugucgcuuacgugucugguaaagggauucuacccuagcgacaucgccgucgagugggaauccaauggucagccagagaacaauuauaagaccacaccgcccguguuggacucagauggcaguuucuuucucuacucucgacugacuguugacaaaagcagauggcaggaagggaacguguucuccugcucagucaugcacgaggcauuacauaaccacuacacccaaaagagccugucucucucccuuggaaaa

SEQ ID NO: 23103 - RNA, 657 nt, Artificial Sequence
  derived and/or modified sequence opt3 from Concizumab_LightChain1
gacaucgugaugacccagacaccccugagccucuccgucacuccuggccaaccagccucuauuucaugcaagaguagccagucccuucuggagucugaugggaaaacguacuugaacugguauuuacagaagccgggacagucgccccaacugcuaauauaccucguuucaauccuggacagcggugugccugauagauucaguggcuccgggucuggaaccgacuuuacacuuaaaauuagcaggguagaagcugaggaugugggcgucuauuacugucugcaggcaacucacuucccacagaccuuuggugggggaacaaagguggaaaucaaacggaccguugccgcgcccuccguguucauuuuuccuccaucagacgagcaguugaagaguggcacugcuagcgucgugugccuccugaauaacuucuauccccgcgaagccaagguacaauggaaaguugauaaugcacugcagucuggcaacucccaggagucagugacagagcaggacagcaaggauaguaccuacucucucuccagcacguuaacucugucgaaagccgacuaugaaaagcauaaagucuacgcuugugaggugacccaccaagggcuuucuuccccugugacaaagucauuuaaucgaggagaaugc

SEQ ID NO: 23104 - RNA, 1314 nt, Artificial Sequence
  derived and/or modified sequence opt3 from Crenezumab_HeavyChain1
gaggugcagcuggucgaaagcggcgggggacucguucaacccgguggcucccuuagacugucuugcgccgcuucaggguucaccuuuaguagcuacggaauguccugggugaggcaggcaccuggcaaggguuuggaguuaguagccucuaucaacucgaaugggggaucaacauauuacccagacagcgugaaaggccgguucacuauuagucgcgauaacgcgaaaaauucccuguaucuacagaugaacucucuccgagcugaagacacggccgucuacuauugugcaagcggcgauuacugggggcagggaaccacagugacuguuuccucagccaguaccaaagguccgagcguguuuccccuggcuccuugcucucguuccacaucagagagcaccgcagcccuuggcugucuggucaaggacuauuucccagaacccgugacuguaaguuggaacucuggggcuuugacauccggaguucacaccuuuccugccgugcuccaaagcucgggccuguacucucuguccucagucgugacggugccaaguagcucccucgguacuaaaaccuacacaugcaaugucgaucauaagcccucuaauacuaagguugacaaaagaguggagagcaaguaugggccuccauguccgcccugcccugcgccagaguucuuaggaggccccucaguauuucuguucccuccaaaacccaaggauacccuuaugauaaguaggacaccggaagugaccugugucgugguugacgugucccaggaggauccugaaguccaguuuaacugguacguggacggcguagagguucacaaugcaaaaacgaagccccgggaggaacaguucaacagcacuuaucgcguggucucuguguugacaguccugcaucaagauuggcuaaaugggaaggaguacaaaugcaaggugucaaacaaaggacucccaaguagcaucgaaaagaccauuuccaaagccaagggucagccuagagagccccagguuuauacucugccacccucucaggaagagaugacaaagaaucaagugucgcuuaccugucugguaaagggcuuuuacccuagcgacaucgcugucgagugggaauccaacgggcagccagagaauaacuauaagacgaccccgcccguguuggauucagacggaaguuucuuucucuacucuaggcugacaguugacaaaagccgguggcaggaaggcaacguguucuccugcucagucaugcacgaggccuuacauaaucacuacacucaaaagagccugucucucucccuuggu

SEQ ID NO: 23105 - RNA, 657 nt, Artificial Sequence
  derived and/or modified sequence opt3 from Crenezumab_LightChain1
gacaucgugaugacccagagcccccugucccucccugucacaccaggcgagccggccucuauuucaugcagaaguagccaaucccuuguuuacucuaacggggauacuuaucugcacugguacuugcagaaacccggacagucgccucaguuacugauauauaaagugucaaauagguucagcgguguaccagaccgguuuaguggcuccgggucuggaacggauuucacccuaaagaucagccgcguggaagcugaggacgucggcguguacuauuguucccaaucaacacauguucccuggacuuuuggucaggggaccaaaguggaaauuaagcgaacagucgcagccccuaguguguucaucuuuccacccagcgaugagcagcucaaaucuggaaccgcguccguaguuugccugcuuaacaauuucuacccucgugaagcuaaggugcaguggaaggucgacaacgcccugcaaucaggcaauagccaggagagugugacugagcaggauucuaaagacuccacauauagcuugucgucuacccucacgcuguccaaggcagauuacgaaaaacacaagguguacgccugugaggucacucaucagggccugucaaguccaguuaccaagagcuuuaacagaggggaaugc

SEQ ID NO: 23106 - RNA, 1365 nt, Artificial Sequence
  derived and/or modified sequence opt3 from Crotedumab_HeavyChain1
gaggugcagcuggucgaaagcggcgggggacucguucaacccgguggcucccuuagacugucuugcgccgcuucaggguucaccuuuaguaacuacuugaugaauugggugaggcaggcaccuggaaagggcuuagaguggcuggccaacauccaggaagacgguauugagaaauauuacguagauagcgugaaggggcgguucacaauaucccgcgacaaugcgaaaaacucucuauaucuccagaugaacucgcugcgagcugaagauacugccgucuacuauugugcacgugagccaucacacuacgacauccuuacgggauaugauuacuacuauggcauggacguguggggccaagggaccacaguuacugugagcagugccuccaccaagggaccgucugucuuuccccuggcuccuugcagcagauccacaucagagaguaccgcagccuuggguugucucgugaaagauuacuucccagaacccguaacuguuagcaauaauucuggcgcucugacauccggggugcauaccuuuccugccguccugcagucaagcggacucuauaguuuaucuuccguggugacggucccaagcucgucucugggcacuaagaccuacacaugcaacguugaccacaagcccuccaauacuaaaguggauaagaggguagagucaaaauaugguccuccauguccgcccugcccugcgccagaguuccuugggggacccaguguguuuuuguucccuccaaagcccaaagacacccugaugauuagccggacaccggaggucaccugugugguuguggaugucucccaggaggacccugaagugcaguuuaacugguacguagauggcguugaggugcauaaugcaaagacgaagccccgcgaagaacaauucaacucuacuuauagagucgugagcguccuaacagugcuccaccaggacuggcugaauggcaaagaauacaagugcaaaguuucaaacaaggggcuuccaaguuccaucgagaaaaccauuagcaaggccaaaggacagccuagggagccccagguguacacucugccacccucucaagaagagaugacaaagaaucagguaucauugaccugucucgucaaggguuuuuauccuagugacaucgcuguggaaugggagagcaacggccagccagaaaacaauuacaaaacgaccccgcccguucuggauuccgacgggucuuucuuuuuauauucgcggcugacaguggauaagagccgcuggcaagagggaaacgucuucuccugcucagugaugcaugaggcccuccacaaucacuacacucagaaaagucuuucucugagcuugggcaag

SEQ ID NO: 23107 - RNA, 1365 nt, Artificial Sequence
  derived and/or modified sequence opt3 from Crotedumab_HeavyChain2
gaggugcagcuggucgaaagcggcgggggacucguucaacccgguggcucccuucaccugucuugcgccgcuucaggguucaccuuuaguaacuacuugaugaauugggugagacaggcaccuggaaagggcuuagaguggcuggccaacauccaggaagacgguauugagaaauauuacguagauagcgugaaggggagguucacaauaucccgggacaaugcgaaaaacucucuauaucuccagaugaacucgcugcgcgcugaagauacugccgucuacuauugugcacgagagccaucacauuacgacauccuuacgggauaugauuacuacuauggcauggacguguggggccaagggaccacaguuacugugagcagugccuccaccaagggaccgucugucuuuccccuggcuccuugcagccguuccacaucagagaguaccgcagccuuggguugucucgugaaagauuacuucccagaacccguaacuguuagcaauaauucuggcgcucugacauccggggugcacaccuuuccugccguccugcagucaagcggacucuauaguuuaucuuccguggugacggucccaagcucgucucugggcacuaagaccuacacaugcaacguugaccauaagcccuccaauacugagguggaugaaagaguagagucaaaauaugguccuccauguccgcccugcccugcgccagaguuccuugggggacccaguguguuuuuguucccuccaaagcccaaagacacccugaugauuagcaggacaccggaagucaccugugugguuguggaugucucccaggaggacccugaagugcaguuuaacugguacguagauggcguugaggugcacaaugcaaagacgaaaccccgggaagaacaauucuggucuacuuaucgcgucgugagcguccuaacagugcuccaucaggacuggcugaacggcaaggaguacaagugcaaaguuucaaauaaggggcuuccaaguuccaucgagaaaaccauuagcaaggccaaaggacagccuagagagccccagguguacacucugccacccucucaagaagagaugacaaagaaccagguaucauugaccugucucgucaaagguuuuuauccuagugacaucgcuguggaaugggagagcaauggccagccagagaacaacuacaagacgaccccgcccguucuggauuccgacgggucuuucuuuuuauauucgaggcugacaguggaugaaagccgguggcaagagcacaaugucuucuccugcucagugaugcacgaagcccuccauaaccacuacacucagaagagucuuucucugagcuugggaaaa

SEQ ID NO: 23108 - RNA, 642 nt, Artificial Sequence
  derived and/or modified sequence opt3 from Crotedumab_LightChain1
gacauccagaugacccaaagccccuccucucugucagccagugugggcgauagggucacaauuacuugcagggcuagccaggggauacggaacgaccucggaugguaccagcagaagccugguaaagcaccaaagcgccuuaucuaugccgcguccucucugcaaucgggcguuccgucacgauucagcgggaguggauccggcacggaguuuauuuugaccgugucuagcuuacagcccgaagauuucgcuacauacuauugucugcaguacaaugagaacccuuuuacuuucgguccagggaccaaaguagacaucaagcguacaguggccgcacccuccgucuuuauuuucccuccaucagaugaacagcuaaaaaguggaaccgccagcgugguuugccuccugaauaacuuuuaucccagagaggcuaaggugcaauggaaggucgacaaugcacuucagucuggcaacucccaggaaucagugacugagcaggauagcaaagacaguacauacucucuguccagcaccuugacgcucucgaaggccgauuaugaggaacacaaaguauacgcuugugagguuacucaucaaggccugucuuccccugugaccaagucauucaauagaggggaaugc

SEQ ID NO: 23109 - RNA, 642 nt, Artificial Sequence
  derived and/or modified sequence opt3 from Crotedumab_LightChain2
gacauccagaugacccaaagccccuccucucugucagccagugugggcgauagggucacaauuacuugcagggcuagccaggggauacggaacgaccucggaugguaccagcagaagccugguaaagcaccaaagcgccuuaucuaugccgcguccucucugcaaucgggcguuccgucacgauucagcgggaguggauccggcacggaguuuauuuugaccgugucuagcuuacagcccgaagauuucgcuacauacuauugucugcaguacaauuccaacccuuuuacuuucgguccagggaccaaaguagacaucaagcguacaguggccgcacccucagucuuuauuuucccuccaagugaugagcagcuaaaaagcggaaccgccucugugguuugccuccugaauaacuuuuaucccagagaagcuaaggugcaaaauaaggucgacaacgcacuucaguccggcaauucacaggagagcgugacugaacaggauaguaaagacucuacauacucccugagcucgaccuugacgcucucugaggccgauuaugagaagcacaaaguauacgcuugugaaguuacucaucaaggccuguccucaccugugaccaagaguuucaacagaggggagugc

SEQ ID NO: 23110 - RNA, 1332 nt, Artificial Sequence
  derived and/or modified sequence opt3 from Dacetuzumab_HeavyChain1
gaggugcagcuggucgaaagcggcgggggacucguucaacccgguggcucccuuagacugucuugcgccgcuucaggguacaguuucaccggauauuacauccacugggugaggcaggcaccuggcaaggguuuggaguggguagcccgggugauuccaaacgcugggggaacaagcuauaaucagaaauuuaagggccgcuucacuuuauccgucgacaacucuaaaaauacggcguaccugcagaugaacucgcuacgagccgaagauaccgcaguguauuacugugcccgugagggcauauauuggugggggcaaggaacacucguuacugugucaagcgcuaguaccaaggguccguccgucuuuccccuggcaccuucuagcaaauccacaucaggcgggaccgccgcucuuggaugccuggugaaggacuacuucccagaacccguaacuguuaguuggaauagcggcgccuugacaucuggugugcauaccuuuccugcgguccuccaguccucagggcuguacagccugaguucuguggugacggucccauccagcucgcucggaacucagaccuauaucuguaacguuaaucacaagcccucuaacacaaaaguggauaagaaaguagagccuaaguccugcgacaaaacucauaccuguccaccgugccccgcaccugaguuacugggcggcccaucaguguuccuuuuucccccuaagccaaaggauacauugaugauuaguagaacccccgaagucacgugugugguuguggacgucagccacgaggauccggaagugaaauucaauugguacguagacgggguugaggugcauaacgccaagacuaaaccuagggaggaacaguauaauuccacauaccgggucgugucuguccugaccgugcuacaccaagauuggcucaacggaaaggaguauaaaugcaagguuagcaauaaagcucugcccgccccaaucgaaaagacuauuucaaaggcaaaaggucagccucgcgagccccagguguacacacuuccacccaguagagaagagaugaccaagaaccagguaucccugacguguuuggucaaaggcuuuuauccuagcgacaucgcuguggagugggaaucuaaugggcaaccagagaacaacuacaagaccacaccgcccguucucgauucagacggaaguuucuuucuguacagcaaauuaacuguggauaaguccagguggcagcagggcaaugucuucucuugcucggugaugcacgaagcccugcauaaccacuauacccaaaagagccucucccuuucaccugguaaa

SEQ ID NO: 23111 - RNA, 657 nt, Artificial Sequence
  derived and/or modified sequence opt3 from Dacetuzumab_LightChain1
gacauccagaugacccaaagccccuccucucugucagccagugugggcgauagagucacaauuacuugcaggagcucccagucucucguucacucgaacgggaauacguuccuucauugguaccagcagaagccuggaaaagcuccaaagcuguugauauauaccgugucaaaccgguuuagcgguguaccgagucgcuucuccggcucugggagcggaacagacuuuacuuuaaccaucuccucacugcaacccgaggauuucgcaacauacuuuuguagucagaccacucacgugccuuggacauucggccaggguaccaaagucgaaauuaagcgaacgguggccgcgccaagcguuuuuaucuuucccccuucugacgagcagcuaaaauccgggacugcuucaguggucugccuccugaauaacuucuauccacgugaagccaaggugcaauggaagguagauaaugcacuucagagcggaaacagucaggagucuguuaccgaacaggacuccaaagauagcacauacucgcugucuuccacuuugacccucucaaaggccgacuaugagaaacauaagguguacgcuugugaggucacacaccaaggccugaguagccccgugaccaaauccuucaauagaggcgaaugc

SEQ ID NO: 23112 - RNA, 318 nt, Artificial Sequence
  derived and/or modified sequence opt3 from Dacliximab_LightChain_VJ-Region
gacauccagaugacccaaagccccuccacacugucugccucagugggcgauagagucacuauuacgugcagugcuagcuccucuauaucguacaugcacugguaucagcagaagccugggaaagcaccaaagcuccuuaucuacaccacaucaaaccuggccagcggaguuccggcgagguucagugguuccggcucugggacugaguuuaccuugacaauuagcuccuuacagcccgacgauuucgcuaccuauuacugucaucaacggucaacuuauccucugacauuuggacagggcaccaaaguggaaguaaag

SEQ ID NO: 23113 - RNA, 348 nt, Artificial Sequence
  derived and/or modified sequence opt3 from Dacliximab_gamma2-Chain_VDJ-Region
caggugcaacugguccagagcggcgccgagguuaagaaacccggguccucugugaagguaucaugcaaagcuaguggauacaccuucacaagcuauagaaugcacugggugaggcaggcaccuggucagggccucgaauggaucggguacauuaacccauccacuggauauacggaguacaaucaaaaguuuaaagacaaggccaccauaacagcggaugaaucuacuaacaccgcuuauauggagcuuucgucacugcggagcgaagacacagccgucuacuauugugcacgcggcggugggguguucgauuacuggggacagggcaccuugguuacugugaguucc

SEQ ID NO: 23114 - RNA, 1326 nt, Artificial Sequence
  derived and/or modified sequence opt3 from Daclizumab_HeavyChain
caggugcaacugguccagagcggcgccgagguuaagaaacccggguccucugugaagguaucaugcaaagcuaguggauacaccuucacaagcuauagaaugcacugggugaggcaggcaccuggucagggccucgaauggaucggguacauuaacccauccacuggauauacggaguacaaucaaaaguuuaaagacaaggccaccauaacagcggaugaaucuacuaacaccgcuuauauggagcuuucgucacugcggagcgaagacacagccgucuacuauugugcacgcggcggugggguguucgauuacuggggacagggcaccacuuugacaguuaguuccggcccgucuguguuucccuuagccccuagcuccaagucaaccagugggggaacggcugcacuggguugccuagucaaagacuacuucccagagcccgugacuguaagcuggaacucuggcgcccucaccuccgggguucauacauuuccugcugugcugcagucaagcggacuuuauagucugucuuccgucgugacugugccaagcucgucuuugggcacccagacauacaucuguaaugucaaucacaagcccuccaacaccaaaguugauaagaaagccgagccuaagucaugcgacaagacgcauacuuguccaccgugccccgcgccugaacuccugggugggccaaguguguuccuguuucccccuaaaccaaaggauacacucaugauuagccgaacccccgagguaacuuguguggucguggacguuucccacgaagauccggaggugaaauucaauugguaugucgacggaguggagguacauaacgcaaagacaaaaccucgugaggaacaauacaauucuaccuauagaguugugagcgucuuaacggugcugcaccaggauuggcuuaacggcaaggaauacaaaugcaaggucucaaauaaggccuugcccgcuccaaucgagaaaaccauuaguaaggccaaaggccagccuagggaaccccagguguauacacugccacccucccgggacgagcuaacuaagaaccaaguuagccucaccugucuggugaaaggguuuuacccuucugauaucgcaguagagugggaaucaaauggacagccagagaacaauuacaagacaacuccgcccguccuugacagugacgguagcuucuuucuguauuccaaguugaccguggauaaaucucgcuggcagcaaggcaacguuuucucgugcagcgugaugcacgaagcucuccauaaccacuacacacagaagucccugucauuaaguccugggaaa

SEQ ID NO: 23115 - RNA, 630 nt, Artificial Sequence
  derived and/or modified sequence opt3 from Daclizumab_LightChain
gacauccagaugacccaaagccccuccacacugucugccucagugggcgauagagucacuauuacgugcagugcuagcuccucuauaucguacaugcacugguaucagcagaagccugggaaagcaccaaagcuccuuaucuacaccacaucaaaccuggccagcggaguuccggcgagguucagugguuccggcucugggacugaguuuaccuugacaauuagcuccuuacagcccgacgauuucgcuaccuauuacugucaucaacggucaacuuauccucugacauuuggaaguggcaccaaaguggaaguaaagcgcacgguggccgcaccaagcgucuucaucuuucccccuucugacgagcagcuaaaauccgguacugccucagugguuugccuccugaauaacuucuacccacgagaagcuaaggugcaguggaaggucgauaaugcacuucagagcgggaacagucaagagucugugaccgaacaggacuccaaagauagcacauauucgcugucuuccacuuugacccucucaaaggccgacuacgagaaacacaagguauacgcuugugagguuacacaucagggacugaguagccccgugaccaaauccuuuaaucgu

SEQ ID NO: 23116 - RNA, 1341 nt, Artificial Sequence
  derived and/or modified sequence opt3 from Dalotuzumab_HeavyChain1
caggugcaacugcagcagagcggccccgggcucgucaagccuucccagacccuuucucugacaugcacuguuucaggauggaguaucagcgguggcugguuguggaacuggauuagacaaccaccggggaaaggauuacaguggauaggcuggaucuccugggacgguacgaauaacuggaagcccucucugaaagauagggugaccauuucgguagacacaucaaagaaucaguucagccuaaaacucaguuccgugacugccgcugauaccgcagucugguggugugcccggugggggcgcguguuuuucgacugguggggacagggcacacugguuaccgugucuagcgcguccacuaagggcccuucagucuuuccacuugcucccaguagcaagucuacauccgggggaaccgccgcacuggguugcuuggugaaagauuacuucccugagccaguaacgguuucauggaacagcggcgcccucacaaguggggugcacaccuuucccgcuguccugcaaucuuccggacuguauagccucucgucuguggugacagucccuuccucaaguuuaggcacucagaccuacaucuguaauguuaaccauaagccaagcaauacaaaaguggacaagcgaguagaaccgaaauccugcgauaagacccacacgugucccccuugcccagcacccgagcugcuuggugggccuucuguguucuuguuuccacccaagccgaaagacacucugaugauuagccguacaccugaagucaccugugugguuguggaugucucacaugaggaccccgaagugaaguucaacugguauguagauggaguugaggugcacaaugccaaaacuaagccaagagaggaacaguacaacaguacauauagggucguguccguccuaaccgugcuccaucaggacuggcugaauggcaaagaguacaagugcaaaguuagcaacaaggcccuuccugcucccaucgaaaagacgauaucuaaagcgaagggccaaccacgggagccccagguguauacccugccuccaucacgcgaggaaaugacuaaaaaucagguaaguuugacuugucucgucaagggguuuuacccgagcgauaucgcaguggagugggaauccaacggacaacccgagaauaacuacaaaaccacaccuccaguucuggacucugacgguucguucuuuuuauauagcaagcugacuguggauaaguccagauggcagcagggcaacgucuucucaugcagugugaugcacgaagcccuccacaaucauuacacccagaaaucucuuagccugucccccgggaag

SEQ ID NO: 23117 - RNA, 657 nt, Artificial Sequence
  derived and/or modified sequence opt3 from Dalotuzumab_LightChain1
gacaucgugaugacccagagcccccugucccucccugucacaccaggccaaccggccucuauuucaugcagaaguagccaguccauaguucacucuaacgggaauacuuggcuucagugguggcugcagaagcccggacaaucgccucaguuguuaaucuggaaagugucaaacaggcugugggguguaccagaucgguucagcggcaguggguccggaacggacuuuacccuaaagauuucucgcgugcaggcucaggaugucggcguguggugguguuuccaagguagccauguucccuggacauuugggcagggaacuaaagugcagaucaagcgaaccgucgcagccccuuccguguucauuuuuccacccucagacgagcagcucaaaaguggcacagcgagcguaguuugccugcuuaauaacuucuacccucgugaagcuaaggugcaauggaaggucgauaaugcccugcagucuggcaacucccaggagucagugaccgaacaagacagcaaagauaguacuuauucuuuguccagcacacucacccugucgaaggcagacuacgagaaacacaagguguaugccugugaagucacgcaucaggggcugucuuccccaguuacuaaaucauuuaauagaggagagugc

SEQ ID NO: 23118 - RNA, 687 nt, Artificial Sequence
  derived and/or modified sequence opt3 from Dapirolizumab_pegol_HeavyChain1
gaggugcagcuggucgaaagcggcgggggacucguucaacccgguggcucccuuagacugucuugcgccgugucaggguucaguagcaccaacuaccacguacauugggugaggcaggcuccuggaaagggcuuggaguggaugggugucaucuggggagacggggauacauccuauaauucuguguuaaaaucgcgguuuacuauuucacgcgacacgagcaagaacaccguuuaccugcagaugaauagucuacgagcagaagauacagccguguauuacugugcgcgucagcucacucacuauuacguccuggcugccuggggccaaggcacccuugugacaguauccucugcaagcaccaaagggccauccguuuucccgcuggcccccucaaguaagagcacuucuggagguacagcugcauugggcugccucgugaaagacuauuuuccugagccagucaccguguccuggaacucaggggcccugacgagcggagugcauacuuuccccgcuguccugcagaguucuggccucuacuccuuaagcucgguugugaccguaccuucuuccucacuggguacacagacuuacauauguaaugugaaccacaagccaaguaauaccaaggucgauaaaaagguggaacccaaaagcugcgacaagacacauaccugugccgcg

SEQ ID NO: 23119 - RNA, 642 nt, Artificial Sequence
  derived and/or modified sequence opt3 from Dapirolizumab_pegol_LightChain1
gacauccagaugacccaaagccccuccucucugucagccagugugggcgauagagucacaauuacuugcagggcuagcgaggaccucuacuauaaccuugcaugguaccagcggaagccugggaaagccccaaagcuguugauauaugauacguaccgcuuagcggacggaguuccgucccgauucucugguucgggcucagggaccgauuauacacugacuaucagcagucuacagcccgaagacuuugcuuccuacuauugucagcaauacuacaaauucccuuuuaccuucggacagggcacaaagguggagauuaaacguaccguagccgcaccaucuguguuuaucuuucccccuagcgaugaacagcucaaguccgguacugccucagucgugugccugcuuaauaacuucuauccaagagaggcuaagguucaguggaaaguggacaaugcacugcaaagugggaacagccaggaaucugucacagagcaggauuccaaggacucaaccuacagcuugaguucuacgcucacucuguccaaagccgauuaugagaagcacaaaguguacgcuugugaaguaacccaucagggacugagcucgcccguuacaaagucuuucaauaggggcgagugc

SEQ ID NO: 23120 - RNA, 1356 nt, Artificial Sequence
  derived and/or modified sequence opt3 from Daratumumab_HeavyChain1
gaggugcagcugcucgaaagcggcgggggacuuguccaacccgguggcucccugagauugucuugcgcuguuucaggguucaccuuuaacaguuucgcuaugagcugggugaggcaggcaccuggaaagggcuuagaguggguauccgccaucucugguucagggggaggcacauacuaugcggacucggugaaaggccgguuuacuauuagccgcgauaauaguaagaacacgcuguaccuacagaugaacucccuccgagcugaagacaccgccgucuauuucugugcaaaagauaagauacugugguuuggggagccaguguucgacuacuggggacaggguacacuuguuacugugucuagcgccuccaccaaaggcccgucagucuuuccccuggcuccuaguagcaagucuacauccgggggaaccgcagccuugggcugccucgugaaggauuauuucccagaacccguaacuguuucauggaauagcggugcucugacaaguggggugcacaccuuuccugccguccugcaaucuuccggacucuacagcuuaucgucuguggugacggucccauccucaagucugggcacucagaccuauaucuguaauguuaaccauaaacccagcaauacaaagguggacaaacguguagagccuaaguccugcgauaaaacucacaccuguccaccgugccccgcgccugagcuuuugggcgggccaucuguguuccuguuucccccuaagccaaaggacacacuaaugauuagcagaacccccgaagucacgugugugguuguggaugucucacaugaggacccggaagugaaauucaacugguacguagauggaguugaggugcacaaugcaaagacuaaaccuagggaggaacaguacaacaguacauaucgggucguguccguccucaccgugcugcaucaggacuggcuuaaugguaaggaguacaaaugcaagguuagcaacaaagcccugcccgcuccaaucgaaaagacuauuucuaaggccaaaggccaaccucgcgagccccagguguauacauugccacccucaagagaagagaugaccaagaaucagguaagucucacgugucuggucaaaggguuuuacccuagcgauaucgcaguggagugggaauccaacggacagccagagaauaacuauaagaccacaccgcccguuuuagacucugacggcucguucuuccuguacagcaaacucacuguggauaaguccagguggcaacaggguaacgucuuuucaugcagugugaugcacgaagcccuucacaaucauuauacccagaagucucugagcuuguccccugggaaa

SEQ ID NO: 23121 - RNA, 642 nt, Artificial Sequence
  derived and/or modified sequence opt3 from Daratumumab_LightChain1
gagaucgugcugacccagagccccgccacacucucccuuucuccuggcgaaagagcuacucugucaugcagggcaagucaaagcgucuccucuuacuuggccugguaucagcagaagccagggcaggcgccgcgguuacugauuuacgacgcuucgaaccgcgccacgggaauacccgcacgauucucagguagcggcagugggaccgauuuuacacuaacuaucuccucucucgagccugaagacuucgccguuuauuacugucaacagcguagcaauuggccacccaccuuuggacagggcacaaaaguggagauuaagagaaccguagcugcaccuuccguguucaucuuuccacccucagaugaacagcugaaaagugguacugccagcgucgugugccuucugaacaauuucuauccuagggaggcuaagguucaauggaaaguggacaacgccuugcagucuggaaauucccaggagucagucacagaacaggauagcaaggacaguaccuacucucucuccagcacgcugacucugucgaaggcggauuaugagaaacacaagguguacgcaugugaaguaacccaucaagggcucucuuccccaguuacaaaaucauuuaaccggggcgagugc

SEQ ID NO: 23122 - RNA, 1350 nt, Artificial Sequence
  derived and/or modified sequence opt3 from Dectrekumab_HeavyChain1
gaggugcagcuggucgaaagcggcgggggaguugugcaacccgguagaucccucaggcuuucuugcgccgcuucaggcuucaccuuuaguagcuacgggaugcacuggguacggcaggcaccuggaaagggccuggaguggguggccaucauuugguaugacgguuccaacaaauacuaugcggauucugucaaggggcgcuucacaauaucgcgagacaauucaaagaacacuuuguacuuacagaugaauagccugcgugcugaagauacggccguguauuacugugcaagacuaugguuuggagaccucgaugccuucgacaucuggggccagggcaccaugguuacagugaguuccgcuucuacuaaagggccaagcgucuuuccgcuggcacccuccucaaaaaguaccagcggagguacagccgcucuuggcugccuggugaaggauuauuucccugagccaguaaccguuucuuggaacuccggggccuugacuucaggagugcauacauuucccgcgguccuccaaagcaguggccuguacucucuguccagcguggugaccgucccuucgucuucccucgguacgcagacuuacauuuguaauguuaaccacaagccaucaaauaccaaaguggacaagaggguagaacccaaaaguugcgauaagacacauacuuguccuccaugcccggcacccgaguuacuugggggaccuagcguguuccuguuuccacccaaaccuaaggacaccuugaugaucucccggacaccagaggucaccugugugguuguggaugucucucacgaagaccccgaggugaaguucaacugguauguagauggcguugaagugcauaaugccaaaacgaagccgcgcgaggagcaguacaacagcacuuauagagucgugucaguccugacagugcuacaccaggacuggcucaauggcaaagaauacaagugcaaaguuaguaacaaggcucugccugcccccauugagaaaaccaucuccaaggcaaaggggcaaccaagggaaccucagguguauacucuucccccaagccgggaggaaaugaccaaaaaucagguaucucugacauguuuggucaagggauuuuaccccucagacauagcuguggagugggagaguaacggucagccugaaaauaacuauaaaacgaccccaccgguucucgauagcgacggcuccuucuuucuguacucuaaguuaacaguggauaaaucgcgcuggcaacaggggaacgucuucagcugcuccgugaugcacgaggcccugcauaaucacuacacucagaagucacucagucuuucucccggaaag

SEQ ID NO: 23123 - RNA, 648 nt, Artificial Sequence
  derived and/or modified sequence opt3 from Dectrekumab_LightChain1
gagaucgugcugacccagagccccgccacacucucccuuucuccuggcgaaagagcuauucugucaugcagggcagggcaaagugucagcuccuacuugguuugguaucagcagaagccaggacaggccccgcgguuacugauauacgacgcgucuaaccgcgcuacugguauccccgcccgauucucgggcucagggagcggaacggauuuuacccuaacaauuaguucccucgagccugaagacuucgcaguguauuacugucaacagcguucuagcuggccacccguauauacuuuuggccaggguaccaaacuggagaucaagagaacaguggccgcuccuuccgucuucauuuuuccacccucagaugaacagcuuaaaagugggaccgcaagcgugguuugccuguugaauaacuucuacccuagggaggccaaggugcaauggaaagucgacaaugcucuccagucuggaaacucccaggagucagugacugaacaggauagcaaggacaguacauauucucuguccagcacccugacgcucucgaaggccgauuacgagaaacacaagguauacgcgugugaaguuacucaucaaggcuuaucuuccccagugaccaaaucauuuaaucggggcgagugc

SEQ ID NO: 23124 - RNA, 1332 nt, Artificial Sequence
  derived and/or modified sequence opt3 from Demcizumab_HeavyChain1
caggugcagcugguccagagcggcgccgagguuaagaaacccggggcuuccgugaagaucucuugcaaagcaucaggauacaguuucaccgccuauuacauucacuggguaaagcaggcgccuggucagggccucgaauggauaggguauaucagcuccuacaacggagcuacaaauuauaaccaaaaauuuaagggcagagugacuuucacgaccgacacaucuacuucgaccgccuacauggagcuuaggucacugcggagcgaugacacagcagucuauuacugugcccgcgauuacgacuaugauguggguauggacuacugggggcagggaaccuugguuacugugaguuccgcuucuacaaagggcccaagcgucuuuccguuagcacccugcucccgaucaaccagugaaagcacggccgcucugggcugucuagugaaagauuauuucccugagccaguaacuguuucuuggaauaguggggcccucaccucaggagugcauacauuucccgcgguccugcagagcaguggucuuuacucucuguccagcguggugacugucccuucgucuaacuucggcacccagacauauaccugcaauguugaccacaagccauccaacacgaaaguggauaagacuguagaacguaaauguugcguggagugucccccuugcccagcaccgcccgucgccgggccuucaguguuuuuguucccacccaagccuaaggacacacucaugauuaguagaaccccagagguuacuuguguggucguggauguaagccaugaagaccccgagguucaauuuaauugguacguggauggagucgaagugcacaacgcuaaaacaaagccgagggaggagcaguucaauuccaccuuucgggucgugucuguucugacggugguacaucaggacuggcugaacggcaaagaauauaagugcaaagucagcaauaagggucucccugcccccaucgagaaaaccauuucaaagacaaaggggcagccacgcgaaccucaaguguacacuuuacccccaaguagagaggaaaugaccaaaaaccagguuucccugacaugucuugugaagggauucuaccccagcgacaucgcagucgagugggagucuaauggccagccugaaaacaauuauaaaacuaccccaccgauguuggauucagacggcuccuuuuuccuguacagcaagcuaacaguggauaaauccagguggcaacaggggaacguauucucuugcucggugaugcacgaggcucuccacaaccauuauacccaaaagagccugucccuuucacccgga

SEQ ID NO: 23125 - RNA, 654 nt, Artificial Sequence
  derived and/or modified sequence opt3 from Demcizumab_LightChain1
gacaucgugaugacccagagccccgauucccuggccgucucucucggcgagagagcuacaauuucaugcagggcaagugaaagcguugacaacuacgggauauccuucaugaagugguuucaacagaaaccuggacagccaccgaaacuucugaucuaugccgcgucuaaucaggguucgggcgugcccgaucgguucucagggagcggaaguggcacugacuuuacguugaccauuuccucuuuacaagcugaggauguagccguguacuauugucagcagagcaaggaagucccuuggacauucggugggggaacuaagguggagaucaaacgcaccguugcagccccauccguguuuauuuuucccccuucagacgaacagcugaagaguggcacagcuagcgucgugugccuacucaacaauuucuacccacgagaggcaaagguacaauggaaaguugauaacgcccugcagucuggcaauucccaggagucagugaccgaacaggacagcaaggauaguacuuauucucuuuccagcacacugaccuugucgaaagcugacuacgagaagcacaaagucuaugccugugaagugacgcaucaagggcucucuucccccgugacuaagucauucaaccguggagagugc

SEQ ID NO: 23126 - RNA, 1350 nt, Artificial Sequence
  derived and/or modified sequence opt3 from Denintuzumab_mafodotin_HeavyChain1
caggugcagcugcaggagagcggccccgggcucgucaagccuucccagacccuuucucugacaugcacuguuucaggagguaguaucagcacguccggcaugggggugggauggauuagacagcacccaggcaaagguuuggaauggauagggcauaucuggugggacgaugacaagagguacaacccggcuuuaaaaucucggguaaccauuucgguggauacaucaaagaaucaauucagccugaaacuaaguuccgucacugcugcagacaccgccguguauuacugugcgcgcauggagcucuggucuuauuacuuugauuauuggggacagggcacacugguuaccgugagcuccgcuucaacuaagggccccagugucuucccucuugccccaagcucuaaguccacaucagggggaaccgcagcccuggguugcuuggugaaagacuacuuucccgaaccuguaacgguuagcuggaacaguggcgcucucacuucuggggugcacaccuucccagcaguccugcaguccagcggacuguauucgcucucuuccguggugacaguccccucaaguagcuuaggcacucagaccuacaucuguaauguuaaccauaagccuuccaauacaaaaguggauaagaaaguagagccaaagucuugcgacaagacccacacguguccgcccugcccugccccagaacugcuuggugggcccagcguguuuuuguucccuccaaaacccaaggauacucugaugauuucacgaacaccggaggucaccugugugguuguggacgucagucaugaggauccugaagugaaauuuaacugguacguagacggaguugaggugcacaaugcuaagacuaaaccccgugaagaacaauauaacuccacauacagagucgugagcguccuaaccgugcuccaccaggauuggcugaauggcaaggaguauaaaugcaagguuucuaacaaggcccuuccagcgccuaucgagaaaacgauaucaaaggcaaaaggccagcccagggagccacagguguacacccugcccccuagucgggacgaauugacaaagaaucaaguaagccucacuugucuggucaaaggguucuauccauccgacaucgccguggagugggaaucuaacggacagccggagaauaacuacaagaccacacccccuguuuuagauucggacgguagcuuuuuccuguauuccaagcucacuguggauaaaucacgcuggcagcaaggcaaugucuuuaguugcucugugaugcaugaggcccuucacaaccauuacacccaaaagagccuguccuugucaccagggaaa

SEQ ID NO: 23127 - RNA, 639 nt, Artificial Sequence
  derived and/or modified sequence opt3 from Denintuzumab_mafodotin_LightChain1
gagaucgugcugacccagagccccgccacacucucccuuucuccuggcgaaagagcuacucugucaugcagugcaagcuccucugucucguacaugcacugguaucaacagaagccagggcaggccccgagguuguuaauuuacgacacgucaaaacuggcgagcggaauacccgcucgguucagugguuccggcucugggaccgauuuuacacuaacuaucagcucccucgagccugaagacguugccguguauuacuguuuccagggaucaguauauccauuuaccuucggccaagguacaaagcuggagauuaaacgcaccguggcagcccccagugucuuuaucuucccuccaagcgaugaacagcuuaagucugggacugcuuccgugguuugccuguugaacaauuuuuacccccgagaggcaaaagugcaguggaaggucgacaacgcccuccagucaggaaauagccaagagagugugacagaacaggauucuaaggacuccaccuauagccugucgucuacgcugacucucuccaaagcugauuacgagaagcauaaaguauacgccugugaaguuacccaccagggcuuaucaaguccugugacaaagagcuucaaccguggcgagugc

SEQ ID NO: 23128 - RNA, 1356 nt, Artificial Sequence
  derived and/or modified sequence opt3 from Denosumab_HeavyChain
gaggugcagcugcucgaaagcggcgggggacuuguccaacccgguggcucccugagauugucuugcgcugcuucaggguucaccuuuaguagcuacgcaauguccuggguuaggcaggccccuggaaagggcuuagagugggugucugguaucacagggucgggaggcucaacuuauuacgcggacagcguaaaaggccgguucacgauuagucgcgauaacuccaagaauacccuguaucuacagaugaacucucuccgagcugaagacacagccguguacuauugugcaaaagauccagggacuaccgucauaaugagcugguuugacccguggggacaggguacacuggugaccguuuccucagccaguacuaagggccccagcguguucccucuugcuccaucuuccaaaucaacaagcgggggaaccgcagcccugggcugcuuggucaaggauuacuuucccgagccugugacgguaaguuggaacucuggugcucucacuuccgggguucacaccuucccagccgugcugcaaagcucgggacuguauucucucuccucagucgugacagugcccaguagcuccuuaggcacucagaccuacaucuguaaugucaaucauaagccuucuaacacaaaaguugacaagaaaguggaaccaaagagcugcgauaaaacccacacguguccgcccugcccugcgccagagcugcuuggcgggcccucaguauuuuuguucccuccaaagcccaaggacacucugaugauuagucguacaccggaggugaccugugucgugguugaugugucccaugaagacccugaggucaaauuuaauugguacguggauggaguagaaguucacaacgcaaagacuaaacccagagaggagcaguauaauagcacauacaggguggucucugugcuaaccguccuccaucaggacuggcugaacgguaaggaauauaaaugcaaggugucaaauaaagcccuuccagcuccuaucgagaagacgauuaguaaggccaaaggccaaccccgggaaccacagguuuacacccugcccccuagccgcgaugaguugacaaagaaccaggugucccucacuugucugguaaaaggguucuauccaucugacaucgcagucgaaugggagucgaauggacagccggagaacaauuacaagaccacacccccuguguuagacagcgauggcuccuuuuuccuguauucaaaacucacuguugacaagaguagauggcaacaggguaacguguuuucuugcagcgucaugcacgaagcccuucacaaccauuacacccagaagucccugucauugagcccagggaaa

SEQ ID NO: 23129 - RNA, 645 nt, Artificial Sequence
  derived and/or modified sequence opt3 from Denosumab_LightChain
gagaucgugcugacccagagccccggcacacucucccuuucuccuggggaaagagccacucugucaugcagggcuagucaaagcguccggggacgcuacuuggcaugguaucagcagaagccaggucaggccccgcgauuacugauuuacggcgcguccucucgugcuacggggauacccgacagauucucgggaucaggcagcgguaccgauuuuacacuaacuaucaguaggcucgagccugaagacuucgccguguuuuauugucaacaguacggguccucuccacggaccuucggacagggcacaaaaguugagauuaagcgcaccguagcagcccccagcguguuuaucuucccuccauccgaugaacagcugaaaucaggcacugcuagugucgugugccuucugaacaauuuuuaucccagagaggcaaagguucaauggaaaguggacaacgccuugcagagcggaaauucucaggaguccgucacagaacaggauucaaaggacagcaccuacagucucucuuccacgcugacucugagcaaggcugauuaugagaaacacaagguguacgccugugaaguaacccaucaagggcucucgucuccuguuacaaaauccuucaacaggggugagugc

SEQ ID NO: 23130 - RNA, 1338 nt, Artificial Sequence
  derived and/or modified sequence opt3 from Depatuxizumab_HeavyChain1
caggugcaacugcaggagagcggccccgggcucgucaagccuucccagacccuuucucugacaugcacuguuucaggauacaguaucagcuccgacuucgccuggaacuggauuagacagccaccggguaaaggcuuggaauggaugggguauauaucuuacucgggaaauacgagguaucaacccucauuaaagagccggaucaccauuagucgcgauacauccaaaaaccaguuuuuccugaagcuaaauucugugacugcugcagacaccgccacauacuauuguguaaccgcgggccgagguuuuccuuacugggggcagggaacucucgugacagucagcuccgcuucaaccaaaggcccaaguguguucccccuggccccuagcucuaaguccacgucaggcgggacugcagcccuuggaugccugguuaaggauuauuuuccagagcccgugaccgucagcuggaacaguggugcuuugacaucuggcgugcacacuuucccugcaguacuccaguccagcgggcuguacucgcugucuuccguugugaccgucccaucaaguagccucggaacacaaaccuacaucuguaaugugaaccauaaaccguccaauacgaagguggacaaaaaggucgaacccaaaucuugcgauaagacucacacauguccuccaugccccgccccugaguuacugggcgguccaagcguuuuucuuuuucccccgaagccuaaagacaccuugaugauuucacguacucccgaagugacauguguaguggucgaugugagucaugaggacccagagguuaaguucaacugguauguggauggggucgaagugcacaaugcuaaaaccaagccuagagaggaacaguacaacuccacguauaggguaguuagcgugcugaccguccuacaucaggacuggcucaauggaaaagaguacaagugcaaagugucuaacaaggcccugcccgcgccaaucgagaagacaauaucaaaagcaaagggccagccccgggaaccucaagucuauacucuuccaccgagucgcgaugagcugaccaaaaaucaggugagcuugacaugucucguuaagggcuucuaccccuccgacaucgccguggaaugggagucuaacgggcagccugaaaauaacuauaaaacuaccccacccguacuggauucggacgguagcuuuuucuuauacuccaagcugacagucgacaagucaagauggcaacagggaaacguguuuaguugcucuguuaugcacgaggcucuccacaaucauuacacccagaaaagccuuucccugucaccuggcaag

SEQ ID NO: 23131 - RNA, 642 nt, Artificial Sequence
  derived and/or modified sequence opt3 from Depatuxizumab_LightChain1
gacauccagaugacccaaagccccuccucuaugucagugagugucggcgauagaguuacaauuacuugccacagcucccaggacauaaacucuaauaucggguggcugcagcagaagccuggaaaaucguucaagggucucauuuaccauggcacgaaccuugaugacggggugccaucaagguuuagcggaaguggcuccgguaccgauuauacacugacuaucucuagcuugcaaccggaggacuucgccaccuacuauuguguacaguacgcucaguuucccuggacauucgggggaggcaccaaauuagaaauuaagcggacuguggcagccccuuccgucuuuaucuucccacccucagaugagcagcugaaaaguggcacagcgagcgugguuugccuacucaauaacuuuuauccucgcgaagcuaaggugcaauggaaggucgacaaugcccugcagucugggaacucccaggagucagugaccgaacaggauagcaaagacaguacguacucucuuuccagcacucugaccuugucgaaggcagauuaugagaaacacaagguauacgccugugagguuacacaucaaggacucucuuccccagugacuaaaucauucaaucgaggugaaugc

SEQ ID NO: 23132 - RNA, 1338 nt, Artificial Sequence; identical to SEQ ID NO: 23130
  derived and/or modified sequence opt3 from Depatuxizumab_mafodotin_HeavyChain1

SEQ ID NO: 23133 - RNA, 642 nt, Artificial Sequence; identical to SEQ ID NO: 23131
  derived and/or modified sequence opt3 from Depatuxizumab_mafodotin_LightChain1

SEQ ID NO: 23134 - RNA, 1329 nt, Artificial Sequence
  derived and/or modified sequence opt3 from Dinutuximab_beta_HeavyChain1
gaggugcagcugcuccaaagcggccccgaacuugagaagccuggggccuccgucaugaucucuugcaaggcuucaggaaguagcuucaccgguuacaacaugaauuggguuagacagaacauuggcaaaucccuggaauggauaggggcaaucgacccauauuacggaggcacaucuuauaaucagaaauuuaaggguagggccacuuugacgguggauaaaucgucaagcaccgcguacaugcacuuaaagagucugacauccgaggacucugcuguauauuacugugugagcgggauggaauauuggggacagggcacuuccgucaccgugucaagugccagcacaaagggcccgucuguuuucccccuagcaccuuccucaaaaagcaccagugggggaacugccgcucucgguugccuggugaaggauuacuuuccagagcccgucacagugucuuggaacuccggcgcacuuaccagcgggguacauacguucccugccguucugcaaucgucuggauuguacucccucucaaguguggucacugugccaagcuccucucugggcacccagacauauauuuguaaugugaaccacaaacccagcaauacuaaggucgacaaacggguugagccuaagucaugcgauaagacccauacauguccaccgugccccgcuccugaacugcucggugggccaaguguguuuuuauuucccccuaaaccaaaggacacccugaugaucucccgcacgcccgagguaacuuguguggucguggauguuagccacgaagacccggaggugaaauucaacugguacgucgauggaguggagguacauaaugccaagacaaaaccucgagaggaacaguauaacucuaccuaccguguugugucaguccuuacuguguugcaccaggacuggcugaauggcaaggaauauaaaugcaaggucaguaacaaggcgcuacccgcaccaauugagaaaacaaucagcaaggccaaaggccaaccuagagaaccccagguguacacccucccacccuccagggaggagaugacgaagaaucagguuucucugaccugucuugugaaaggguucuauccuucggauauagcuguagaaugggagagcaacggacagccagaaaauaacuacaagacaacuccgcccguccuggacuccgaugguucauuuuucuuguacaguaagcucaccguggacaaaucucgguggcaacagggcaacguuuuuagcugcuccgugaugcacgaggcccugcauaaucacuauacacagaagucauuaagccugucuccugggaaa

SEQ ID NO: 23135 - RNA, 660 nt, Artificial Sequence
  derived and/or modified sequence opt3 from Dinutuximab_beta_LightChain1
gagaucgugaugacccagagccccgccacacuguccgucucuccuggcgaacgggcuacucucucaugcaggaguagccaaucccuuguucaccggaacgggaauacguaccugcauugguauuugcagaagccaggacagucuccgaaauuacugauucacaaggugucgaaccgcuucucagguguacccgaccgauuuagcggcaguggguccggaaccgauuucacacuaaaaauaucucguguggaggcagaagaccucggcgucuacuuuuguagccaguccacucaugugccuccacugaccuucggugccgggacaaaguuggagcugaaaagaaccguugcggcucccucaguguuuaucuucccuccaagugaugaacaacuuaagagcggaacugccucugucgugugccuccugaauaacuuuuaucccagggaggcaaagguacaguggaaaguugacaaugcccugcaguccggcaacucacaggagagcgugacagaacaagauaguaaggacucuaccuacucccucagcucgacguuaacucugucuaaagcugauuaugagaagcacaaagucuacgcaugugaagugacccaucagggccuuuccucaccugugacaaagaguuucaauagaggggagugc

SEQ ID NO: 23136 - RNA, 1329 nt, Artificial Sequence; identical to SEQ ID NO: 23134
  derived and/or modified sequence opt3 from Dinutuximab_HeavyChain1

SEQ ID NO: 23137 - RNA, 660 nt, Artificial Sequence; identical to SEQ ID NO: 23135
  derived and/or modified sequence opt3 from Dinutuximab_LightChain1

SEQ ID NO: 23138 - RNA, 660 nt, Artificial Sequence; identical to SEQ ID NO: 23135
  derived and/or modified sequence opt3 from Dinutuximab_LightChain

SEQ ID NO: 23139 - RNA, 1350 nt, Artificial Sequence
  derived and/or modified sequence opt3 from Diridavumab_HeavyChain1
gaggugcagcuggucgaaagcggcgccgagguuaagaaacccggguccucugugaagguaucaugcaaagcuaguggagguccuuucagaagcuacgcaaucuccugggugaggcaagccccaggccaggggccggaauggaugggaggcauuauacccaucuuugguaccacaaaguaugcgccuaaauuccaggggcgggucacuauuacggcugacgauuuugccggaaccguguacauggagcucucuucgcuucgcucagaagacacagcaauguauuacugugccaagcacaugggcuaucagguucgagagacuauggauguguggggcaaggggaccacagucaccgugagcagugcuuccacuaaaggaccaucuguauucccccuggcaccuagcuccaagucaacaagugguggcaccgccgcuuuggggugcuuaguuaaagacuacuuuccagagcccgugacggucagcuggaacucuggagcccugacuuccggcgugcauaccuucccugcggugcuacaaucaagcggucucuauagucugucuuccgucguuacagugccaagcucgucucuugggacucagaccuacaucuguaauguaaaccacaagccguccaauacaaaaguggauaagcgugucgaacccaagucaugcgacaaaacccauacguguccuccaugccccgcaccugagcuguugggaggcccaaguguguuucucuuucccccgaagccuaaagauacucugaugauuagcagaacacccgaaguuaccuguguggucguggacguaucccacgaggauccagagguuaaguucaacugguacguggacggcgucgaagugcauaaugccaaaacuaagccuagggaggaacaguauaacucuacauaccgggucgugagcguucugaccgugcuccaccaggauugguuaaaugggaaagaguauaagugcaagguaucaaacaaagcucugcccgccccaaucgaaaagacgauaaguaaagcaaagggacaaccccgcgagccucaggucuacacccuuccaccguccagagaggaaaugacuaaaaaucaggugagcuugacaugucugguuaaggguuucuaucccucugacaucgcuguggagugggaaucaaacggccagccugagaauaacuacaagaccacaccacccguccuagauagugacgggagcuuuuuccucuauuccaaacugacuguggacaagucuagguggcaacagggaaauguauuuucgugcagcgugaugcacgaagcccuucauaaccacuacacccagaaaucccugucauugaguccuggc

SEQ ID NO: 23140 - RNA, 651 nt, Artificial Sequence
  derived and/or modified sequence opt3 from Diridavumab_LightChain1
cagagcgugcugacccaacccccuuccgucucugccgcuccaggccagaagguuacaaucucaugcagugggagcuccucuaacauuggaaaugacuacgugucgugguaucagcagcucccggguacugcacccaaacuucugauauacgauaacaauaagagaccuucaggcaucccagacagguucagcgggaguaaauccggaacgucugccaccuugggcauuacagguuuacaaacuggggaugaggcgaacuauuacugugcuaccugggaccggcgccccacagccuauguaguguuuggaggcggcaccaagcugacuguccuagggcagccuaaagcagccccaagcgugacacucuuucccccuuccucagaggaacugcaggcuaauaaggcaacccuuguuugccugaucagugauuucuacccaggagccgugacggucgcuuggaaggccgacagcucuccggugaaagcggguguagaaacuaccacacccuccaagcagucaaacaauaaauaugcagccagcaguuacuugucucucacuccugagcaauggaagucccaccgaagcuacucgugucagguuacccaugaaggcucuacaguggagaaaaccgucgcuccaacggagugcucc

SEQ ID NO: 23141 - RNA, 1338 nt, Artificial Sequence
  derived and/or modified sequence opt3 from Domagrozumab_HeavyChain1
gaggugcagcugcucgaaagcggcgggggacuuguccaacccgguggcucccugagauugucuugcgccgcuucaggguucaccuuuaguagcuacgcaauguccuggguuaggcaggccccuggaaagggcuuagagugggugucuacaaucucgucaggugggagcuauacgaguuacccagacuccguaaaaggacgguucacuauuucucgcgauaacagcaagaauacccuguaucuacagaugaacucccuccgagcggaagacacagcuguguacuauugugccaaacaggauuacgcaaugaauuauuggggccaaggcacucuggucaccgugucaagugccagcacaaaggggccgucuguuuuuccccuugcuccuuccucaaaaagcaccaguggagguacugcagcccugggcugcuuggugaaggacuacuucccagagcccgucacagugucuuggaacuccggggcucucaccagcggaguacacacguuuccugccguucugcagucgucuggccuguacucccucucaaguguggucacugugccaagcuccucuuuagguacccagacauauauauguaaugugaaccauaagcccagcaauacuaaagucgauaagaaaguugaaccuaagucaugcgacaaaacccacacauguccaccgugccccgcgccugaggcagccggggcuccaaguguguuccuguuucccccuaagccaaaggauacccuuaugaucucccguacgcccgagguaacuuguguggucguggacguuagccaugaagauccggaggugaaauucaacugguacgucgacggaguggaaguacacaaugccaagacaaaaccuagagaggagcaguauaacucuaccuacaggguugugucagucuugacugugcugcaucaagauuggcuaaauggcaaggaauauaaaugcaaggucaguaacaaagcacuccccgcuccaauugagaagacaaucagcaaggccaaaggccagccucgggaaccccagguguacacccugccacccucccgcgaggaaaugacgaagaaucagguuucucuuaccugucuggugaaaggguuuuauccuucggacauugcgguagagugggagagcaacggacaaccagaaaauaacuacaagacaacuccgcccgucuuggauuccgacgguucauucuuucucuacaguaaacugaccguggacaagucuagauggcagcagggcaacguuuucagcugcuccgugaugcacgaggccuuacacaaucauuauacacaaaagucacugagccucucuccugggaaa

SEQ ID NO: 23142 - RNA, 1335 nt, Artificial Sequence
  derived and/or modified sequence opt3 from Domagrozumab_HeavyChain
gaggugcagcugcucgaaagcggcgggggacuuguccaacccgguggcucccugagauugucuugcgccgcuucaggguucaccuuuaguagcuacgcaauguccuggguuaggcaggccccuggaaagggcuuagagugggugucuacaaucucgucaggugggagcuauacgaguuacccagacuccguaaaaggacgguucacuauuucucgcgauaacagcaagaauacccuguaucuacagaugaacucccuccgagcggaagacacagcuguguacuauugugccaaacaggauuacgcaaugaauuauuggggccaaggcacucuggucaccgugucaagugccagcacaaaggggccgucuguuuuuccccuugcuccuuccucaaaaagcaccaguggagguacugcagcccugggcugcuuggugaaggacuacuucccagagcccgucacagugucuuggaacuccggggcucucaccagcggaguacacacguuuccugccguucugcagucgucuggccuguacucccucucaaguguggucacugugccaagcuccucuuuagguacccagacauauauauguaaugugaaccauaagcccagcaauacuaaagucgauaagaaaguugaaccuaagucaugcgacaaaacccacacauguccaccgugccccgcgccugaggcagccggggcuccaaguguguuccuguuucccccuaagccaaaggauacccuuaugaucucccguacgcccgagguaacuuguguggucguggacguuagccaugaagauccggaggugaaauucaacugguacgucgacggaguggaaguacacaaugccaagacaaaaccuagagaggagcaguauaacucuaccuacaggguugugucagucuugacugugcugcaucaagauuggcuaaauggcaaggaauauaaaugcaaggucaguaacaaagcacuccccgcuccaauugagaagacaaucagcaaggccaaaggccagccucgggaaccccagguguacacccugccacccucccgcgaggaaaugacgaagaaucagguuucucuuaccugucuggugaaaggguuuuauccuucggacauugcgguagagugggagagcaacggacaaccagaaaauaacuacaagacaacuccgcccgucuuggauuccgacgguucauucuuucucuacaguaaacugaccguggacaagucuagauggcagcagggcaacguuuucagcugcuccgugaugcacgaggccuuacacaaucauuauacacaaaagucacugagccucucuccuggg

SEQ ID NO: 23143 - RNA, 642 nt, Artificial Sequence
  derived and/or modified sequence opt3 from Domagrozumab_LightChain1
gacauccagaugacccaaagccccuccucucugucagccagugugggcgauagagucacaauuacuugcaaggcuagccaggacguuuccacggcaguggccugguaccagcagaaaccugggaaggcgccaaaacuccuuauauauucugcuucguacagguauaccggaguaccgucacgguucagcgguaguggcuccgggacagauuuuacucugaccaucucuagcuugcaacccgaggacuucgccacauacuauugucagcagcacuacuccaccccuuggacuuuuggaggcgguacaaagguggaaauuaaacgcaccgucgcagccccaucaguguucaucuuucccccuagugaugagcaguuaaagagcgggacggcuucuguugugugccugcuaaacaauuucuauccacgagaagcaaagguccaauggaaaguggacaacgcccuccaguccggaaauucacaggagagcguaacugaacaggauaguaaggacucuaccuacucccugagcucgacacuuacucugucuaaagcugauuacgagaagcauaaaguuuaugccugugaggugacccaccaaggcuuguccucacccgucacaaagaguuuuaaccguggcgaaugc

SEQ ID NO: 23144 - RNA, 1335 nt, Artificial Sequence
  derived and/or modified sequence opt3 from Drozituab_HeavyChain1
gaggugcagcugguccaaagcggcgggggaguugaaagacccgguggcucccucaggcuuucuugcgccgcuucaggguucaccuuugacgauuacgcaaguugggugcggcaggccccuggaaagggccuggaguggguaagcgguaucaacuggcaagggggauccacaggcuaugcggacucugugaaaggccgcgucacuauuucgcgagauaaugcuaagaacucauuguacuuacagaauagccugcgugccgaagacacggcaguguauuacugugccaaaauacuaggggcuggaagagguugguauuucgauuacuggggcaaggggaccacaguuacugugaguuccgcaucuaccaaaggaccaagcgucuuuccgcucgcccccuccucaaagaguacaagcggcgguaccgcugcccuggggugccuugugaaggacuauuucccugagccaguaacuguuucuuggaacuccggagcgcugacaucaggcgugcacaccuuucccgcagucuugcagagcaguggccucuacucucuguccagcguggugacggucccuucgucuucccuggggacucagaccuacaucuguaauguuaaccauaaaccaucaaauacaaagguggauaaaaagguagaacccaaaaguugcgacaagacucacaccuguccuccaugcccggcccccgagcucuuaggagguccuagcguguuccuguuuccacccaagccuaaagauacacuuauuuccaggaccccagaggucacgugugugguuguggacgucucucaugaagaucccgaggugaaguucaacugguauguagacggcguugaagugcacaaugcuaaaacuaagccgcgggaggagcaguacaacagcacauaucgcgucgugucagucuugaccgugcugcaucaggauuggcuaaaugggaaagaauacaagugcaaaguuaguaacaaggcccucccugcacccaucgagaagacuauuuccaaagcuaagggacaaccaagagaaccucagguguauacacugcccccaagcagggaggaaaccaaaaaucagguaucucuuacgugucuggucaagggcuuuuaccccucagacaucgccguggagugggagaguaacggucagccugaaaauaacuauaaaaccacaccaccgguuuuggacagcgauggguccuucuuucucuacucuaagcugacuguggacaagucgcgguggcaacagggcaacgucuucagcugcuccgugcacgaggcguuacacaaucauuacacccagaaaucacugagucucucucccgga

SEQ ID NO: 23145 - RNA, 639 nt, Artificial Sequence
  derived and/or modified sequence opt3 from Drozituab_LightChain1
agcgagcugacccaggaccccgccguguccgucgcucucggccaaacaguuagaaucacuugcucuggggauucacuuaggaguuacuaugcaagcugguaccagcagaagccuggacaggccccagugcugguaauuuauggugcgaacaaucggccguccggcauacccgaccgcuucucugggucgucaagcggaaacacggcuaguuugaccaucacaggcgcccaagcagaagaugaggccgacuacuauuguaauuccgcugauucuagcgguaaccacguggucuuugggggaggcacuaaauuaaccgugcugggccagccuaaggcagccccauccguuacacuauuucccccuucaagugaagaacuccaggcuaauaaagccacccuggugugccuuauuagcgacuucuacccaggggcggucacuguggcauggaaggccgauucuucccccguaaaagcuggaguugaaacaaccacgccuucaaagcagagcaacaauaaguaugccgcaaguucuuaccuguccuugacuccagagcaauggaaaagccauaagucguacucuugucaggugacccacgaggguuccacagucgagaaaacuguggcuccgaccgagugcuca

SEQ ID NO: 23146 - RNA, 1353 nt, Artificial Sequence
  derived and/or modified sequence opt3 from Drozitumab_HeavyChain1
gaggugcagcugguccaaagcggcgggggaguugaaagacccgguggcucccucaggcuuucuugcgccgcuucaggguucaccuuugacgauuacgcaaugaguugggugcggcaggccccuggaaagggccuggaguggguaagcgguaucaacuggcaagggggauccacaggcuaugcggacucugugaaaggccgcgucacuauuucgcgagauaaugcuaagaacucauuguacuuacagaugaauagccugcgugccgaagacacggcaguguauuacugugccaaaauacuaggggcuggaagagguugguauuucgauuacuggggcaaggggaccacaguuacugugaguuccgcaucuaccaaaggaccaagcgucuuuccgcucgcccccuccucaaagaguacaagcggcgguaccgcugcccuggggugccuugugaaggacuauuucccugagccaguaacuguuucuuggaacuccggagcgcugacaucaggcgugcacaccuuucccgcagucuugcagagcaguggccucuacucucuguccagcguggugacggucccuucgucuucccuggggacucagaccuacaucuguaauguuaaccauaaaccaucaaauacaaagguggauaaaaagguagaacccaaaaguugcgacaagacucacaccuguccuccaugcccggcccccgagcucuuaggagguccuagcguguuccuguuuccacccaagccuaaagauacacuuaugauuuccaggaccccagaggucacgugugugguuguggacgucucucaugaagaucccgaggugaaguucaacugguauguagacggcguugaagugcacaaugcuaaaacuaagccgcgggaggagcaguacaacagcacauaucgcgucgugucagucuugaccgugcugcaucaggauuggcuaaaugggaaagaauacaagugcaaaguuaguaacaaggcccucccugcacccaucgagaagacuauuuccaaagcuaagggacaaccaagagaaccucagguguauacacugcccccaagcagggaggaaaugaccaaaaaucagguaucucuuacgugucuggucaagggcuuuuaccccucagacaucgccguggagugggagaguaacggucagccugaaaauaacuauaaaaccacaccaccgguuuuggacagcgauggguccuucuuucucuacucuaagcugacuguggacaagucgcgguggcaacagggcaacgucuucagcugcuccgugaugcacgaggcguuacacaaucauuacacccagaaaucacugagucucucucccggaaag

SEQ ID NO: 23147 - RNA, 639 nt, Artificial Sequence; identical to SEQ ID NO: 23145
  derived and/or modified sequence opt3 from Drozitumab_LightChain1

SEQ ID NO: 23148 - RNA, 1353 nt, Artificial Sequence
  derived and/or modified sequence opt3 from Duligotumab_HeavyChain1
gaggugcagcuggucgaaagcggcgggggacucguucaacccgguggcucccuuagacugucuugcgccgcuucaggguucaccuugaguggagacuggauccacugggugaggcaggcaccuggcaaggguuuagaguggguaggggaaauuagcgccgcgggaggcuacacagauuaugcugacuccgugaaaggccgguuuacuauaucugccgauacgucgaagaacaccgcauaccugcagaugaauagccuacgcgccgaggacacagcugucuauuacugugcacgagaaagccgugugaguuucgaggccgcuauggauuauugggggcagggaacucucguuaccguguccucugccagcacaaaagguccauccgucuuuccgcuggcgcccucaaguaagagcaccucuggcgggacugcagcccuuggaugccuggugaaagacuacuucccugagccaguaacaguuuccuggaacucaggcgcuuugaccagcggugugcauacguuucccgccguccuccaaaguucugggcuguauucccugagcucgguggugacugucccuucuuccucacucggaacccagacauacaucuguaauguuaaccacaagccaaguaauacuaagguggauaaaaagguagaacccaaaagcugcgacaagacccauacauguccuccaugcccggcacccgaguuacugggcggcccuuccguguuccuuuuuccacccaaaccuaaggauaccuugaugauuucuagaacgccagaagucacuugugugguuguggacgucagccacgaggaucccgaggugaaguucaacugguacguagacgggguugaagugcauaaugcuaaaacaaagccgagggaggaacaguauaacucaaccuaccgggucgugaguguccugacugugcuacaccaggauuggcucaauggaaaagaguauaagugcaaaguuuccaacaaggcccugccugcgcccaucgagaaaacaauuagcaaggccaagggucaaccacgcgaaccucagguguacacccuucccccaucuagagaggaaaugacgaaaaaucagguaucacugaccuguuuggucaagggcuuuuaucccagugacaucgcaguggagugggaaagcaacgggcagccugagaauaacuacaaaacaacuccaccgguucucgacuccgauggaucuuucuuucuguauucgaaguuaaccguggacaaaucaagguggcaacagggcaaugucuucuccugcucagugaugcacgaagcucugcauaaccacuacacacagaagagucucucucuuagccccgguaag

SEQ ID NO: 23149 - RNA, 642 nt, Artificial Sequence
  derived and/or modified sequence opt3 from Duligotumab_LightChain1
gacauccagaugacccaaagccccuccucucugucagccagugugggcgauagagucacaauuacuugcagggcuagccagaacauagcaacggacguugccugguaccagcagaagccugggaaagcgccaaagcuccuuaucuauuccgcuucuuuccuguacucgggagugccgucacgguuuagcgguaguggcuccgggaccgauuucacauugacuauuucuagcuuacaacccgaggacuuugccaccuauuacugucagcaguccgaaccugagccauauacauucggacagggcaccaaaguagaaaucaagcgcacuguggcagcccccucagucuuuauuuucccuccaagugaugagcaacugaaaagcgguacagcuucugugguuugccuacucaauaacuuuuacccccgagaagcaaaggugcaguggaaggucgacaaugcccugcaguccgggaacucacaggagagcgugaccgagcaagauaguaaagacucuacguauucccuuagcucgacucugaccuugucuaaggcugauuacgaaaaacacaagguauacgccugugagguuacacaucagggacucuccucaccugugacuaaaaguuucaaucguggcgaaugc

SEQ ID NO: 23150 - RNA, 1353 nt, Artificial Sequence; identical to SEQ ID NO: 23148
  derived and/or modified sequence opt3 from Duligotuzumab_HeavyChain1

SEQ ID NO: 23151 - RNA, 642 nt, Artificial Sequence; identical to SEQ ID NO: 23149
  derived and/or modified sequence opt3 from Duligotuzumab_LightChain1

SEQ ID NO: 23152 - RNA, 1353 nt, Artificial Sequence
  derived and/or modified sequence opt3 from Dupilumab_HeavyChain1
gaggugcagcuggucgaaagcggcgggggacucgagcaacccgguggcucccuuagacugucuugcgccgggucaggauucaccuuuagggacuacgcuaugacauggguucggcaggcaccuggcaaggguuuggaaugggugaguagcaucuccgggucuggaggcaacacuuauuacgccgauucgguaaaaggccgcuucacgauuucacgagacaauagcaagaacaccuuauaucugcagaugaauagucuacgugcggaggauacagcuguguacuauugugccaaagacagacucuccauaacuaucaggccacgguacuaugggcuggaugucuggggacaggguaccacagugaccguuucuagcgcauccacuaagggcccgucaguguuuccccuugccccuugcagucgcagcacaucugaauccaccgcugcacugggguguuuggucaaagacuacuucccagagcccgugacgguaucauggaacagcggagcccucaccaguggcguucacacuuuuccugcugugcugcaaucuuccggucuguacagccucucgucugucgugacagugccauccucaaguuuagggacuaagaccuauacaugcaaugucgaucauaagcccagcaacaccaaaguugacaagagaguggaguccaaauacggaccuccauguccgcccugcccugccccagaguuccugggcggccccucuguauuucuuuucccuccaaagcccaaagauacguugaugauuagcaggacuccggaggugacaugugucgugguugacgugucacaggaagauccugagguccaguuuaauugguauguggacgggguagagguucacaacgcgaagaccaagccccgggaagaacaguucaauaguacuuaccgcguggucuccgugcugacaguccuacaucaagauuggcucaacggaaaagaauauaagugcaaagugagcaauaagggucugccaucuucaaucgagaaaaccauuaguaaggcaaaaggccagccucgagaaccccagguuuacacgcuuccacccagccaggaggagaugaccaagaaccaagugucccugacauguuugguaaagggguuuuauccuucugacaucgccgucgaaugggagucgaauggacagccagaaaacaauuacaaaacuaccccgcccgugcucgacagcgauggcuccuucuuucuguacucaagauuaacaguugacaagaguagguggcaggaggguaacguguucucuugcagcgucaugcacgaagcucugcauaaccacuauacucaaaaaucccucucacuuagccugggg

SEQ ID NO: 23153 - RNA, 657 nt, Artificial Sequence
  derived and/or modified sequence opt3 from Dupilumab_LightChain1
gacaucgugaugacccagagcccccugucccucccugucacaccaggcgagccggccucuauuucaugcagaaguagccaaucccuucuguacucuauaggguauaacuacuuggauugguauuuacagaagucgggacagucaccccagcugcuaaucuaccucgguagcaauagggcuaguggcguuccugaccgguucuccgggucuggaagcggcacugauuuuacgcugaaaauuucccgcguggaagcagaggacguagguuucuauuacuguaugcaagcccuucagaccccauauacauuugggcagggaacuaagcuggaaaucaaacgaaccguggcggcucccucagucuucauuuuuccuccaagugaugagcagcucaagagcggcacagccucugugguuugcuugcugaacaauuucuacccccgugaagcaaaagugcaauggaaggucgacaacgcccugcaguccggcaauucacaggagagcgugaccgagcaggauaguaaggacucuacuuacucccucagcucgacauuaacccugucuaaagcugauuaugaaaagcacaaaguauacgcaugugagguuacgcaucaagggcuuuccucaccugugacuaagaguuuuaacagaggagaaugc

SEQ ID NO: 23154 - RNA, 1353 nt, Artificial Sequence
  derived and/or modified sequence opt3 from Durvalumab_HeavyChain1
gaggugcagcuggucgaaagcggcgggggacucguucaacccgguggcucccuuagacugucuugcgccgcuucaggguucaccuuuaguagguacuggaugagcugggugcggcaggcaccuggaaagggcuuggaguggguagccaacaucaaacaggacgguuccgaaaaguauuacguggauucugucaaagggcgcuucacaauuucgcgagacaaugcgaagaacucauuauaucugcagaugaauagccuacgugcugaggauacugccguguacuauugugcaagagaaggaggcugguuuggcgagcucgccuucgacuacugggggcaaggaacgcugguuaccgugaguuccgcuucuacaaaagguccaagcgucuuuccgcuugcacccuccucaaagaguacuagcggcgggaccgccgcucugggaugcuuggugaaggauuauuucccugagccaguaacaguuucuuggaacuccggcgcccucaccucaggugugcacacuuuucccgcgguccugcagagcagugggcuguacucucucuccagcguggugacagucccuucgucuuccuuaggaacccagacguacauauguaauguuaaccauaaaccaucaaauacuaagguggacaaaaggguagaacccaagaguugcgauaaaacccacacauguccuccaugcccggcacccgaguucgaaggcggcccuagcguguuucuguucccacccaagccuaaggacacucuuaugaucucccggaccccagaggucacaugugugguuguggaugucucucaugaggaccccgaagugaaauuuaacugguauguagaugggguugaggugcacaaugccaagaccaaaccgcgcgaggaacaguacaacagcacguauagagucgugucagucuugacugugcugcaucaagacuggcuaaauggaaaggaauacaaaugcaagguuaguaacaaagcucucccugccuccauugagaagacaaucagcaaggcaaaaggucagcccagggagccacagguguauacccugccucccucucgggaagagaugacuaagaaucagguaucacuuacaugucuggucaaaggcuucuacccaagugauauugcuguggaaugggagagcaacgggcaacccgaaaauaacuauaagaccacgccuccaguuuuggacuccgacggaucguuuuuccucuacucuaaacugaccguggauaagagccgcuggcagcagggcaacgucuucuccugcucagugaugcacgaggccuuacacaaucauuacacacaaaagagucugucucucagcccggguaaa

SEQ ID NO: 23155 - RNA, 645 nt, Artificial Sequence
  derived and/or modified sequence opt3 from Durvalumab_LightChain1
gagaucgugcugacccagagccccggcacacucucccuuucuccuggggaaagagccacucugucaugcagggcuagucaacgggucagcuccucuuacuuggcaugguaucagcagaagccaggacaggccccgcgcuuacugauuuacgacgcgucgucacgagcuacggguauacccgaucguuucagcggcaguggguccggaaccgacuuuacacuaacuaucucuagacucgagccugaagauuucgccguuuauuacugucaacaguauggcagccugccauggaccuuuggucaggggacaaaaguggagauuaagaggaccguagcagcccccuccguguucaucuuuccuccaucagacgaacagcuuaaaaguggaacugcuagcgucgugugccuguugaacaauuucuacccccgggaggcaaagguucaauggaaaguggauaacgcccuccagucuggcaauucccaggagucagucacagaacaggacagcaaggauaguaccuauucucuguccagcacgcugacucucucgaaggcugacuacgagaaacacaagguguacgccugugaaguaacccaucaaggcuuaucuuccccuguuacaaaaucauuuaaccgcggggagugc

SEQ ID NO: 23156 - RNA, 1338 nt, Artificial Sequence
  derived and/or modified sequence opt3 from Dusigitumab_HeavyChain1
caggugcaacugguccagagcggcgccgagguuaagaaacccggggcuuccgugaagguaucuugcaaagcaucaggauacaccuucacaaguuaugacaucaacugggugagacaggccacuggucagggccucgaauggaugggguggaugaauccuaacagcggaaauacgggcuacgcgcaaaaguuucaggguagggucaccaugacacggaacacuuccauuucuaccgcuuauauggagcuuucgucacugcgcagcgaagauacagccguguacuauugugcacgagacccauacuauuacuacuaugggauggauguuuggggacagggcaccacugugacagucaguuccgccucuaccaaaggcccgagcguguuccccuuggcuccuugcucccguucaacgagugagagcacugcagccuuagggugucugguaaaggacuacuuuccagaacccguuaccgugucuuggaacuccggagcucuaacaucagguguccacacuuucccugccgugcuccagagcaguggccuguauucucuuuccagcguggucaccguuccaucgucuaauuuugggacacaaaccuacacgugcaauguggaucauaagcccuccaacacuaaaguagacaagacaguggagagaaaauguugcgucgaguguccuccaugcccggcgcccccuguggcaggaccaucaguuuuccuguuucccccuaagccaaaagauaccuugaugauaaguaggacucccgaagugacaugugucgugguagacguuagccacgaggauccggaagugcaguucaauugguaugucgacggcguggagguccauaacgccaagaccaagccucgggaggaacaguuuaauuccacguuccgcgugguuucugugcucaccguaguccaccaggauuggcugaacgguaaagaguacaagugcaaagugagcaauaaggggcugcccgcuccaaucgaaaagacaauuucaaagacuaaaggacaaccuagagagccccagguuuauacccucccacccaguagggaagagaugacaaagaaccagguguccuuaacuugucuggucaagggcuuuuacccuagcgacaucgccguggagugggaaucuaauggccaaccagagaacaacuacaaaaccacaccgcccaugcuugauucagacgggaguuucuuuuuguauagcaagcugaccguagacaaaucccgguggcagcagggaaauguguucucuugcucgguuaugcaugaagcacuacacaaccacuacacucagaaaagccucucccugucaccugguaaa

SEQ ID NO: 23157 - RNA, 651 nt, Artificial Sequence
  derived and/or modified sequence opt3 from Dusigitumab_LightChain1
cagagcgugcugacccaacccccuuccgucucugccgcuccaggccagaagguuacaaucucaugcagugggagcuccucuaacauugagaauaaccacgugucgugguaccagcagcucccgggaacugcacccaaacuucugauauaugacaauaacaagagaccuucagguaucccagauagguucagcggcaguaaauccgggacgucugccaccuugggaauuacaggcuuacaaacuggugacgaagcggauuacuauugugagaccugggacacaagccuguccgcugggcggguauuuggaggcggcaccaagcuaacugugcucgggcagcccaaagccgcaccuucagucacacuguucccacccaguagcgaagaacuucaggccaauaaggcuacccuggugugcuugaucucugauuuuuacccuggagcaguuacgguggccuggaaggcugacuccucaccagucaaagccgguguggaaacuaccacaccgagcaagcagaguaacaauaaauaugcggcaucuuccuaccucagccugacucccgagcaauggaagucgcaucgcucuuauuccugucagguaacccacgagggcucaacaguugagaaaaccguggccccuacggagugcagu

SEQ ID NO: 23158 - RNA, 1347 nt, Artificial Sequence
  derived and/or modified sequence opt3 from Ecromeximab_HeavyChain1
gaggugacccuggucgaaagcggcggggacuucguuaagcccggagguucccucaaagugucuugcgccgcuucaggcuuugcauucagucacuacgccaugagcuggguaagacagacuccugcgaagaggcuugaguggguggcuuauaucuccucugggggaucgggcacauacuauucagauagcgucaaaggucgguuuacgauuagucgcgacaacgccaagaauacccuguacuugcaaaugcgauccuuacguucugaagauagcgcaauguauuucuguacaagagugaaacuggggacuuacuauuuugacuccuggggacagggcaccacacuaaccguuucaagugccagcacuaagggcccaucuguguucccgcucgcucccuccucaaagagcacaagugggggaaccgcagcccuggguugccuugucaaagauuacuuuccugagccagugacgguaucuuggaacuccggcgcucugacuagcgggguucauaccuuccccgccguguugcagucgucuggacucuacucccugucaagugucgugacagugccuagcuccucucugggcacucagaccuauauauguaaugucaaccacaagccaagcaauacaaaaguugacaagaaaguggaacccaagucaugcgauaagacccauacguguccuccaugcccggcgcccgagcucuuaggugggccuaguguauuucuguucccacccaaaccuaaggacacucuuaugaucuccaggacaccagaggugaccugugucgugguugaugugagccacgaagaccccgaggucaaauuuaacugguacguggauggaguagaaguucauaaugcaaagacuaaaccgcgggaggagcaauauaacucuacauaccgcguggucucaguguugaccguccugcaccaggacuggcuaaauggcaaggaauauaaaugcaaggugaguaacaaggcccucccugcucccauugagaaaacgaucagcaaggccaaaggccagccaagagaaccucagguuuacacccugcccccauccagggaugagcuuacaaagaaucaagugucucugacuuguuugguaaaaggguucuaucccucggacauugcagucgaaugggagagcaacggacagccugagaauaacuacaagaccacaccaccggugcucgacuccgaugguucauuuuuccuguacaguaaguuaacuguugacaaaucucgguggcagcagggcaauguguucagcugcuccgucaugcacgaagcucugcauaaccacuauacccaaaagucacucagccuuucucccgggaaa

SEQ ID NO: 23159 - RNA, 642 nt, Artificial Sequence
  derived and/or modified sequence opt3 from Ecromeximab_LightChain1
gacauccagaugacccaaacagccagcucccugcccgcuucucucggcgauagagugacuauuucaugcagugcaagccaggacauauccaacuaccuuaauugguaucagcagaagccugaugggacggucaaacuguugaucuucuacucuucgaacuuacacucaggaguuccaagcagguuuagugguggcggguccggaaccgacuauucucugacaauuagcaaucuagagccggaagauaucgccacuuacuucugucaucaauauuccaagcuccccuggaccuuuggcggugggacaaaacuggagauuaagcggaccguggcggcuccuucaguauucaucuuuccacccagugacgaacagcuuaaaagcggaacugccucuguggucugccuguugaacaauuucuacccucgcgaggcaaaggugcaguggaagguugauaacgcccuccaguccggcaauucacaagaaagcgugacagagcaggacaguaaagauucuaccuauucccugagcucgacgcugacucucucuaaggcugacuacgagaaacacaaggucuacgcaugugaagugacccaucagggcuuauccucaccaguaacaaaaaguuuuaaccgaggggagugc

SEQ ID NO: 23160 - RNA, 1341 nt, Artificial Sequence
  derived and/or modified sequence opt3 from Eculizumab_HeavyChain1
gugcagcugguccaaagcggcgccgagguuaagaaacccggggcuuccgugaagguaucuugcaaagcaucaggauacaucuucaguaacuauuggauucagugggugagacaggccccuggucagggccucgaauggaugggggagauacuuccaggaagcggcuccaccgaauacacagagaauuuuaaggacagggucacuaugacgcgggauaccucuacaucgacuguguauauggaacugucaagccuucgcagugaggacaccgcgguuuacuauugugcucgauacuucuuugguuccucuccgaacugguauuucgaugugugggggcaaggaacauuagucaccgugagcuccgccucaacuaaaggccccaguguauuuccucuggcaccaugcagccguucuacauccgagucaaccgccgcucuaggcugucucguuaaggacuacuuccccgaaccugugacggucagcuggaauaguggggcacugacuucuggagugcacaccuuuccagccgugcuucaguccagcggucuguacucguugucuuccgucguuacagugcccucaaguaacuucggcacucagaccuauacaugcaauguagaucauaagccuagcaacaccaaaguggacaagacggucgagagaaaauguugcguggaauguccaccgugccccgcuccuccaguugccgggcccuccguguuucucuucccuccaaagcccaaagauacucugaugaucucuaggacaccggaggucaccugugugguaguugacgugagccaggaggauccugaaguccaauuuaauugguacguggacggagucgaggugcacaacgcgaagacuaagccccgggaggaacaguucaauucaacauaucgcguugugaguguacugaccguccuccaucaggauugguuaaacggcaaagaauacaagugcaaaguguccaauaagggucugccaagcucuauugagaaaacgaucucaaaggcaaaagggcagccuagagagccccaaguuuauacccuuccacccagucaggaagagaugacaaagaaccaggugagcuugacuugucuggucaagggauuuuacccuuccgacauugccguggaaugggagucuaauggccaaccagaaaacaauuauaaaaccacaccgcccguacuagauucggacggcagcuucuuccucuacuccaggcugacuguggacaagucacgguggcaggaggggaacguuuuuaguugcucugucaugcacgaggcuuugcauaaccacuacacccagaaaagccuguccuugucacucggaaag

SEQ ID NO: 23161 - RNA, 642 nt, Artificial Sequence
  derived and/or modified sequence opt3 from Eculizumab_LightChain1
gacauccagaugacccaaagccccuccucucugucagccagugugggcgauagagucacaauuacuugcggggcuagcgagaacauauacggagcacucaauugguaucagcagaagccugguaaagccccaaaacuucugaucuacggcgcgacgaacuuggcugacgggguuccguccagguucucuggaucgggcucagguaccgauuuuacauuaacuauuagcagucugcagcccgaagacuucgccaccuauuacugucaaaaugugcuaaacacaccucucaccuuugggcagggaacuaagguagagaucaagcggacaguggcagccccauccgucuucauuuuucccccuucugaugaacagcugaaaagcggcaccgcuuccgugguuugccuucugaauaacuucuauccacgcgaggcaaaggugcaguggaaggucgacaaugccuugcaaucaggcaacagucaggaaagcgugacggagcaggauucuaaagacuccacuuacucacucagcaguacccugacacugucuaaggcugauuaugagaaacacaagguauacgccugugaaguuacucaucaggggcucuccagccccgugaccaaaucguuuaaucgaggagagugc

SEQ ID NO: 23162 - RNA, 375 nt, Artificial Sequence
  derived and/or modified sequence opt3 from Efalizumab_HeavyChain
gaggugcagcuggucgaaagcggcgggggacucguucaacccgguggcucccuuagacugucuugcgccgcuucaggguacaguuucaccggacacuggaugaauugggugaggcaggcaccuggcaaggguuuggaguggguagggaucaugauucauccaagcgacuccgaaacacgguauaaucagaaauuuaaggauauacgcuucacuaucucuguggacaaaucgaagaacacguuauaccugcagaugaacucacuacgagccgaggauaccgcggucuauuacugugcucguauuggaaucuauuuuuacggcacaacuuauuucgacuacauuuggggccaagggacccucgugacaguuagcagu

SEQ ID NO: 23163 - RNA, 324 nt, Artificial Sequence
  derived and/or modified sequence opt3 from Efalizumab_LightChain
gacauccagaugacccaaagccccuccucucugucagccagugugggcgauagagucacaauuacuugcagggcuagcaagacgauauccaaauaccucgcaugguaucagcagaagccugggaaagccccaaaacuucugaucuacucuggaucgaccuugcagucagguguuccgagccgguucaguggcuccgggucuggaacagacuuuacuuuaaccauuagcucccugcaacccgaggauuucgcgacauauuacugucagcagcacaacgaauauccucuaaccuuuggccaggguacuaagguggagaucaagcgc

SEQ ID NO: 23164 - RNA, 768 nt, Artificial Sequence
  derived and/or modified sequence opt3 from Efungumab_SingleChain_variable_fragment
auggccgaggugcagcuggucgaaagcggcgcugagguuaagaaacccggggaaucccucagaaucucuugcaagggaucagguuguauuauaaguagcuacuggaucuccugggugaggcaaaugccuggcaaagggcuugaguggaugggaaagauugacccaggcgauucuuauaucaacuacucgccgucauuccagggucacguaaccauuagcgcagacaaaaguaucaauacagccuaucugcaguggaacuccuugaaggcgucugauacugcuauguacuauugcgcccgcgggggacgggacuuuggcgauagcuucgacuacuggggccaggggacguuagugaccgucuccucaggagguggcgggaguggaggcggugggagcggaggcggcgggucugaugugguuaugacacaaucccccucauuucugagcgcauucgugggagaccgaauaacuaucaccugucgugccaguucugguauuuccagauaucuagcuugguaccagcaggcaccuggcaaggccccaaaacuccugaucuacgcugccagcacacuucagaccgggguccccucgagguuuucuggauccggcucagguacugaguucacacugaccauuaauaguuugcaaccugaagauuuugcgacguauuacugccagcaucucaacagcuauccacugacuuucgggggcggaaccaagguggacaucaaacgggcagccgcucuggagcaccaucaccaucaccac

SEQ ID NO: 23165 - RNA, 1362 nt, Artificial Sequence
  derived and/or modified sequence opt3 from Eldelumab_HeavyChain1
cagaugcaacugguggagagcggcgggggagucguucagcccgguagaucccucaggcuuucuugcaccgccucaggcuucacauuuaguaacaaugggaugcacugggugcggcaggcuccuggaaagggccuggaauggguagcagugaucugguucgacgguaugaacaaauuuuacgucgauagcgugaaggggcgcuucacuauuucccgagacaauucuaaaaacacguuguauuuagagaugaacucgcugcgugccgaagauaccgcgauauacuauugugcuagagagggagacggcucaggcaucuacuauuacuaugggauggauguuuggggacaggguacaacugugaccgucagcagugccuccacaaagggcccaucuguguuuccgcuagcacccagcuccaaaucaaccagugggggaacugccgcucucggcugccugguaaaggacuacuucccugaaccaguuacagugagcuggaacucuggugcacuuaccuccgggguccauacguuucccgccgugcugcaaucaagcggauuguacagucucucuuccguggucacuguuccuagcucgucucugggcacccagacauauauuuguaaugugaaucacaagccauccaauacuaaaguagauaagaggguggagcccaaaucaugcgacaagacccauacauguccuccaugcccggcucccgagcugcucggcgggccuagugucuucuuauuuccacccaaaccuaaggauacccugaugaucagccggacgccagaagugacuuguguuguggucgacgugucccacgaggaucccgaaguaaaguucaacugguacguugacggaguggagguccauaaugccaaaacaaagccgcgcgaggaacaguauaacucuaccuacagaguggucagcgugcuuacuguuuugcaccaggauuggcugaaugguaaagaguauaagugcaaagugucaaacaaggcgcuaccugcacccauugagaaaacaaucaguaaggccaagggccaaccaagggaaccucagguauacacccugcccccaucccgggaagagaugacgaaaaaucaggucagccucaccugucuugugaagggguuuuaucccucugacauagcuguugagugggaaucaaacggacagccugagaacaauuacaaaacaacuccaccggugcuggacagugauggcagcuucuuuuuguacuccaagcucaccgucgacaaaucucgcuggcaacaggguaacguguucucgugcagcguaaugcacgaagcccugcauaaucacuauacacagaaguccuuaucacugagucccgggaag

SEQ ID NO: 23166 - RNA, 648 nt, Artificial Sequence
  derived and/or modified sequence opt3 from Eldelumab_LightChain1
gagaucgugcugacccagagccccggcacacucucccuuucuccuggggaaagagccacucugucaugcagggcuagucaaagcgucuccucuucguacuuggcaugguaucagcagaaaccaggacaggccccgcgguuacugauuuacggugcgucaagccgcgcuacgggcauacccgaccgauucaguggguccggaucuggcaccgauuuuacacuaacuaucagccgucucgagccugaagacuucgccguuuauuacugucaacaguaugguuccucaccaauuuuuaccuucgggcccggaacaaaaguggauaucaagagaaccguagcagccccuaguguguuuauuuucccacccagcgacgagcagcugaaaucuggcacugcuuccgucgugugccuucugaacaauuuuuacccuagggaagcaaagguucaguggaaaguggauaacgccuugcaaucaggcaauagccaggagagugucacagagcaggacucuaaggauuccaccuauagccucucgucuacgcugacucuguccaaggcugacuacgaaaaacacaagguguacgccugugagguaacccaucaggggcucucaaguccaguuacaaagagcuucaaccggggagaaugc

SEQ ID NO: 23167 - RNA, 1341 nt, Artificial Sequence
  derived and/or modified sequence opt3 from Elgemtumab_HeavyChain1
gaggugcagcugcucgaaagcggcgggggacuuguccaacccgguggcucccugagauugucuugcgccgcuucaggguucaccuuuaguagcuacgcaauguccuggguuaggcaggccccuggaaagggcuuagagugggugucugcgaucaacucgcaggguaaaucaacauauuacgcugacagcguaaaggggcgguucacuauuagucgcgauaauuccaaaaacacgcuguaucuacagaugaacucucuccgagccgaagacaccgcaguguacuauugugcccguuggggagaugagggcuuugacauauggggccaagggacacuggucacugugagcuccgcuucaaccaagggaccaaguguuuucccgcuugcacccagcucuaaauccacaucagguggcaccgccgcucuggggugcuuggugaaggauuacuuuccugaaccagucacugugagcuggaauaguggagcccucacaucuggcguacacaccuuccccgcgguucugcaguccagcggucuguauucgcucucuuccguggucacggugccuucaaguagcuuagggacucagaccuacaucuguaaugugaaccauaagccauccaauacaaaagucgacaagagaguugagcccaaaucuugcgauaagacucacaccuguccuccaugcccggcacccgagcugcuuggaggcccuagcguguuuuuguucccacccaaaccuaaggacacacugaugauuucaaggaccccagaaguaacguguguggucguggauguuagucaugaggaccccgaagugaaguuuaacugguacgucgauggcguggagguacacaaugccaaaacuaagccgcgggaggaacaguauaacuccacauaccgcguugugagcguccuaaccgugcuccaucaagacuggcugaaugggaaagaguauaagugcaaagucucuaacaaggcccuuccugcucccaucgagaaaacuauuucaaaggcaaagggacagccaagagaaccucagguguacacacugcccccaaguagggaagagaugaccaaaaaucagguuagcuugacgugucucgugaaggguuucuaucccuccgauaucgcuguagagugggaaucuaacggccaaccugagaauaacuacaaaaccacaccaccgguccuggacucggacgggagcuuuuucuuauauuccaagcugacuguggauaaaucacgguggcagcagggaaacguuuuuaguugcucugugaugcacgaagcccuccacaaucauuacacccaaaagagccuuucccugucacccggcaag

SEQ ID NO: 23168 - RNA, 642 nt, Artificial Sequence
  derived and/or modified sequence opt3 from Elgemtumab_LightChain1
gacauccagaugacccaaagccccuccucucugucagccagugugggcgauagagucacaauuacuugcagggcuagccaggggauauccaacuggcucgcaugguaccagcagaagccuggaaaagccccaaaacuucugaucuauggugcgucuucguugcaaucaggcguuccgagccgguucaguggguccggaucuggcacggacuuuaccuuaacaauuagcucccugcagcccgaggauuucgcuacuuacuauugucagcaguacucaaguuuuccuaccacauucggucaagggaccaagguggaaaucaagcgcacuguagccgcaccaagcguguuuauuuuucccccuucugacgagcagcuaaaauccggaacagccucagucgugugccuccugaauaacuucuauccacgagaagcuaagguucaguggaagguggauaaugcacuucagagcggcaacagucaagagucugucaccgaacaggacuccaaagauagcacguacucgcugucuuccacuuugacccucucaaaggccgacuaugagaaacacaagguguacgcuugugagguaacacaucagggccugaguagccccguuacuaaauccuucaaucguggggaaugc

SEQ ID NO: 23169 - RNA, 1347 nt, Artificial Sequence
  derived and/or modified sequence opt3 from Elotuzumab_HeavyChain1
gaggugcagcuggucgaaagcggcgggggacucguucaacccgguggcucccuuagacugucuugcgcugcuucaggguucgacuuuaguagguacuggaugagcugggugcggcaggcaccuggaaagggcuuggaguggaucggugaaauuaacccagauuccucuaccauaaauuaugccccgucguuaaaagacaaguucaucauuucacgcgauaacgcgaaaaauagccuguaccuacagaugaacagucuccgagcugaggacacagccguauauuacugugcacgucccgaugggaauuauugguacuuugacguguggggacagggcacucuggucacgguguccucugccagcaccaagggcccuuccguuuucccacuugcucccucaaguaaaagcacaucugggggaacugcagcccuggguugcuuggugaaggauuauuuuccugaaccagucaccguguccuggaacucaggcgcucucacaagcgggguacacaccuuccccgccguucugcaaaguucuggacuguacucccucagcucgguggucacugugccuucuuccucauuaggcacacagaccuacaucuguaaugugaaccauaagccaaguaauacgaaagucgacaagaaaguugagccgaaguccugcgauaaaacucacaccugucccccuugcccagcgcccgagcugcuuggugggccuuccguguuuuuguucccacccaagccgaaggacacacugaugauuucuagaacuccugaaguaaccuguguggucguggauguuagccaugaggaccccgaagugaaauuuaacugguaugucgauggaguggagguacacaaugcaaagacaaaaccaagggaggaacaguacaacucaaccuaucggguugugaguguccuaacggugcuccaucaggacuggcugaauggcaaggaguacaaaugcaaggucuccaacaaagcccuuccugcucccaucgaaaagacuauaagcaaggccaaaggccaaccacgcgagccccagguguauacacugccuccaucuagagacgaauugaccaagaaucagguuucacucacuugucuggugaaaggguucuacccgagugauaucgcaguagagugggagagcaacggacagcccgaaaacaauuauaagacaaccccuccagucuuagacuccgaugguagcuuuuuccuguacucgaaacucacgguggacaagucuagguggcaacagggcaacguuuuuagcugcucagugaugcacgaggcccuucacaaucauuacacccagaagagucugucuuugagccccgggaaa

SEQ ID NO: 23170 - RNA, 642 nt, Artificial Sequence
  derived and/or modified sequence opt3 from Elotuzumab_LightChain1
gacauccagaugacccaaagccccuccucucugucagccagugugggcgauagagucacaauuacuugcaaggcuagccaggacguugggauagcaguggccugguaccagcagaaaccuggaaagguaccaaaacuccuuaucuauugggcguccacgaggcacaccggugugccggaucgguucucuggcucggggucaggaacagacuuuacucugaccauuagcaguuugcaacccgaggaugucgcuacauacuauugucagcaguacuccucuuauccuuacaccuucggccaggguacuaagguggaaaucaaacgcacaguugccgcaccaagcguguuuauuuuucccccuuccgacgagcaauuaaagucagggaccgccagugucgugugccugcuaaacaauuucuauccacgagaagcuaagguacaguggaaaguugauaacgcacuccagagcggaaauucucaggaguccgugacggaacaagacucaaaggauagcacuuacagucugucuuccacccuuacacugagcaaagccgacuacgagaagcauaaagucuaugcuugugaggugacucaccagggcuugucgucucccgugaccaaguccuucaaccguggcgaaugc

SEQ ID NO: 23171 - RNA, 1338 nt, Artificial Sequence
  derived and/or modified sequence opt3 from Emactuzumab_HeavyChain1
caggugcaacugguccagagcggcgccgagguuaagaaacccggggcuuccgugaagguaucuugcaaagcaucaggauacaccuucacaaguuaugacaucagcugggugagacaggccccuggucagggccucgaauggaugggggucauuuggacugauggaggcacgaacuacgcgcaaaaacuucaggguagggugaccaugacaacugacaccuccacaucuaccgcuuauauggagcugcggucguugcgcucagaugacacugccguuuacuauugugcacgagaucagcguuuauacuuugacgugugggggcagggaacaaccgucacggugagcagugccuccacuaagggcccaucuguauucccgcuggcucccagcuccaagucaaccaguggcgggacagcagcccuaggaugccucguuaaggauuauuuuccugaaccagugacugucagcuggaacucuggugcucugaccuccggcgugcacacauuccccgccgugcuucaaucaagcgggcuguacaguuugucuuccgucguuaccgugccuagcucgucucucggaacgcagacuuacauauguaauguaaaucauaaaccauccaacacaaagguggacaaaaaggucgagcccaaaucaugcgauaagacccacacuuguccuccaugcccggcgcccgaacugcugggcgguccuaguguguuucucuucccacccaagccuaaagacacauuaaugaucagcagaaccccagagguuacguguguggucguggauguaucccaugaggaccccgaaguuaaguuuaauugguauguggauggggucgaggugcacaacgcaaaaaccaagccgagggaggaacaguacaauucuacauaucgggucgugagcguucugacugugcuucaucaggacugguugaacggaaaagaguacaagugcaaaguaucaaauaaggcccugccugcucccauugaaaagaccaucaguaaagccaagggccaaccacgcgagccucaggucuauacacuacccccauccagagacgaacucacuaaaaaccaggugagccugaccugucuuguuaagggcuucuaccccucugauauugcaguggagugggaaucaaaugggcaaccugagaacaauuauaaaacaaccccaccgguccuggacagugaugguagcuuuuucuuguacuccaagcucacuguggacaagucuagguggcagcagggaaacguauuuucgugcagcgugaugcacgaggcucugcacaaucauuacacgcagaaauccuuaucacugagucccggcaag

SEQ ID NO: 23172 - RNA, 639 nt, Artificial Sequence
  derived and/or modified sequence opt3 from Emactuzumab_LightChain1
gacauccagaugacccaaagccccuccucucugucagccagugugggcgauagagucacaauuacuugcagggcuagcgaggacguuaacacguacguguccugguaucagcagaagccugggaaagcaccaaagcuccuuauauacgccgcgucuaaucgguauaccggaguaccgucgcgcuucucagguagcggcagugggacagauuuuacucugaccaucuccucuuugcagcccgaagacuucgcuacauacuauugucaacagagcuuuuccuacccuaccuucggacagggcacuaaauuagagauuaagcgaacaguggccgcaccaucagucuuuaucuuucccccuagugaugaacagcugaaaagcgguaccgccucugugguuugccuacucaacaauuucuauccacgugaggcuaaggugcaauggaaggucgacaacgcacugcaguccggaaauucacaggaaagcgugacggagcaggauaguaaagacucuacuuacucccuuagcucgacccugacauugucuaaggccgauuacgagaaacacaagguauaugcuugugaaguuacucaucaagggcucuccucacccgugaccaaaaguuucaacagaggcgagugc

SEQ ID NO: 23173 - RNA, 1323 nt, Artificial Sequence
  derived and/or modified sequence opt3 from Emibetuzumab_HeavyChain1
caggugcaacugguccagagcggcgcugagguuaagaaacccggggcuuccgugaagguaucuugcaaagcaucaggauacaccuucacagacuauuacaugcacugggugagacaggccccuggucagggccucgaauggauggggagggucaacccaaaucggcgcggaacuacguauaaccaaaaguuugagggccgagugaccaugacaacugauaccaguacaagcaccgcguacauggaacuucguucccugagaucugacgauacugcuguuuauuacugugccagggcaaauugguuggacuauuggggucaggggacaaccgugacggucucgucagccagcacuaaaggaccgaguguguuccccuuagcuccuugcucccggucuaccagcgaguccacagcagcccugggcugucuaguaaaggauuacuuuccagaacccguuacugugucauggaacaguggcgcucucaccagcgggguccauacauucccugccgugcugcagucuuccggacuuuacucacugagcaguguggucaccguuccaucuuccagcuuggguacgaagacuuauacaugcaauguggaccacaaacccucgaacaccaagguagauaaacgcguggagucuaaguacggcccuccauguccgcccugcccugcgccagaggcagccgggggacccuccgucuuucucuucccuccaaaacccaaggacacucugaugaucucaagaacaccggaagugaccuguguuguggucgaugugagucaggaggacccugaaguacaauuuaauugguauguugauggcguggagguccauaacgcuaagacgaaacccagggaggaacaguucaauagcaccuaccggguggucuccgugcugacaguucuccaccaggacugguuaaacgguaaggaguauaaaugcaaggugucuaauaaagggcugccaagcucaauugaaaagacuauaaguaaagccaagggacagccucgcgagccccaaguauacacccuuccacccucccaggaagagaugacaaagaaccaggucagcuugacuugucuggugaaaggcuuuuauccuucugauaucgcaguugagugggaaucaaauggccaaccagagaacaauuacaagaccacaccgcccgugcuagacagugacgggagcuucuuucucuacucccgacugaccgucgauaaaucuagauggcaggaaggaaacguguucucgugcagcguaaugcaugaggcccuucacaaccacuauacucagaagucccugucauugagucucggu

SEQ ID NO: 23174 - RNA, 645 nt, Artificial Sequence
  derived and/or modified sequence opt3 from Emibetuzumab_LightChain1
gacauccagaugacccaaagccccuccucucugucagccagugugggcgauagagucacaauuacuugcagcguuuccucuucggugucaagcauauaccuccacugguaucagcagaagccugggaaagcuccaaaacuucugaucuacaguacguccaacuuggcaucuggaguaccgagcagguucuccgguucaggcagugggaccgacuuuacauuaacuauuagcucucugcagcccgaggauuucgccaccuauuacugucaaguguauuccggauacccucuaacauuuggcggugggaccaaggucgaaaucaagcggacuguggcggcuccaucaguuuucauuuuucccccuagcgacgagcagcucaaaaguggaacagccucuguggucugccugcuuaauaacuucuauccacgcgaagcaaaggugcaguggaagguagauaaugcccugcaguccggcaacagccaagagucgguuaccgaacaggacucuaaagauuccacguacucauugaguagcacucucacccuguccaaggcugacuacgagaaacauaagguguaugcaugugaggucacacaccagggccugucuagccccgugacuaaaucauuuaaucgaggggaaugc

SEQ ID NO: 23175 - RNA, 1344 nt, Artificial Sequence
  derived and/or modified sequence opt3 from Emicizumab_HeavyChain1
caggugcaacuggucgagagcggcgggggacucguucagcccgguggcucccuuagacugucuugcgccgcuucaggguucaccuuuaguuacuaugacauccagugggugaggcaggcaccuggaaagggcuuggaauggguaagcuccauuucuccaucgggucaaucaacauacuaucggcgcgaggugaaagggcgauucacuauaagccgugauaacaguaagaauacguuauaccugcagaugaacucccuaagagccgaagacaccgcggucuauuacugugcuaggcggacaggacgcgaguauggcggcgggugguacuuugauuacuggggacaggguacucucgugaccguuucuagcgccuccacaaaaggcccgucaguguucccccuggcaccuugcaguagaagcaccucugaauccacugccgcucuugggugucuggucaaggacuauuuuccagagcccgugacaguaucauggaauagcggagcauugaccaguggcguucacacguucccugccgugcuccagucuuccggucuguacagccugucgucugucgugacugugccauccucaagucucgggacccaaacauauacuugcaacgucgaucauaaacccagcaauaccaagguugacaagaggguggaguccaaauacggaccuccauguccgcccugcccugcuccagaauuuuuaggcggccccucuguauuccuguuuccuccaaagcccaaagauacacuuaugaucagccggaccccggaggugacgugugucgugguugacgugucacaggaagauccugagguccaguucaacugguauguggacgggguagagguucacaaugccaagacuaaaccccgcgaggaacaguacaacaguacauaucgaguggucuccguguugaccguccugcaucaagauuggcuaaauggaaaggaauacaagugcaaagugagcaacaagggucucccaucuucaauugagaaaacuaucaguaaggcgaaaggccagccuagagaaccccagguuuacacacugccacccagccaaaaggagaugaccaaaaaucaggugucccuuacgugucugguaaagggguuuuauccuucugacauugcagucgagugggaaucgaacggacagccagagaauaacuacaagaccacaccgcccguguuggauagcgacggcuccuucuuucucuauucaaaacugacuguugacaagaguagguggcaggaagguaauguguucucuugcagcgucaugcacgaggccuuacauaaccgguacacccaaaaaucccugucacucagcccu

SEQ ID NO: 23176 - RNA, 1332 nt, Artificial Sequence
  derived and/or modified sequence opt3 from Emicizumab_HeavyChain2
caggugcaacugguccagagcggcuccgagcucaagaaacccggggccucuguuaaggugucaugcaaagcuaguggauacaccuucacagacaacaauauggauuggguaagacaggcaccuggucagggccuugaauggaugggggacaucaacacuaggagcggaggcuccauuuauaaugaggaauuucaagaucgggugauaaugacggucgacaagucuaccgauacagccuacauggagcugucgucauugcgcagcgaagacacugcgaccuaucacugugcucgacguaaaaguuacgguuauuacuuagaugaguggggagagggaacacuggugaccguuuccucugccagcacuaagggcccauccguguucccgcuagcacccugcucaagaaguacaagcgaaucuaccgccgcucucggcugucuggucaaggacuauuuuccugagccagugacgguauccuggaacucaggggcacuuacuagcggaguucauaccuuccccgccgugcugcagaguucugguuuguacucccucagcucggucgugacagugccuucuuccucacugggcacucagaccuacacaugcaaugucgaucacaaaccaaguaacaccaagguugacaaaaggguggaaagcaaguaugggcccccuuguccaccgugccccgcuccugaguuucugggaggcccauccguauuccucuuucccccuaaaccaaaggauacguuaaugaucucucggacucccgaggugacaugugucgugguugacgugagccaggaagauccggagguccaauucaauugguacguggacgguguagaaguucauaacgccaagaccaaaccucgcgaggaacaguauaauucaacuuacagaguggucagugugcugacaguccuucaccaggacugguugaacgggaaggaguauaaaugcaagguguccaauaaaggacugcccagcucuauugagaagaccaucucaaaagcgaagggccagccaagggaaccucaaguuuacacgcuacccccaagucaggaggaaaugaccaagaaccaggugagccucacaugucugguaaaaggcuuuuaucccuccgauauugcagucgagugggaaucuaaugggcaaccugagaacaauuacaagacuaccccaccggugcuugacucggaugggagcuucuuucuguacuccaaauugacaguugacaagucacgguggcaggaggguaacguguucaguugcucugucaugcaugaagcccuccacaaccacuauacucaggagagccuguccuuaucaccc

SEQ ID NO: 23177 - RNA, 642 nt, Artificial Sequence
  derived and/or modified sequence opt3 from Emicizumab_LightChain1
gacauccagaugacccaaagccccuccucucugucagccagugugggcgauagagucacaauuacuugcaaggcuagcaggaacauagagcggcagcucgcaugguaccagcagaaaccugggcaagccccagaacuucugaucuaucaggcgucccgcaaggagucuggaguuccggaccgauucucggguucacguuacggcacggauuuuaccuugacaauuagcaguuuacagcccgaagacaucgcuacuuauuacugucagcaauauuccgauccuccacugaccuucgggggaggcacaaaaguggagauuaagagaaccguagccgcacccucuguguuuaucuucccuccaagcgacgaacagcuaaaauccgguacugccucagucgugugccuccugaauaacuuuuaccccagggaggcuaagguucaguggaagguggauaaugcacuucagagugggaacagccaagagucugucacagaacaggacuccaaagauucaaccuauagccugaguucuacguugacucucuccaaggccgacuacgagaaacacaagguguacgcuugugaaguaacccaucagggacugagcucgccuguuacaaaaucuuucaaucggggcgagugc

SEQ ID NO: 23178 - RNA, 1347 nt, Artificial Sequence
  derived and/or modified sequence opt3 from Enavatuzumab_HeavyChain1
gaggugcagcuggucgaaagcggcgggggacucguucaacccgguggcucccuuagacugucuugcgccgcuucaggguucaccuuuaguagcuacuggauguccugggugaggcaggcaccuggaaagggcuuggaguggguagccgaaauccgguuaaaaucugacaacuaugcgacacacuacgcugagucggugaagggucgcuucacuauuucacgagaugacagcaaaaauagucuguaucuacagaugaacucccuccgugccgaagauacggcagucuacuauuguaccggguacuaugccgacgcuauggauuacuggggacagggcacacuggugacuguuucuagcgcauccaccaagggcccaucaguguuuccgcuugcccccaguagcaaaucuacauccgggggaaccgcugcccuggguugcuuggucaaggacuacuucccugagccagugacuguaucauggaauagcggcgcgcucacaagugggguucauaccuuucccgcagugcugcaaucuuccggacuguauagccucucgucugucgugacggugccuuccucaaguuuaggcacucagaccuacauauguaacgucaaucacaagccaagcaacacaaaaguugauaagaaaguggagcccaaguccugcgacaaaacucauaccuguccuccaugcccggcccccgaacugcuuggugggccuucuguauucuuguuuccacccaagccuaaggauacacugaugaucagcagaaccccagaggugacgugugucgugguugacgugucacacgaagaucccgaggucaaauucaauugguauguggacggaguagagguucauaacgcuaagacuaaaccgagggaggaacaguacaauaguacauaucggguggucuccgugcuaaccguccuccaccaggauuggcugaacggcaaggaauacaaaugcaaggugagcaauaaagcccuuccugcacccauugagaagacuaucucuaaggcuaaaggccaaccacgcgaaccucagguuuauacacugcccccaucaagagaggagaugaccaagaaccaggugaguuugacgugucucguaaaaggguuuuaccccagcgacauugccgucgaaugggaguccaauggacagccugaaaacaauuacaagaccacaccaccggugcuggacucugaugguucguucuuuuuauauagcaaacugacuguugacaaguccagguggcaacagggcaacguguucucaugcagugucaugcacgaggcgcuccauaaccacuacacccagaagucucuuagccugucccccgggaaa

SEQ ID NO: 23179 - RNA, 654 nt, Artificial Sequence
  derived and/or modified sequence opt3 from Enavatuzumab_LightChain1
gacauccagaugacccaaagccccuccucucugucagccagugugggcgauagagucacaauuacuugcagggcuagccaguccguuucuacgucgucauacagcuauaugcacugguaccagcagaagccugggaaagcaccaaagcuccuuauaaaauaugccaguaaccuggaguccggagugccgucucgguucagcgguuccggcucagggaccgacuuuacauugacuaucaguagcuuacaacccgaagauuucgcgaccuacuauugucagcauucuugggagauuccuuacacauuuggaggcgguaccaagguagaaaucaaacgcacuguggcugccccauccgucuucauuuuucccccuucagacgagcagcuaaagagcgggacagcaagugugguuugccugcucaauaacuucuauccacgagaagccaaggugcaguggaaagucgauaaugcucugcaaucuggaaacucccaggagagcgugaccgagcaggacucgaaggauucuacguacucccuuucaaguacucugaccuugagcaaagcagacuacgaaaagcacaaaguauaugccugugagguuacacaucagggccucuccucucccgugacuaagagcuuuaaucguggcgaaugc

SEQ ID NO: 23180 - RNA, 1341 nt, Artificial Sequence
  derived and/or modified sequence opt3 from Enfortumab_HeavyChain
gaggugcagcuggucgaaagcggcgggggacucguucaacccgguggcucccuuagacugucuugcgccgcuucaggguucaccuuuaguagcuacaacaugaauugggugaggcaggcaccuggaaagggcuuggaguggguauccuauaucucuucgucaagcaguacaauuuacuaugccgacuccgugaaaggucgguucacuauaucucgcgauaacgcgaagaauagcuuaucccugcagaugaacucacuacgagacgaagauacggcugucuacuauugugcccgugcauacuauuacgggauggacguguggggacagggcaccacaguuacugugaguagcgccucuaccaaaggcccauccgucuuuccgcucgcucccucaagcaagaguacaucugggggaaccgcagcccuggguugccuugugaaagauuacuucccugagccaguaacuguuuccuggaauagcggcgcucugacaucgggggugcacaccuuucccgccgucuugcaaucuuccggacucuauucacugaguagcguggugacggucccuuccucuagccugggcacucagaccuacaucuguaacguuaaucauaagccaucaaacacaaagguggacaaaagaguagaacccaagaguugcgauaaaacucacaccuguccuccaugcccggcgcccgagcucuuaggugggccuuccguguuccuguuuccacccaagccuaaagacacacuuaugauuagcaggaccccagaggucacgugugugguuguggaugucucucaugaagaccccgaggugaaguucaauugguauguagauggaguugaagugcacaacgcaaagacuaaaccgcgggaggagcaguacaauucaacauaucgcgucgugagugucuugaccgugcugcaucaggacuggcuaaacggcaaggaauacaaaugcaagguuagcaauaaagcccucccugcucccaucgagaagacuauuuccaaagccaagggccaaccaagagaaccucagguguauacacugcccccaucuagggaggaaaugaccaagaaccagguaucgcuuacgugucuggucaaaggguuuuaccccagcgauaucgcaguggagugggaguccaauggacagccugaaaacaacuacaagaccacaccaccgguuuuggacucagacgguaguuucuuucucuauucuaaacugacuguggauaagagccgguggcaacagggcaaugucuucuccugcucagugaugcacgaggcuuuacacaaccauuacacccagaaaagccugucucucucccccgggaag

SEQ ID NO: 23181 - RNA, 642 nt, Artificial Sequence
  derived and/or modified sequence opt3 from Enfortumab_LightChain
gacauccagaugacccaaagccccuccucugugucagccagugucggcgauagaguuacaauuacuugcagggcuagccaggggauauccggauggcuggcaugguaccagcagaagccugguaaagccccaaaguuccucaucuaugcggcuucuacgcuucaaucgggcgugccgucacgguuuagcgggaguggauccggcaccgacuucacacugacuauuucuagcuugcagcccgaggauuuugccaccuacuauugucagcaggcaaacuccuucccuccaacauuuggugggggaaccaaaguagaaaucaagcgcacuguggccgcucccucagucuucauuuuuccuccaagugacgagcaauuaaaaagcggcacagcaucugugguuugccugcuaaauaacuucuacccccgagaagccaaggugcaguggaaggucgauaaugcucuccaguccggcaacucacaggagagcgugaccgaacaagacaguaaagauucuacguauucccugagcucgacucuuacccugucuaaggccgacuacgagaaacacaagguauaugcgugugagguuacacaucagggguuguccucaccugugacuaaaaguuuuaaucguggagaaugc

SEQ ID NO: 23182 - RNA, 1341 nt, Artificial Sequence; identical to SEQ ID NO: 23180
  derived and/or modified sequence opt3 from Enfortumab_vedotin_HeavyChain1

SEQ ID NO: 23183 - RNA, 642 nt, Artificial Sequence; identical to SEQ ID NO: 23181
  derived and/or modified sequence opt3 from Enfortumab_vedotin_LightChain1

SEQ ID NO: 23184 - RNA, 1356 nt, Artificial Sequence
  derived and/or modified sequence opt3 from Enoblituzumab_HeavyChain
gaggugcagcuggucgaaagcggcgggggacucguucaacccgguggcucccuuagacugucuugcgcugcuucaggguucaccuuuaguagcuucggaaugcacugggugaggcaggcaccuggcaaggguuuggaguggguagccuacaucuccucugacucgucagcgauuuauuacgcugauacagugaaagggcgguuuacuauaagccgcgacaacgccaagaauaguuuauaucugcagaugaacucccuacgagaugaagacacggcagucuacuauuguggacguggcagagagaauaucuacuauggcucuaggcucgauuacugggggcagggaaccacagugacuguuagcuccgccucaaccaaagguccaaguguguucccgcuggcucccagcucuaaguccacaucaggcgggaccgcagcccuuggaugccuggucaaagacuacuuuccugaaccagugacuguaagcuggaacaguggcgcuuugacaucugguguucauaccuuccccgccgugcuccaauccagcgggcuguauucgcugucuuccgucgugacggugccuucaaguagccucggaacucagaccuacauuuguaaugucaaccacaagccauccaauacaaagguugauaaacggguggagcccaagucuugcgacaaaacucauaccuguccuccaugcccggcgcccgaguuaguaggcggcccuagcguguuucugcuuccacccaagccuaaagauacauugaugaucucacgcaccccagaagucacgugugugguuguggacgucagucacgaggaucccgaagugaaguucaacugguauguagacgggguugaggugcauaaugcaaagacuaaaccgccugaggaacaguacaacuccacacugagagucgugagcguccuaaccgugcuccaccaggauuggcugaauggaaaggaguauaaaugcaagguuucuaacaaagcccuucccgcuccaauugaaaagacuaucucaaaagccaagggucaaccuagggagccccagguguacacacugccacccagucgggaagagaugaccaagaaucaggucagcuugacgugucucguaaaaggcuuuuauccuuccgacauagcaguggagugggaaucuaacgggcagccagagaauaacuacaagaccacaccgcugguuuuagacucggauggcagcuucuuucuguacuccaaacucacuguggacaagucacgcuggcaacagggaaacgucuucaguugcucugugaugcacgaagcccuucauaaucacuauacccagaaaagccuguccuugucacccgguaag

SEQ ID NO: 23185 - RNA, 642 nt, Artificial Sequence
  derived and/or modified sequence opt3 from Enoblituzumab_LightChain
gacauccagcugacccaaagccccuccuuccucucugccucagugggcgauagagucacaauuacuugcaaggcuagucagaacguugacacgaauguggcaugguaccagcagaaaccugggaaggccccaaaagcgcuuauauauagcgcuuccuacagguauucuggaguaccgucgcgguuuucagguagcggcagugggaccgauuucacacugacuaucuccucuuugcaacccgaggacuuugccaccuacuauugucagcaguacaacaauuauccuuucacauuuggacagggcaccaaguuagaaauuaaacgcacuguggcagccccaagcgucuucaucuuucccccuuccgaugagcaacugaagucagguacagcuagugugguuugccuacucaacaauuucuacccacgagaagcaaaggugcaguggaaagucgacaacgcccugcagagcggaaauucucaggaguccgugaccgaacaagauucaaaggacagcacguacagucuuucuuccacucugaccuugagcaaagcugauuaugagaagcacaaaguauacgccugugagguuacacaucaggggcucucgucucccgugacuaaguccuuuaaccguggcgaaugc

SEQ ID NO: 23186 - RNA, 1356 nt, Artificial Sequence
  derived and/or modified sequence opt3 from Enokizumab_HeavyChain1
caggugcaacugguccagagcggcgccgagguuaagaaacccggguccucugugaagguaucaugcaaagcuaguggagguaccuucagcuacuauuggaucgaaugggugagacaggcaccuggccaggggcucgaguggaugggagaaauucuuccaggcuccgguacaacuaacccgaaugagaaguuuaaagggagggucacgauaaccgccgacgaaucuacaucgacugcguacauggagcugaguagcuugcggagugaggauaccgcuguguauuacugugcccgcgcagacuauuacggauccgauuauguuaaguucgacuacuggggccaaggcacauuagugaccgucucuagcgccuccacuaaggggcccucaguguuuccucuggcuccaaguagcaaaucuacauccggagguaccgcagcccuaggcugccucguaaaggauuacuuccccgaaccuguuacggugucauggaacagcggggcucugacuucaggaguccacaccuuuccagccgugcuucagucuuccggccuguauagcuugucgucuguggucacaguucccuccucaagucucgguacucagaccuacaucuguaaugugaaccauaaaccuagcaauacaaagguagacaaacgaguggagccaaaguccugcgauaagacccacacguguccgcccugcccugcgccagaacugcucgggggacccucugucuuccuguuuccuccaaaacccaaggacacuuuaaugauuagccguacaccggaggugaccuguguuguggucgaugugucacaugaggacccugaaguaaaauucaacugguauguugauggcguggagguccacaaugcaaagacuaaacccagagaggaacaguacaacaguacauauaggguggucuccgugcugaccguucuucaucaagacugguugaauggcaaggaauacaaaugcaaggugagcaacaaggcccugccagcuccuaucgagaaaacgauuucuaaggccaaagggcagccccgggagccacagguauauacccuacccccuucacgcgaagagaugacaaagaaucaggucagucucacuugucuggugaaaggauuuuacccaagcgauaucgcaguugaaugggaguccaacggucaaccggaaaauaacuacaagaccacacccccugugcuugacucugacggcucguucuuucuguauagcaaguugacugucgauaaauccagauggcagcaggggaauguguucucaugcaguguaaugcacgaggcucuccacaaccauuacacccaaaagucucugagcuuauccccaggaaaa

SEQ ID NO: 23187 - RNA, 642 nt, Artificial Sequence
  derived and/or modified sequence opt3 from Enokizumab_LightChain1
gacauccagaugacccaaagccccuccucucugucagccagugugggcgauagagucacaauuacuugcaaggcuagccagcacguuauaacgcaugugaccugguaccagcagaaaccugggaaggcaccaaaacuccuuaucuauggaacauccuacucuuauucggguguaccgucaagguucagcggcaguggguccggaacugacuuuacccugacaauuucuagcuugcaacccgaggauuucgccaccuacuauugucagcaguuuuacgaauauccuuuaacuuucggcggugggacaaagguggagaucaaacggaccgucgcggcuccauccguguuuauuuuucccccuucagacgaacagcugaagaguggaacggccagcguugugugccuacucaacaauuucuacccacgcgaggcaaagguccaauggaaaguggauaacgcccugcagucuggcaauucccaggaaucaguaacugagcaggacagcaaggauaguaccuacucucuuuccagcacacugacuuugucgaaagcugacuaugagaagcacaaaguuuacgcaugugaagugacccaucaaggccucucuucccccgucacaaagucauucaaccgaggggagugc

SEQ ID NO: 23188 - RNA, 612 nt, Artificial Sequence
  derived and/or modified sequence opt3 from Enokizumab_LightChain
gacauccagaugacccaaagccccuccucucugucagccagugugggcgauagagucacaauuacuugcaaggcuagccagcacguuauaacgcaugugaccugguaccagcagaaaccugggaaggcaccaaaacuccuuaucuauggaacauccuacucuuauucggguguaccgucaagguucagcggcaguggguccggaacugacuuuacccugacaauuucuagcuugcaacccgaggauuucgccaccuacuauugucagcaguuuuacgaauauccuuuaacuuucggcggugggacaaagguggagaucaaacggaccgucgcggcuccauccguguuuauuuuucccccuucagacgaacagcugaagaguggaacggccagcguugugugccuacucaacaauuucuacccacgcgaggcaaagguccaauggaaaguggaaucuguaacugagcaggauuccaaggacucaaccuacagccugaguucuacacuuacucuguccaaagccgauuaugagaagcacaaaguuuacgcuugugaagugacccaucagggcuugagcucgcccgucacaaagucuuucaaccgaggcgagugc

SEQ ID NO: 23189 - RNA, 1356 nt, Artificial Sequence
  derived and/or modified sequence opt3 from Enoticumab_HeavyChain1
caggugcaacuggucgagagcggcgggggaguugugcagcccgguagaucccucaggcuuucuugcgccgcuucaggcuucaccuuuaguagcuacgggaugcacuggguacggcaggcaccuggaaagggccuggaauggguguccuucuugugguaugacgguacaaacaaaaauuacgucgagucugugaaggggcgcuuuacuaucucgcgagauaacucuaaaaauauguuauaucuggaaaugaacagccuacgugccgaggacacggcgguuuacuauugugcuagagaucaugacuucaggaguggauacgaaggcugguuugauccauggggccaggggacccucgugacagucuccucugccagcacuaagggaccguccguguucccccuggcaccuucaaguaaaagcaccucugguggcacagccgcucuugggugccugguaaaggacuauuuuccagagcccguuaccguguccuggaacucaggagcauugacuagcggcguccacacauucccugccgugcuccaaaguucuggucuguacucccugagcucgguggucaccguuccaucuuccucacucgggacgcagacuuacauuuguaaugugaaucauaagcccaguaacaccaaaguagauaagaaaguggagccuaagagcugcgacaaaacacacacuuguccaccgugccccgcuccugaauuacugggaggcccauccgucuuucuuuuucccccuaagccaaaggauaccuugaugauaucucggacacccgaggugaccuguguuguggucgacgugagccaugaagauccggagguaaaauucaauugguauguugacggcguggagguccacaacgccaagacgaaaccucgcgaggaacaguacaauucaacuuauagaguggucagugugcugacaguucuacaccaggauuggcucaacgggaaggaauacaaaugcaagguguccaauaaagcgcugcccgcaccaaucgagaagaccauuagcaaggccaaaggacaaccuagggaaccccagguauauacucuuccacccucucgggacgagcugacaaagaaccaggucucauugaccugucucgugaaagguuucuacccuagugacaucgcuguugagugggaaagcaauggccagccagagaacaacuauaagacgaccccgcccgugcuggauuccgacgggucauuuuucuuauacucgaaacugacagucgauaagagccgcuggcaacagggaaauguguucuccugcucaguaaugcaugaagcccuccacaaccauuacacucagaagagucuuucucugagcccuggc

SEQ ID NO: 23190 - RNA, 642 nt, Artificial Sequence
  derived and/or modified sequence opt3 from Enoticumab_LightChain1
gagaucgugcugacccagagccccgccacacucucccuuucuccuggcgaaagagcuacucugucaugcagggcaagucaaagcgucuccucuuacuuggccugguaucagcagaagccagggcaggcgccgcgguuacugauuuacgacgcuucgaaccgcgccacgggaauacccgcacgauucucagguagcggcagugggaccgauuuuacacuaacuaucuccucucucgagccugaagacuucgccguuuauuacugucaacaccguagcaauuggccacccaccuuuggaggcgguacaaaaguggagauuaagagaaccguagcugcaccuuccguguucaucuuuccacccucagaugaacagcugaaaagugggacugccagcgucgugugccuucugaacaauuucuauccuagggaggcuaagguucaguggaaaguggacaacgccuugcagucuggaaauucccaagagucagucacagaacaggauagcaaggacaguaccuacucucucuccagcacgcugacucugucgaaggcggauuaugagaaacauaagguguacgcaugugaaguaacccaccagggccucucuuccccaguuacaaaaucauuuaaccggggcgagugc

SEQ ID NO: 23191 - RNA, 1329 nt, Artificial Sequence
  derived and/or modified sequence opt3 from Ensituximab_HeavyChain1
caagugcaacugaaggagagcggccccgaccucgucgccccuucccagucucuuucaauuaccugcacaguuaguggguucagccuguccaaauuuggagugaacuggguaagacagccaccggguaagggcuuggaaugguuaggggugaucuggggagauggcucuacuucguacaauucaggucugauaagcaggcuaaguaucuccaaagagaacucuaagagccaggucuuccucaaacugaauagccuucaagcugacgauacggcaaccuauuacugugugaagcccgggggagacuauuggggccacggcacaucaguuacugugaguagcgccucuaccaaggggccuuccgucuuuccacuggcgcccucaagcaaaaguacaucuggagguaccgcugccuugggcugccucgugaaggauuacuucccugaaccaguaacuguuuccuggaacagcggggcacugacaucgggagugcauaccuuucccgccguccugcagucuuccggcccuuauucacucaguagcguggugacggucccauccucuagcuuagguacucagaccuacauuuguaauguuaaccacaaaccgucaaauacaaagguggacaaaaagguagagcccaagaguugcgauaaaacucauaccuguccuccaugccccgcuccugaacugcuugggggaccauccguguucuuguuucccccgaagccuaaagacacacugaugaucagccggacccccgaggucacgugugugguuguggaugucucucacgaggacccagaagugaaguucaacugguauguagauggcguugaggugcauaaugcaaaaacuaagccucgcgaggaacaguacaacucaacauaccgagucgugaguguccuaaccgugcuccaccaagacuggcugaauggcaaagaguauaagugcaagguuagcaacaaagcccuucccgcuccaauugaaaagacuaucuccaaagccaaggggcagccccgugagccucagguguacacacugccaccgucuagagaugaauugaccaaaaaucagguaucgcucacgugucuggucaagggauuuuaucccagcgacauagcgguggagugggaauccaacggucaaccugagaauaacuacaagaccaugccacccguuuuagacucagauggcaguuucuuucuguauucuaaacucacaguggacaaguccagguggcagcaggggaacgucuucuccugcucagugaugcacgaggcacuucauaaucacuacacucagaaaagccugucuuuguccccuggaaag

SEQ ID NO: 23192 - RNA, 639 nt, Artificial Sequence
  derived and/or modified sequence opt3 from Ensituximab_LightChain1
caggugguccugacccaaagccccguuaucauguccgccucuccuggcgagaaggugacaaugacuugcucagcuaguagcuccauuucuuacauguauugguaccagcagaaaccagggacgucgccgaagagauggauauaugacaccucaaaacucgcaagcggaguacccgccagguucagugguuccggcucugggacaagcuacucccuuacuaucucaaacauggaagcgggagaugcugccaccuauuacugucaccagcgggacaguuauccuuggacauuuggcggugggaccaaucuggagauuaagcgcacuguggcagccccaagcgucuucaucuuucccccuucugaugaacaauugaaauccggaacagcuucagugguuugcuuacugaacaauuucuacccacgagaggcaaaggugcaguggaaggucgacaacgcccuacagagcggcaauagucaggaaucugugaccgagcaagauuccaaagacagcacguacucgcucucuuccacucugacccuuucaaaggcugauuaugagaaacauaagguauacgccugugaaguuacacaccagggccugaguagccccgugacuaaauccuuuaaccguggggagugc

SEQ ID NO: 23193 - RNA, 768 nt, Artificial Sequence; identical to SEQ ID NO: 23164
  derived and/or modified sequence opt3 from Ensituximab_SingleChain_variable_fragment

SEQ ID NO: 23194 - RNA, 987 nt, Artificial Sequence
  derived and/or modified sequence opt3 from Entolimod_chain1
augagaggcagccaccaucaccaucaccaugggauggccuccaugaccggaggucagcaaaugggcagggaccuguacgaugacgaugacaaggaucccauggcucaggugaucaacacaaauucucucucacuucugacucagaacaauuugaacaaaagucagagcuccuuaucuucggcaauugagcggcugucaagcgggcuacgcauaaauagugccaaggacgaugcggcuggacaagccaucgcaaaccgauucacguccaauauuaaaggccucacccaggccucucguaacgcuaaugacgguaucagcauugcacagacaacugaaggggcccugaacgagaucaauaacaaucuucagagagucagggaacuguccguucaagcuaccaacggaacaaauucagauagugaccucaagagcauacaggaugagauccagcagcgguuggaagagauugaccgcgugucuaaccaaacccaguuuaacggcguaaaagugcugucccaggauaaucaaaugaagauccaggucggcgccaacgacggggagacuauuacaaucgaccugcagaagauagaugugaaaucacucggauuagacgguuucaauguuaacagcccuggcauuagugggggaggcggugggauccuggauucuaugggaacccuuauuaaugaagacgcggcagccgcuaagaaauccacggccaacccauuggcaagcaucgauucggcucugucuaagguggacgccgucagauccucacuaggcgcgauccagaauagguuugauagugccauuacuaaccucggcaauaccgugacaaaccugaauagcgcacggucccgcauagaggacgcugauuaugccacugaaguaucuaacaugagcaaagcucaaauccuucagcaggccgggaccucaguucuggcacaggccaaucaagugccgcagaacgucuugagucuccugcga

SEQ ID NO: 23195 - RNA, 1338 nt, Artificial Sequence
  derived and/or modified sequence opt3 from Epratuzumab_HeavyChain
caggugcaacugguccagagcggcgccgagguuaagaaacccggguccucugugaagguaucaugcaaagcuaguggauacaccuucacaagcuauuggcuccacugggugagacaggcaccuggucagggccuugaauggaucggguacauuaacccaaggaaugacuauacugaguacaaccaaaauuuuaaggauaaagccacgauaaccgcggacgaauccacaaacacugcuuauauggagcugucuucguugcggucagaagauaccgccuucuacuuuugugcacgccgagacaucacaaccuucuauuggggacagggcacuuuagucacagugagcagugccuccaccaaggguccgucuguuuuuccccuggcuccuagcuccaagucaacgagugggggaacugcagcccuaggcugccucgugaaagauuacuucccagagcccgucaccgugagcuggaacucuggcgcucugacauccgggguacauacuuuuccugccguucuucagucaagcggacuguacaguuugucuuccguggucaccgugccaagcucgucucucgguacacagaccuauauuuguaaugugaaucacaagcccuccaacacgaaagucgacaagaaaguugagccuaagucaugcgauaagacucauacauguccaccgugccccgcgccugaacugcugggcgggccaaguguguuccucuuucccccuaaaccaaaggacaccuuaaugaucagccguacucccgagguaacauguguggucguggauguuucccacgaagacccggaggugaaauucaauugguacgucgauggaguggagguacauaacgcaaagaccaaaccuagagaggaacaauauaauucuacguacaggguugugagcguccugaccgugcuucaccaggacugguugaacggcaaggaauauaaaugcaaggucucaaauaaggcccugcccgcuccaauugagaaaacaaucaguaaggccaaaggucagccucgggaaccccagguguacacucuaccacccucccgcgaugagcucaccaagaaccaaguuagccugacaugucuugugaaaggguuuuauccuucugacauagcaguagagugggaaucaaauggacagccagagaacaacuacaagacuaccccgcccguccuggacagugauggcagcuucuuuuuguacuccaagcucacaguggacaaaucuagauggcagcaaggcaauguuuucucgugcagcgugaugcacgaagcucugcauaaccacuauacccagaaguccuuaucacugaguccugggaaa

SEQ ID NO: 23196 - RNA, 657 nt, Artificial Sequence
  derived and/or modified sequence opt3 from Epratuzumab_LightChain
gacauccagcugacccaaagccccuccucucucucagccagugugggcgauagagucacaaugagcugcaaguccucucagucgguucuuuacucagcuaaccacaaaaauuaucuggcaugguaccagcagaagccugggaaagccccaaaguuguuaauuuauugggcgagcacuagggagaguggagugccgucccgguucucugguagcggcuccgggacggacuuuaccuucacaauaucaagucugcaacccgaagauaucgcuacuuacuauugucaucaguaccuaagcucuuggaccuuuggacagggcacaaaaguagagauuaagcgcaccguggccgcaccuuccgucuucaucuuuccacccucagacgaacagcucaagagcgguacugccagugugguuugccugcuuaacaauuucuauccucgagaggcuaaagugcaauggaaggucgauaacgcacugcagucuggaaauucccaggaaagcgugacagagcaggacucgaaagauucuaccuacuccuugucaaguacgcucacucugagcaaggccgacuacgagaaacacaagguauaugcuugugaaguuacccaucaagggcuguccucuccagugacaaagagcuuuaaccguggcgagugc

SEQ ID NO: 23197 - RNA, 762 nt, Artificial Sequence
  derived and/or modified sequence opt3 from Eptacog_beta_HeavyChain1
aucgugggcgggaaggucugccccaagggagaguguccuuggcagguucugcuccuugugaacggugcccaacugugcggcgggaccuugauuaauacaauauggguagugagcgcugcacacuguuucgacaagaucaaaaacuggagaaauuuaauugccguccugggagaacaugaucuauccgagcacgacggcgaugaacagucuaggcggguggcgcagguuaucauuccaucaacuuacgugccggguacgaccaaccaugacaucgcucuccugcgccuucaccagcccgucgugcugacagaucauguaguuccuuugugccucccagagcgaacuuuuagugaacguacccuggccuucgugagauuuagccuggucuccggguggggacaacucuuagacaggggcgcaacagcccuggagcuuaugguguugaaugugccccggcugaugacccaggauugucuacagcagucucgcaaggucggcgacucgccuaacauaacugaguauauguucugcgcuggguacucagauggaagcaaagacaguuguaagggugauuccggcgggccacacgcaacacacuauagaggaaccugguaccucacgggcaucguuucuuggggucaagggugcgccacugugggacauuuuggcguauauaccagggugagccaguacauugaauggcugcagaaacuuaugcgguccgagccccgcccuggcguccuguugcgagcuccauucccg

SEQ ID NO: 23198 - RNA, 456 nt, Artificial Sequence
  derived and/or modified sequence opt3 from Eptacog_beta_LightChain1
gccaacgcuuuccuggaggaacucagacccggcagccuugagagggaaugcaaggaggaacaguguuccuuugaggaggcacgggaaaucuucaaagacgccgagcgcaccaagcuguuuuggauuucuuacucagauggggaccaaugcgcgaguagcccuugucagaauggagguuccugcaaagaucaguugcagucuuauauauguuucugcuuaccagcuuuugaaggccgaaacugugagacacacaaggacgaucaacugaucugcgugaaugagaacgggggaugugaacaguacugcucggaccauacuggcacgaaacguucauguagaugccacgaggguuauagccuacucgccgauggggucaguugcaccccgacaguugaauaccccuguggaaagauuccuauccuggagaagaggaaugcauccaaaccacagggccgg

SEQ ID NO: 23199 - RNA, 708 nt, Artificial Sequence
  derived and/or modified sequence opt3 from Erlizuab_HeavyChain1
gaggugcagcuggucgaaagcggcgggggacucguucaacccgguggcucccuuagacugucuugcgccaccucaggguacacauucacugaguauacgcacuggaggcaggcuccuggaaagggcuuggaauggguggcagguaucaacccgaaaaaugggggaaccagucauaaccagcgguuugaccgcuucacaauuagcguagauaaguccacuucuaccgccuaccaaaauucguuacgagcggaggacacagcuguguauuacugugcccguuggagaggccugaacuauggcuuugaugucagguacuucgacgugugggggcagggaacccuaguuacugugucaagcgcaaguacaaaagguccauccgucuuuccccucgccccuucuagcaaguccaccucaggcgggacggcugcacugggaugccuugugaaagauuauuucccagaacccguaacuguuaguuggaauagcggcgcccugaccucuggugugcacacauuuccugcugucuugcaguccucagggcucuacagccugaguucuguggugacugucccauccagcucgcugggaacccagacauacauauguaacguuaaucauaagcccucuaacaccaagguggacaaaaagguagagccuaaauccugcgauaagacgcacacuuguccaccgugccccgccccugagcuc

SEQ ID NO: 23200 - RNA, 639 nt, Artificial Sequence
  derived and/or modified sequence opt3 from Erlizuab_LightChain1
gacauccagacccaaagccccuccucucugucagccagugugggcgauagagucacaauuacuugcagggcuagccaggacauaaacaauuaccucaacugguaucagcagaagccugggaaagcaccaaaacuucugaucuacuauacguccaccuugcacucuggaguuccgucgcgguucucagguagcggcagugggacagauuacacuuuaaccauuuccucucugcaacccgaggacuuugccacauauuacugucagcagggaaauacccuaccuccaacuuucggccaggguacaaagguggaaaucaagcgcaccguagcggcucccagcguguuuauuuucccuccauccgaugagcaacucaaaucagggacggccagugucgugugccugcuuaacaauuuuuauccccgagaagcaaagguucaguggaagguggacaacgcccugcagagcggaaauucucaggaguccgucacugaacaagauucaaaagacagcaccuacaguuugucuuccacacucacucugagcaaggcugauuacgagaaacauaagguguaugcaugugagguaacccaccagggccugucgucuccuguuacaaaauccuucaaccguggcgaaugc

SEQ ID NO: 23201 - RNA, 1341 nt, Artificial Sequence
  derived and/or modified sequence opt3 from Etaracizumab_HeavyChain1
caggugcaacuggucgagagcggcgggggaguugugcagcccgguagaucccucaggcuuucuugcgccgcuucaggcuucaccuuuaguagcuacgacauguccuggguacggcaggcaccugggaagggacuggaauggguggccaaagucucuucgggcggugggucaacauauuacuuggauacugugcagggacgcuucacgaucagccgagacaacaguaagaauaccuuauaucugcaaaugaacucccuacgugcggaggauacagcuguuuacuauugugccagacaccuccauggcucuuuugcaagcuggggccaggggacuaccgugacagucuccucagccaguaccaaaggaccaagcguguucccgcuggcucccucuuccaagucaacuagcgguggcacagcagcccuugggugccugguaaaagacuacuuuccugaaccaguuaccgugaguuggaacucuggagcuuugacguccggcguccacacuuuccccgccgugcuccagagcucgggucuguauucucuguccucaguggucaccguuccuaguagcucccucgggacacagacuuacauuuguaaugugaaucauaagccaucuaacaccaagguagauaaaaggguggagcccaagagcugcgacaaaacacacaccuguccuccaugcccggcgcccgaauuacugggaggcccuucagucuuucuuuucccacccaagccuaaagauacguugaugauaagucggacuccagaggugacauguguuguggucgacgugucccaugaggaucccgaaguaaaguuuaauugguacguugacggcguggagguccacaacgcaaagaccaaaccgcgcgaggaacaauauaauagcacuuacagaguggucucugugcugacaguucuacaccaggauuggcucaacgggaaggaguauaaaugcaaggugucaaauaaagcccugccugcucccaucgaaaagaccauuaguaaagccaagggacagccaagggagccucagguauacacgcuucccccaagccgggaagagaugaccaagaaccaagucucccugacauguuuggugaaagguuucuaucccucugacaucgcaguugaaugggagucgaauggccagccugagaacaauuacaagacuaccccaccggugcucgauagcgacggguccuuuuuccuguauucaaaauuaacagucgacaagagucgcuggcagcaaggaaacguguuuucuugcagcguaaugcaugaagcucugcacaaccauuacacucagaaaucccucucacuuagccccggcaag

SEQ ID NO: 23202 - RNA, 642 nt, Artificial Sequence
  derived and/or modified sequence opt3 from Etaracizumab_LightChain1
gagaucgugcugacccagagccccgccacacucucccuuucuccuggcgaaagagcuacucugucaugccaagcaagucagagcauuuccaacuucuugcacugguaccagcagaggccagggcaagccccgcgguuacugauacgcuaucgaucucagucgaucucagggauucccgcgcguuuuagcgguaguggcuccgggacggacuucacccuaacaaucucuagccucgagccugaagauuuugcugucuacuauugucagcaguccggaucauggccacugacuuucggcggugggaccaagguugagauuaaaagaacaguggccgcacccaguguauuuaucuucccuccaagcgacgaacaacuuaagucuggaaccgccuccguggucugccuguugaauaacuuuuaccccagggaggcuaaagugcaguggaagguugauaaugcacuccagucaggcaacagccaggagagugugacugaacaagacucuaaagauuccacauauagccugucgucuacccugacgcucuccaaggccgacuacgagaagcauaaagucuaugcuugugaagugacucaccagggcuuaucaaguccuguaaccaagagcuucaaucggggagagugc

SEQ ID NO: 23203 - RNA, 1326 nt, Artificial Sequence
  derived and/or modified sequence opt3 from Etrolizuab_HeavyChain1
gaggugcagcuggucgaaagcggcgggggacucguucaacccgguggcucccuuagacugucuugcgccgcuucaggguucuuuaucaccaacaauuacuggggaugggugaggcaggcaccuggcaaggguuuggaguggguaggguauauuaguuacagcggauccacaucuuauaacccaucguuaaaaucacgguucacuauaagccgcgacacgaguaagaauaccuuuuaccugcagaacucccuacgagccgaagauacagcgguguauuacugugcucguacuggcucuagcggcuauuucgacuuuugggggcagggaacccucgucacaguguccucagccaguaccaaagguccgagcguuuucccccuggcaccuucuuccaagucaacuagcggcgggacagccgcucuuggaugccuggugaaagauuacuuuccagagcccgucaccgugaguuggaacucuggcgcauugacguccgguguacacacuuucccugccguucuccaaagcucggggcuguacucucuguccucaguggucaccgugccaaguagcucccucggaacacagacuuauaucuguaaugugaaucauaagcccucuaacaccaaggucgacaaaaagguugaaccuaaaagcugcgauaagacacacaccuguccaccgugccccgcuccugaguuacugggcggcccaucaguguuucuuuuucccccuaaaccaaaggacacguugauuaguagaacucccgagguaacauguguggucguggauguuucccaugaagacccggaggugaaguucaauugguacgucgaugggguggaaguacacaacgccaaaaccaagccuagggaggagcaguauaauagcacuuaccggguugugucuguccugacagugcuacaucaggacuggcucaacggaaaagaauauaagugcaaagucucaaauaaggcgcugcccgcaccaaucgagaaaaccauuaguaaggccaagggucaaccucgcgaaccccagguguacacgcuuccacccagcagagaggaaaccaaaaaccagguuucccugacauguuuggugaagggcuucuauccuucugauaucgcuguagagugggagucgaaugggcagccagaaaacaacuacaaaacuaccccgcccguccucgacagcgauggauccuuuuuccuguacucaaaguuaacaguggacaaaaguagguggcaacagggcaauguuuucucuugcagcgugcacgaggcccugcacaaccauuauacucagaagucccucucacuuagcccuggu

SEQ ID NO: 23204 - RNA, 1326 nt, Artificial Sequence
  derived and/or modified sequence opt3 from Etrolizuab_HeavyChain2
gaggugcagcuggucgaaagcggcgggggacucguucaacccgguggcucccuuagacugucuugcgccgcuucaggguucuuuaucaccaacaauuacuggggaugggugaggcaggcaccuggcaaggguuuggaguggguaggguauauuaguuacagcggauccacaucuuauaacccaucgaaauuaucacgguucacuauaagccgcgacacgaguaagaauaccuuuuaccugcagaacucccuacgagccgaagauacagcgguguauuacugugcucguacuggcucuagcggcuauuucgacuuuugggggcagggaacccucgucacaguguccucagccaguaccaaagguccgagcguuuucccccuggcaccuucuuccaagucaacuagcggcgggacagccgcucuuggaugccuggugaaagauuacuuuccagagcccgucaccgugaguuggaacucuggcgcauugacguccgguguacacacuuucccugccguucuccaaagcucggggcuguacucucuguccucaguggucaccgugccaaguagcucccucggaacacagacuuauaucuguaaugugaaucauaagcccucuaacaccaaggucgacaaaaagguugaaccuaaaagcugcgauaagacacacaccuguccaccgugccccgcuccugaguuacugggcggcccaucaguguuucuuuuucccccuaaaccaaaggacacguugauuaguagaacucccgagguaacauguguggucguggauguuucccaugaagacccggaggugaaguucaauugguacgucgaugggguggaaguacacaacgccaaaaccaagccuagggaggagcaguauaauagcacuuaccggguugugucuguccugacagugcuacaucaggacuggcucaacggaaaagaauauaagugcaaagucucaaauaaggcgcugcccgcaccaaucgagaaaaccauuaguaaggccaagggucaaccucgcgaaccccagguguacacgcuuccacccagcagagaggaaaccaaaaaccagguuucccugacauguuuggugaagggcuucuauccuucugauaucgcuguagagugggagucgaaugggcagccagaaaacaacuacaaaacuaccccgcccguccucgacagcgauggauccuuuuuccuguacucaaaguuaacaguggacaaaaguagguggcaacagggcaauguuuucucuugcagcgugcacgaggcccugcacaaccauuauacucagaagucccucucacuuagcccuggu

SEQ ID NO: 23205 - RNA, 639 nt, Artificial Sequence
  derived and/or modified sequence opt3 from Etrolizuab_LightChain1
gacauccagacccaaagccccuccucucugucagccagugugggcgauagagucacaauuacuugcagggcuagcgaguccguugacgaucuccuucacugguaccagcagaagccugggaaagcaccaaagcuguugauaaaauaugccucucagucgaucucaggagugccgagccgguucagugguuccggcucugggacggacuuuaccuuaacaauuagcucccugcaacccgaagauuucgcgacuuacuauugucagcagggaaacucacuaccuaauaccuuuggccaggguacaaagguagagaucaaacgcaccguggcugccccaagugucuucauuuuucccccuagcgacgaacaacucaagucugggacugcauccgugguuugccugcuuaacaauuucuacccacgagaggccaaggugcaguggaaagucgauaacgcucugcagucaggaaauagccaggaaagugugacagagcaagacucuaaggauuccaccuauagcuugucgucuacgcucacucuguccaaagcagacuacgagaagcauaaaguauaugccugugaaguuacccaccagggccugucaagucccgugacaaagagcuuuaaccguggcgagugc

SEQ ID NO: 23206 - RNA, 1338 nt, Artificial Sequence
  derived and/or modified sequence opt3 from Etrolizumab_HeavyChain1
gaggugcagcuggucgaaagcggcgggggacucguucaacccgguggcucccuuagacugucuugcgccgcuucaggguucuuuaucaccaacaauuacuggggaugggugaggcaggcaccuggcaaggguuuggaguggguaggguauauuaguuacagcggauccacaucuuauaacccaucguuaaaaucacgguucacuauaagccgcgacacgaguaagaauaccuuuuaccugcagaugaacucccuacgagccgaagauacagcgguguauuacugugcucguacuggcucuagcggcuauuucgacuuuugggggcagggaacccucgucacaguguccucagccaguaccaaagguccgagcguuuucccccuggcaccuucuuccaagucaacuagcggcgggacagccgcucuuggaugccuggugaaagauuacuuuccagagcccgucaccgugaguuggaacucuggcgcauugacguccgguguacacacuuucccugccguucuccaaagcucggggcuguacucucuguccucaguggucaccgugccaaguagcucccucggaacacagacuuauaucuguaaugugaaucauaagcccucuaacaccaaggucgacaaaaagguugaaccuaaaagcugcgauaagacacacaccuguccaccgugccccgcuccugaguuacugggcggcccaucaguguuucuuuuucccccuaaaccaaaggacacguugaugauuaguagaacucccgagguaacauguguggucguggauguuucccaugaagacccggaggugaaguucaauugguacgucgaugggguggaaguacacaacgccaaaaccaagccuagggaggagcaguauaauagcacuuaccggguugugucuguccugacagugcuacaucaggacuggcucaacggaaaagaauauaagugcaaagucucaaauaaggcgcugcccgcaccaaucgagaaaaccauuaguaaggccaagggucaaccucgcgaaccccagguguacacgcuuccacccagcagagaggaaaugaccaaaaaccagguuucccugacauguuuggugaagggcuucuauccuucugauaucgcuguagagugggagucgaaugggcagccagaaaacaacuacaaaacuaccccgcccguccucgacagcgauggauccuuuuuccuguacucaaaguuaacaguggacaaaaguagguggcaacagggcaauguuuucucuugcagcgugaugcacgaggcccugcacaaccauuauacucagaagucccucucacuuagcccuggu

SEQ ID NO: 23207 - RNA, 642 nt, Artificial Sequence
  derived and/or modified sequence opt3 from Etrolizumab_LightChain1
gacauccagaugacccaaagccccuccucucugucagccagugugggcgauagagucacaauuacuugcagggcuagcgaguccguugacgaucuccuucacugguaccagcagaagccugggaaagcaccaaagcuguugauaaaauaugccucucagucgaucucaggagugccgagccgguucagugguuccggcucugggacggacuuuaccuuaacaauuagcucccugcaacccgaagauuucgcgacuuacuauugucagcagggaaacucacuaccuaauaccuuuggccaggguacaaagguagagaucaaacgcaccguggcugccccaagugucuucauuuuucccccuagcgacgaacaacucaagucugggacugcauccgugguuugccugcuuaacaauuucuacccacgagaggccaaggugcaguggaaagucgauaacgcucugcagucaggaaauagccaggaaagugugacagagcaagacucuaaggauuccaccuauagcuugucgucuacgcucacucuguccaaagcagacuacgagaagcauaaaguauaugccugugaaguuacccaccagggccugucaagucccgugacaaagagcuuuaaccguggcgagugc

SEQ ID NO: 23208 - RNA, 1359 nt, Artificial Sequence
  derived and/or modified sequence opt3 from Evinacumab_HeavyChain1
gaggugcagcuggucgaaagcggcgggggaguuauccaacccgguggcucccucagacuuucuugcgccgcuucaggguucaccuuugacgauuacgcaaugaacugggugaggcagggaccuggcaagggucuggaguggguaagugccauuagcggggacggaggcuccacauauuacgcggauucugugaaaggccgguucacuauaucgcgcgacaauucaaagaacagcuuguauuuacagaugaauagucugcgagcugaagauacggccuuuuucuacugugcaaaagaccuacguaacaccaucuuuggggucgugauuccagaugccuucgacaucuggggacaggguacaaugguuacuguguccucugcuagcaccaagggcccguccgucuuuccccucgcaccuugcucaagaaguacaagcgagucuaccgccgcucuggggugucuugugaaagauuauuucccagaacccguaacuguuuccuggaauagcggagcccugacaagcggcgugcacaccuuuccugcggucuugcaaaguucuggucucuacucccugagcucgguggugacggucccaucuuccucacuggggacuaagaccuauacaugcaacguugaccauaagcccaguaauacuaaaguggauaagaggguagagagcaaauacggaccuccauguccgcccugcccugcaccagaguuccucggcggccccuccguguuuuuauucccuccaaagcccaaagacacccugaugauuucucggacaccggaagucaccugugugguuguggaugucagccaggaggacccugaagugcaguuuaacugguacguagacgggguugaggugcacaaugccaagacgaagccccgcgaggaacaguucaacucaacuuauagagucgugaguguccuuacaguguugcaucaagauuggcugaauggaaaagaguacaagugcaaaguuuccaacaagggucuaccaagcucuaucgagaaaaccauaucaaaggcuaaaggccagccuagggaaccccagguguauacucucccacccagucaggaagagaugacaaagaaucaaguaagccugaccugucuugucaagggguucuacccuuccgacaucgccguggagugggaaucuaacggacagccagagaauaacuauaaaacgaccccgcccguucuggauucggacggcagcuuuuucuuguacucccggcucacaguggauaagucacgcuggcaggaagguaacgucuuuaguugcucugugaugcacgaggcacugcauaaucacuauacucaaaaaucauuaucccugucacucgggaag

SEQ ID NO: 23209 - RNA, 642 nt, Artificial Sequence
  derived and/or modified sequence opt3 from Evinacumab_LightChain1
gacauccagaugacccaaagccccuccacacugucugccucagugggcgauagagucacuauuacgugcagggcuagucagagcauacgguccuggcucgcaugguaccagcagaagccugggaaagccccaaaacuucugaucuauaaggcgucuucguuggagucaggaguuccgagccgcuucagugguuccggcucugggaccgaauuuacauuaacuauuagcucccugcaacccgacgauuucgcuaccuacuauugucagcaguacaacucauauaguuacacauuuggacagggcaccaagcuagagaucaaacgaacuguggccgcaccuagcguauucauuuuuccacccucugacgaacaacucaaguccgguacagccucaguggucugccugcuuaauaacuucuauccucgugaggcuaaggugcaguggaaaguugauaaugcacugcagagcgggaacagucaggaaucugugaccgagcaagacuccaaggauagcacguacucguugucuuccacucucacccugucaaaagccgacuacgagaagcacaaagucuaugcuugugaagugacacaucagggacugaguagcccaguaacuaaguccuuuaauagaggcgagugc

SEQ ID NO: 23210 - RNA, 1323 nt, Artificial Sequence
  derived and/or modified sequence opt3 from Evolocumab_HeavyChain1
gaggugcagcugguccaaagcggcgccgaaguuaagaaacccggggcuuccgugaagguaucuugcaaagcaucaggauacacccucacaaguuaugguaucagcugggugagacaggccccuggccaggggcuugaguggaugggaugggucuccuucuacaacggcaauacuaacuaugcgcagaagcugcaagguagggggacgaugaccacagacccaucuacuucgaccgcuuacauggaauugcggucauuacgcagcgaugacacagccguguauuacugugcacgaggauauggcauggauguuuggggccaggggaccacugugacagucaguuccgccucuaccaaaggaccgagcguguuuccccuggcuccuugcucccguucaacgagugagagcacugcagcccuagguugucucguaaaggacuacuucccagaacccguuaccgugucuuggaacuccggcgcucugacaucagggguccacacuuuuccugccgugcuucagagcaguggacuguacucuuuguccagcguggucaccguuccaucgucuaauuucggcacacagaccuauacgugcaauguggaucauaagcccuccaacacuaaaguagacaagacaguggagagaaaauguugcgucgaguguccuccaugcccggcgcccccuguggcagguccaucaguuuuucucuuucccccuaagccaaaagauacccugaugauuaguaggacucccgaagugacaugugucgugguagacguuagccacgaggauccggaagugcaauuuaauugguacgucgacgggguggagguccauaacgccaagaccaagccucgggaggaacaguucaauuccacguuucgcgugguuucugugcugaccguaguccaccaggauuggcucaacggaaaagaguauaagugcaaagugagcaauaagggcuuacccgcuccaauagaaaagacaaucucaaagacuaaaggccagccuagagagccccaaguuuacacccugccacccaguagggaagagaugacaaagaaccaggugucccuuacuuguuuggucaagggguucuauccuagcgacauugccguggagugggaaucuaauggacagccagagaacaauuacaaaaccacaccgcccaugcuggauucagacgguaguuucuuccuauauagcaagcucaccguagacaaaucccgguggcaacagggcaacguguuuucuugcucgguuaugcaugaagcacugcacaaccacuacacucagaaaagccuuucccugucaccugggaaa

SEQ ID NO: 23211 - RNA, 645 nt, Artificial Sequence
  derived and/or modified sequence opt3 from Evolocumab_LightChain1
gagagcgcccugacccagcccgcuuccgugucuggcucaccugggcaaaguaucacaauuagcugcacuggaacguccucugacgucgguggcuacaacucgguuucaugguaucagcagcacccagggaaggcaccgaaacucaugauauacgaagugagcaauagacccaguggaguauccaacagguucucuggcagcaaguccgguaauaccgccucacuuacaaucagugggcugcaggcggaggaugaagcugacuauuacuguaacagcuauacuucuaccuccaugguguuuggaggcggcacaaaauugaccgucuuagggcaaccuaaggccgcaccaucagugacucuguuucccccuagcagugaggaacuacaggccaauaaagcuacacucguuugccugauuucugauuucuacccaggagcagugaccgucgccuggaaggcugacuccagccccgugaaggccgguguagagacgacuaccccuucgaaacagucuaacaauaaguaugcggcauccucauaccuuagucugacaccagagcaguggaaaagccaucgguccuacucuugucaaguuacucacgaaggcagcaccguggagaagacagucgccccgaccgaaugcuca

SEQ ID NO: 23212 - RNA, 1353 nt, Artificial Sequence
  derived and/or modified sequence opt3 from Exbivirumab_HeavyChain1
caggugcaacuggucgagagcggcgggggaguugugcagcccgguggcucccucagacuuucuugcgccccuucaggguucguauuuaggaguuacggaaugcacugggugcggcagaccccaggcaagggucuggaaugggucagcuugaucuggcaugacggguccaaccgcuucuaugcugauucugugaaaggacgauuuacaauuucgcgugacaauucaaagaacacuuuauaccugcagaugaauagccuaagagcagaggauacggccauguauuucugugcgagggaacggcucauagcugccccggcagccuuugaccuguggggccaaggcacccuuguuacagugaguuccgcuucuacuaaagggcccagcgucuucccucuggcaccauccucaaagaguaccagcggagguacagccgcuuugggcugccucgugaaagauuacuuucccgagccuguaaccguuucuuggaacuccggggcccugacuucaggagugcacacauucccagcgguccugcagagcaguggccucuauucuuuauccagcguggugaccguccccucgucuucccuggguacgcagacuuacaucuguaauguuaaccauaagccuucaaauaccaagguggacaaacgcguagaaccaaagaguugcgauaaaacacacacuuguccgcccugcccugcaccagagcuuuugggagggcccagcguguuucuguucccuccaaagcccaaagacacccuaaugauuuccagaacaccggaggucaccugugugguuguggaugucucucaugaagacccugaggugaaguuuaacugguauguagauggcguugaagugcacaaugccaagacgaaacccagggaggagcaguacaacagcacuuaccgggucgugucaguccucacagugcugcaccaagacuggcuuaauggcaaggaauauaaaugcaagguuaguaacaaagcucugccagccccuaucgagaagaccauuuccaaagcaaaggggcagccccgcgaaccacagguguacacuuugcccccuagccgagaggaaaugacaaagaaucagguaucucucaccugucuggucaaaggauucuauccaucagauaucgcuguggagugggagaguaacggucaaccggaaaauaacuacaagacgacacccccuguuuuagacagcgacggcuccuuuuuccuguauucuaaacucaccguggauaagucgagauggcagcaggggaacgucuucagcugcuccgugaugcaugaggcccuucacaaucauuacacucaaaaaucacugaguuugucuccaggaaag

SEQ ID NO: 23213 - RNA, 642 nt, Artificial Sequence
  derived and/or modified sequence opt3 from Exbivirumab_LightChain1
agcuacgugcugacccagcccccuuccgucucuguugccccaggcaagacagcuagaaucucaugcgggggaaacaauauugguacuaaaaacgugcacugguaucaacagaagccgggccaggcacccguacucguggucuacgccgacagugauaggccuagcgggauaccagagcgguucuccggaucuaauucgggcaacacggcgacccuuacaaucucacgcguggaagcuggugacgaggccgauuauuacugucagguuugggacagcgugaguuaucaugucguguuugggggaggcacuacccugacaguauugggccaacccaaagcagccccuuccguuaccuuauucccacccucuagcgaagaacugcaggcuaauaaggcaacucuagugugccucauuuccgauuuuuacccuggggccgucacaguggcuuggaaagccgacucaaguccagugaaggcgggagucgaaaccacgacuccgagcaagcagucuaacaauaaauaugcagccuccucauaccugagccuuacccccgagcaguggaagagucaccgaucuuacuccugucaaguuacacaugaggguagcacuguggagaaaaccguagcuccuacagagugcucg

SEQ ID NO: 23214 - RNA, 1347 nt, Artificial Sequence
  derived and/or modified sequence opt3 from Farletuzumab_HeavyChain1
gaggugcagcuggucgaaagcggcgggggaguugugcaacccgguagaucccucaggcuuucuugcucagccaguggcuucaccuuuagcggguacggacuguccuggguacggcaggcuccuggcaaggguuuggaguggguggcaaugaucucuucagggggaucguauacauacuaugccgacagcgucaaaggccgcuucgcgauuagucgagauaacgcuaagaauacuuuauuucugcagauggacucccuacguccagaagauacgggcguguacuucugugccagacacggggacgauccggcaugguuugccuauuggggacaggguacccccguuacagugucuagcgcuuccacuaaaggcccuucagucuucccacucgcacccaguagcaagucuaccuccgggggaacagccgcucugggcugccuugugaaagacuacuuuccugagccaguaaccguuucauggaacagcggugcccugacaaguggggugcauacauuccccgcggucuugcaaucuuccggacucuauagccugucgucuguggugaccgucccuuccucaagucugggcacgcagacuuacauauguaauguuaaccacaagccaagcaauaccaagguggauaaaaagguagaaccgaaauccugcgacaagacacauacuugucccccuugcccagcacccgagcucuuaggcgggccuucuguguuucuguucccacccaaaccgaaggauacccuuaugaucagcaggacaccugaggucaccugugugguuguggacgucucacacgaagaucccgaggugaaguuuaacugguacguagacggaguugaagugcauaaugccaaaacgaagccacgggaggagcaguauaacaguacuuaccgcgucguguccgucuugacagugcugcaccaggauuggcuaaaugguaaagaauauaagugcaaaguuagcaacaaggcucucccugcccccauugagaaaaccaucucuaaggcaaagggccaaccaagagaaccccagguguacacucugccuccaucaagggacgagcuuacuaaaaaucagguaagucugaccuguuuggucaagggguucuauccgagcgacauugcuguggaaugggaguccaacggacagcccgagaauaacuacaaaacgaccccuccaguucucgauucugacggcucguuuuuccuguauagcaaguuaacaguggauaaaucccgguggcaacaggguaaugucuucucaugcagugugaugcacgaagcccugcauaaccacuacacucagaagucucucagccuuucccccgggaag

SEQ ID NO: 23215 - RNA, 651 nt, Artificial Sequence
  derived and/or modified sequence opt3 from Farletuzumab_LightChain1
gacauccagcugacccaaagccccuccucucucucagccagugugggcgauagagucacaauuacuugcagcguuuccucuucgauaucaagcaacaaucuucacugguaccagcagaagccugggaaagcuccaaagccguggaucuauggaacgaguaaccuggcauccggugugcccucuagguucagcggcuccgggucaggaaccgacuacacauuuacuauuaguagcuugcagccugaggauaucgccaccuauuacugucaacaguggucuuccuauccauacauguauacauucggccaggguaccaaaguagaaauuaagcggacuguggcggcucccucagucuuuaucuucccuccaagcgacgagcaguuaaaaagugggacagccucugugguuugccugcuaaauaacuuuuacccccgcgaagcaaaggugcaauggaaggucgauaaugcccuccaguccggaaacagccaggagucggugaccgaacaggacucuaaagauuccacguacucacugaguagcacucuuacccuguccaaggcugacuaugagaaacauaagguauacgcaugugagguuacacaccaaggcuugucuagcccugugacuaaaucauucaaucgaggcgaaugc

SEQ ID NO: 23216 - RNA, 1338 nt, Artificial Sequence
  derived and/or modified sequence opt3 from Fasinumab_HeavyChain1
caggugcaacugguccagagcggcgccgagguuaagaaacccggggcuuccgugaagguaucuugcaaagugucaggauucacccucacagaacuuaguauccacugggucagacaggcaccugguaagggccuggaguggaugggaggguuugacccagaagauggcgagacuauuuacgcccagaaauuccaagguagggugacgaugaccgaagacacaagcacugauaccgcguauauggaguugacauccuuacggucugaggacaccgcuguuuacuauuguucgacuauauuugggguggucacaaacuucgauaauuggggacagggcacccuggugacgguaucaagcgccaguacuaagggcccguccguuuuuccccuagcaccuugcucucgcagcaccuccgaaucaacagccgcucucgggugucuggugaaggacuacuucccagagcccgucacugugaguuggaacagcggagcacuuaccucuggugugcauacauuuccugccguccugcaguccucaggcuuguauagccucaguucuguugugaccguaccauccagcucgcuggggacgaaaacuuacacaugcaauguggaucacaagcccucuaacaccaaagucgacaagcgaguggaauccaaauauggaccuccauguccgcccugcccugcuccagaguuccugggcggucccucaguuuuucucuucccuccaaagcccaaggauacuuuaaugaucagucguacaccggaggugaccugugucgugguagacguuagccaggaagauccugaggugcaauuuaauugguacgucgacgggguggaaguccauaacgccaaaacgaagcccagagaggaacaguucaauuccaccuacagggugguuucugugcugacaguacuucaccaggauugguugaacggaaaagaguauaagugcaaagucagcaauaagggccugccaucaaguauugagaaaacuaucuccaaggcgaagggccagccucgggaaccccaaguguacacccuaccacccagccaggaggaaaugacuaaaaaccagguuucucucacaugucuggugaagggguuuuauccuucagacauugcagucgagugggaaaguaauggacaaccagagaacaauuacaaaaccacaccgcccgugcuugacagcgaugguuccuucuuccuguauucucgcuugaccguagacaagucgagauggcaggagggcaacguguuuagcugcuccguuaugcaugaagcccuccacaaucacuacacucagaaaucacugaguuuaucucuggggaag

SEQ ID NO: 23217 - RNA, 642 nt, Artificial Sequence
  derived and/or modified sequence opt3 from Fasinumab_LightChain1
gacauccagaugacccaaagccccuccucucugucagccagugcuggcgauagagugacaauuacuugcagggcaagccaggccauacggaacgaccucgggugguaccagcagaagccuggaaaagcgccaaagcgccuuaucuaugcugccuucaaucugcaauccggugucccgucucgauuuucgggcucagggagcggaacggaguucaccuugacaauuaguuccuuacagcccgaagaucuggcaucuuacuauugucagcaguacaaccguuauccuuggacuuuuggccaagguaccaaaguugagaucaagagaacaguggccgcuccaagcguauucauuuuucccccuuccgacgaacagcuaaaaucagggaccgcaaguguggucugccuccugaauaacuucuacccaagggaggccaaggugcaguggaagguugauaaugcccuucagagcggaaacucucaagaauccgugacugagcaggacucaaaagauagcacauauagucugucuuccaccuugacgcucagcaaggcugacuacgagaaacacaaggucuacgcgugugaagugacucaucagggccugucgucucccguaaccaaauccuuuaaucggggcgagugc

SEQ ID NO: 23218 - RNA, 1350 nt, Artificial Sequence
  derived and/or modified sequence opt3 from Fezakinumab_HeavyChain1
caggugcaacugguccagagcggcgccgagguuaagaaacccggggcuuccgugaagguaucuugcaaagcaucaggauacaccuucacaaacuauuacaugcacugggugagacaggccccuggucagggccucgaaugggucggguggaucaauccauauacuggaagugcguuuuacgcucaaaaguucaggggccgggugacgaugacccgcgacacaagcauuuccacugccuauauggagcuuucucgacugcguucggaugacaccgcaguuuacuauugugccagagaaccggagaaauuugauucagacgauagcgacgugugggguagggggacauuggucaccgugaguuccgcuucuacuaagggacccagcguauucccuuuagcaccauccucaaagaguacaagcggcggcaccgccgcucuggggugccuaguuaaagauuacuuucccgaaccugugacggucucuuggaacuccggagcccucacuucaggugugcauaccuucccagcggugcugcagagcaguggccuuuacucucuguccagcgucguuacagugcccucgucuuccuuggggacucagaccuauauauguaauguaaaccacaagccuucaaauacaaaaguggacaagaaagucgagccaaagaguugcgauaagacccauacguguccgcccugcccugcaccagagcuccugggaggccccagcguguuucuguucccuccaaaacccaaggacacucucaugaucucccggacaccggaaguuaccuguguggucguggauguaucucacgaggacccugaaguuaaauuuaacugguacguggauggugucgaggugcauaaugccaagacuaaaccccgcgaggaacaguauaacagcacauacagagucgugucaguuuuaaccgugcugcaccaagacuggcuuaaugggaaggaguauaaaugcaagguaaguaacaaggcuuugccagccccuauugagaaaacgaucuccaaggcaaaaggacagcccagggaaccacaggucuacacccugcccccuagccgggaagagaugacaaagaaucaggugucucuaacuugucucguuaaaggcuucuauccaucagacauugcuguggagugggaaaguaacggccaaccggagaauaacuacaagaccacacccccuguccuggauagcgacggguccuuuuuccuuuacucuaagcugacuguggauaaaucgcgcuggcagcagggaaauguauuuagcugcuccgugaugcacgaagccuugcauaaccacuauacccaaaagucacucagucugucuccaggu

SEQ ID NO: 23219 - RNA, 651 nt, Artificial Sequence
  derived and/or modified sequence opt3 from Fezakinumab_LightChain1
caggccgugcugacccaacccccuagcgucuccggcgcuccagggcagagaguuacaaucucuugcacuggaucaaguagcaacauuggugcaggcuacggggugcacugguaucagcagcucccgggaacggcccccaaacuucugauauacggcgacuccaauaggccuucugguguaccagaucgguucucggggucaaagagcggaaccagugcguccuuggcuaucacaggcuuacaagccgaggacgaagcagauuauuacugucagucuuaugacaacagccuguccggcuacguguuugggggagguacucagcuaaccguccucggccagcccaaggccgcuccuucagugacacuguucccacccaguagcgaggaacuucaagcaaauaaagccacccugguuugcuugauuucugauuuuuauccuggggcugugacugucgccuggaaggcggacuccucaccagugaaagcaggaguagagacaaccacgccgagcaagcagaguaacaauaaguacgccgcuucuuccuaccucagccugacucccgaacaguggaaaucgcaucgcucuuauuccugucagguuacccacgagggcucaacaguggagaagacugucgccccuaccgaaugcagu

SEQ ID NO: 23220 - RNA, 1347 nt, Artificial Sequence
  derived and/or modified sequence opt3 from FG-3019_HeavyChain1
gagggccagcuggugcaaagcgggggaggucucguccaccccggcgggucccuuagacugucuugcgccggaucaggcuucaccuuuaguagcuacgguaugcauuggguuaggcaggcuccugggaagggauuggaauggguguccggcaucggcacagggggagguacuuauucuacggacucgguaaaaggccgguucaccauuucacgcgauaacgcaaagaauagcuuauaccugcagaugaacagucuacgagccgaggacauggcgguguauuacugugcucguggggauuauuacggauccggcagcuuuuucgacugcuggggucaggggacacucgucacugugucuuccgccucaaccaaaggaccaaguguuuuuccgcuggcacccagcucuaaguccacaucaggcggcaccgccgcucuugggugucuggugaaagauuauuucccugaaccagucacugugagcuggaauaguggagcauugacaucugguguacacaccuuucccgccguucuccaauccagcggccuguacucgcugucuuccguggucacggugccuucaaguagccucgggacucagaccuacauaugcaacgugaaucauaagccauccaacacaaaggucgacaaaagaguugagcccaagucuugugauaaaacucauaccugcccuccauguccggcucccgaauuacugggaggcccuagcguguuccuuuuuccacccaagccuaaagacacauugaugaucucaaggaccccagagguaacgugcguggucguggauguuagucacgaggaccccgaagugaaguucaauugguaugucgaugguguggagguacacaacgccaagacuaaaccgcgggaggaacaguacaauuccacauaucgcguugugagcguccugaccgugcuacaccaggacuggcucaacgggaaggaguacaaauguaaggucucuaauaaagcgcugccugcacccauugaaaagacuaucucaaaagccaagggccaaccaagagagccucagguguauacacuucccccaaguagggaagagaugaccaagaaccagguuagccugacgugcuuggugaaaggauuuuaccccuccgauauugcuguagaaugggagucuaauggccagccugagaacaauuauaagaccacaccaccgguccucgacucggacgggagcuucuuucuguacuccaaauuaacuguggauaagucacgguggcaacagggaaacguuuucaguuguucugugaugcaugaagcccugcacaaccauuacacccagaaaagccucucccuuucacccggu

SEQ ID NO: 23221 - RNA, 642 nt, Artificial Sequence
  derived and/or modified sequence opt3 from FG-3019_LightChain1
gacauccagaugacccaaagccccuccucucugucagccagugugggcgauagagucacaauuacuugcagggcuagccaggggauauccucuuggcucgcaugguaccagcagaagccugagaaagccccaaagucgcuuaucuaugcggcuucaagccugcaaaguggaguuccgucccgguucucugguagcggcuccgggacggacuuuaccuugacaauuucaaguuuacagcccgaagauuucgccacuuacuauugucagcaguacaacagcuauccuccaaccuuuggacaaggcacaaaacuggagaucaagcgcaccguggcagcccccucuguauucauuuuuccuccauccgacgaacagcuaaaaucagguacugcuagcguggucugccuccugaauaacuucuacccccgagaggcaaaggugcaguggaagguugauaaugcccuucagagugggaacucucaagaauccgugacagagcaggacagcaaagauucgaccuauucucuguccucaacguugacucucaguaaggcugacuacgagaaacacaaggucuacgccugugaagugacccaucagggacugagcuccccuguaacaaaaucuuuuaaucguggcgagugc

SEQ ID NO: 23222 - RNA, 1344 nt, Artificial Sequence
  derived and/or modified sequence opt3 from Fibatuzumab_HeavyChain1
caggugcaacugguccagagcggcgccgagguuaagaaacccggggcuuccgugaagguaucuugcaaagcaucaggauacaccuucacagguuauuggaugaacugggugagacaggccccuggccaggggcucgaauggaugggagacaucuacccaggcagugguaauacuaacuaugaugagaaguuucaagggagggucacgaugacccgggacacaagcauuuccacugcguacauggaacuuucucgccugcgaucggaugacaccgcuguguauuacugugcccguggaggcuauuacgaggauuucgacucauggggccaggggacaaccguuacugugagcagugcauccacaaaaggaccgucugucuuucccuuggccccuagcuccaagucaaccagugguggcacggcugcauuagggugccuggugaaggauuacuucccagaacccguaacuguuagcuggaacucuggagcccuaaccuccggcgugcacacauuuccugcuguccuccagucaagcggucuguauagucuuucuuccguggugacugucccaagcucgucucuggggacccagacauacauauguaauguuaaucauaaacccuccaacaccaagguggacaaaagaguagagccuaagucaugcgauaaaacgcacacuuguccaccgugccccgccccugaguugcucggaggcccaaguguguuccuguuucccccuaagccaaaggacacacugaugaucagcaggacccccgaagucacuugugugguuguggaugucucccaugaggacccggaagugaaauucaauugguauguagauggcguugaggugcacaacgcgaagacaaaaccucgggaggaacaauacaauucuaccuaucgcgucgugagcguccucacgguguuacaucaggacuggcugaacgggaaggaguacaaaugcaagguuucaaauaaagcacuucccgccccaauugaaaagaccaucaguaaggcuaaaggacagccuagagagccccagguguauacauugccacccuccagggaagagaugacuaagaaccaaguaagccugaccugucuagucaaagguuuuuacccuucugacauugccguggagugggaaucaaauggccagccagagaacaauuacaagacaacuccgcccguucucgauagugacgggagcuucuuucuguauuccaaacuuaccguggauaagucucgguggcagcaaggaaacgucuucucgugcagcgugaugcacgaagcacugcacaaccauuacacacagaaguccuugucacucaguccuggcaaa

SEQ ID NO: 23223 - RNA, 642 nt, Artificial Sequence
  derived and/or modified sequence opt3 from Fibatuzumab_LightChain1
gacauccagaugacccaaagccccuccuuccugucugccucagugggcgauagagucacaauuacuugcagggcuagucaggggauaaucagcuaccucgcaugguaucagcagaagccugagaaagccccaaagcggcuuauuuacgcggcuuccucucugcaaucgggaguuccgucacgcuuuagcgguaguggcuccgggacggaguucaccuugacaaucucuagcuuacagcccgaagacuuugccacuuauuacuguggacaguaugcaaacuacccuuauaccuucggccaggguacaaaacuggaaauuaagcgaaccguggccgcuccauccguauuuaucuuucccccuucagaugagcaacuaaaaagugggacugcaagcguggucugccuccugaauaacuucuacccacgugaagccaaggugcaguggaagguugacaaugcccuucagucuggaaacucccaggagucagugacagagcaagauagcaaagacaguaccuacucucuguccagcacguugacucucucgaaggcugauuaugaaaaacacaaggucuacgcgugugaggugacccaucagggccugucuucccccguaacaaaaucauucaauagaggcgaaugc

SEQ ID NO: 23224 - RNA, 1344 nt, Artificial Sequence
  derived and/or modified sequence opt3 from Ficlatuzumab_HeavyChain1
caggugcaacugguccagcccggcgccgagguuaagaaaccugggaccagcgugaagcucuccugcaaggcuucuggauacacauucacuacguauuggaugcacuggguaagacaggcaccaggucagggccuugaauggaucggggagauuaacccgaccaauggacauacaaacuacaaucaaaaauuucagggcagggccacucugaccguggacaaaucaacaaguaccgcguauauggaauugagcuccuuacggucugaggauacugcugucuacuauugugcccgcaacuacguggguucgauauucgacuauugggggcagggaacacugcuaaccguuucaagcgcaaguacgaagggccccuccguguuuccucucgccccaucuagcaaguccacuucaggcgggaccgcugcacugggaugccuugucaaagauuacuuccccgaaccugugacaguaaguuggaauagcggugcccugacuucuggcguucacaccuuuccagcuguguugcaguccucagggcucuacagccugaguucugucgugacagugcccuccagcucgcugggaacccaaacguauaucuguaacgucaaucauaagccuucuaacacuaaaguugacaagcgaguggagccaaaauccugcgauaagacacacaccuguccgcccugcccugccccagagcucuuaggcggucccucaguauuccuguuuccuccaaagcccaaagacacucuuaugauuagucguacaccggaagugaccugugucgugguugaugugagccaugaggacccugaagucaaguucaauugguacguggaugggguagagguucacaacgcgaaaacgaagcccagagaggaacaguauaauuccaccuacaggguggucucuguguugacaguccugcaccaggacuggcuaaacggaaaagaguauaagugcaaagugagcaauaaggcacucccagccccuaucgaaaagacuauuucaaaagcuaagggccagccccgggagccacaaguuuacacccugcccccuagucgcgaagagaugacuaaaaaccaggugucccuuacaugucugguaaagggcuuuuauccaagcgauaucgccgucgagugggaaucuaaugggcagccggagaacaacuacaaaaccacacccccuguguuggacucagauggaaguuucuuucucuacagcaagcugaccguugacaaguccagauggcaacaggguaauguguucucuugcucggucaugcaugaagcauuacacaaccauuauacucagaaaagccugucccucucaccaggcaag

SEQ ID NO: 23225 - RNA, 1341 nt, Artificial Sequence
  derived and/or modified sequence opt3 from Ficlatuzumab_HeavyChain
gugcagcugguccaacccggcgccgagguuaagaaaccugggaccagcgugaagcucuccugcaaggcuucuggauacacauucacuacguauuggaugcacuggguaagacaggcaccaggucagggccuugaauggaucggggagauuaacccgaccaauggacauacaaacuacaaucagaaauuucaaggcagggccacucugaccguggacaaaucaacaaguaccgcguauauggaauugagcuccuuacggucugaggauacugcugucuacuauugugcccgcaacuacguggguucgauauucgacuauugggggcagggaacacugcuaaccguuucaagcgcaaguacgaagggccccuccguguuuccucucgccccaucuagcaaguccacuucaggcgggaccgcugcacugggaugccuugucaaagauuacuuccccgaaccugugacaguaaguuggaauagcggugcccugacuucuggcguucacaccuuuccagcuguguugcaguccucagggcucuacagccugaguucugucgugacagugcccuccagcucgcugggaacccagacguauaucuguaacgucaaucauaagccuucuaacacuaaaguugacaagcgaguggagccaaaauccugcgauaagacacacaccuguccgcccugcccugccccagagcucuuaggcggucccucaguauuccuguuuccuccaaagcccaaagacacucuuaugauuagucguacaccggaagugaccugugucgugguugaugugagccaugaggacccugaagucaaguucaauugguacguggaugggguagagguucacaacgcgaaaacgaagcccagagaggaacaauauaauuccaccuacaggguggucucuguguugacaguccugcaccaggacuggcuaaacggaaaagaguauaagugcaaagugagcaauaaggcacucccagccccuaucgaaaagacuauuucaaaagcuaagggccagccccgggagccacagguuuacacccugcccccuagucgcgaagagaugacuaaaaaccaagugucccuuacaugucugguaaagggcuuuuauccaagcgauaucgccgucgagugggaaucuaaugggcagccggagaacaacuacaaaaccacacccccuguguuggacucagauggaaguuucuuucucuacagcaagcugaccguugacaaguccagauggcagcaagguaauguguucucuugcucggucaugcaugaagcauuacacaaccauuauacucagaaaagccugucccucucaccaggcaag

SEQ ID NO: 23226 - RNA, 642 nt, Artificial Sequence
  derived and/or modified sequence opt3 from Ficlatuzumab_LightChain1
gacaucgugaugacccagagccccgauucccuggccaugucucucggcgagagagucacacuuaacugcaaggcuucagaaaauguugugaguuacguaagcugguaucaacagaaaccugggcaguccccaaagcuguugauuuacggagcaucuaacagggagucgggugugccggaccgguucucaggcagcgggagugccacugauuuuacguuaaccauauccucuguccaggcggaagacguggcugauuaucacuguggacaaagcuacaauuaucccuacacauucggccaggguacuaaacuggagaucaagcgcaccguugccgcaccuuccguguuuauuuucccacccucagacgaacagcuaaaaagugggacagccagcgucgugugccuccugaacaauuuuuauccucgagaggcuaagguacaguggaagguugauaacgcacuucaaucuggaaauucccaggagucagugaccgaacaggacagcaaagauaguacuuacucucuguccagcacauugacccucucgaaggccgacuacgagaaacauaaggucuaugcuugugaagugacgcaccagggccugucuuccccagugacuaaaucauucaaccguggcgagugc

SEQ ID NO: 23227 - RNA, 1350 nt, Artificial Sequence
  derived and/or modified sequence opt3 from Figitumumab_HeavyChain1
gaggugcagcugcucgaaagcggcgggggacuuguccaacccgguggcucccugagauugucuugcaccgccucaggguucacauuuaguagcuacgcuaugaacuggguuaggcaggcaccuggaaagggcuuagaguggguguccgccaucucugguucagggggaacuacguucuaugcggacucgguaaaaggccgguuuaccauuagccgcgauaauagucgaacaacucuguaccuacagaugaacucccuccgugcugaagacaccgccguguauuacugugcaaaggaucugggcuggucugacagcuauuacuauuacuacgggauggaugucuggggacaggguacaaccgugacuguuuccucagccaguacaaaaggcccaagcguguucccgcuugcucccugcucuagauccaccucagagagcacggcagcccugggguguuuggucaaggacuauuuuccugaaccagugacuguaaguuggaacucuggagcucucaccuccggcguucacacauuccccgccgugcugcaaagcucgggucuguacucucucuccucagucgugacugugccuaguagcaauuuugggacccagacauauaccugcaaugucgaucauaaaccauccaacacgaagguugacaagacuguggagaggaaauguugcguagagugucccccuugcccagcgccgcccguggcaggaccuucugucuucuuauuuccacccaagccuaaagauacacugaugauaagccggaccccagaagugacuuguguuguggucgacgugucacacgaggaucccgaaguacaguucaauugguacguugacggcguggagguccauaacgccaagacaaaaccgcgcgaggaacaguuuaauaguaccuucagaguggucuccgugcuuacgguugugcaccaagauugguugaacggcaaggaguauaagugcaaaguaagcaauaaggggcugccugcucccaucgagaaaaccauuucuaagacaaaaggacagccaagggaaccucaggucuacacucuacccccaucacgggaagagaugaccaagaaccaggugagucucacaugucugguuaaagguuuuuaucccagcgacaucgccguggagugggaauccaauggccaaccugagaacaauuacaagacuaccccaccgaugcuugacucugaugggucguucuuccuguacagcaaguugacagucgacaaaucccgcuggcagcagggaaacguguuuucaugcaguguaaugcaugaagcacuccacaaccacuauacccaaaagucucugagcuuaucccccggc

SEQ ID NO: 23228 - RNA, 642 nt, Artificial Sequence
  derived and/or modified sequence opt3 from Figitumumab_LightChain1
gacauccagaugacccaauuccccagcucccugucugccucagugggcgauagagucacaauuacuugcagggcuagucaggggauacggaacgaccucggaugguaccagcagaagccugguaaagcaccaaagcgccuuaucuaugccgcgagccgacugcaccguggcguuccguccagauuuucugggucgggaucaggcacggaguucaccuugacaauuagcaguuuacaacccgaagauuuugcuacuuacuauugucugcagcauaauuccuacccuugcucuuucggucaggggaccaaacuagagaucaagaggacaguggccgcaccaagcguauuuauuuuucccccuuccgacgaacagcucaaaucaggaaccgccaguguggucugucugcuuaacaauuucuauccacgggaggcuaaggugcaauggaagguugauaacgcacugcagagcggcaauucucaggaauccgugacugagcaggacucaaaagauagcacauacaguuugucuuccacccucacgcugagcaaggccgacuaugagaaacacaaggucuacgcuugcgaagugacucaucaaggccugucgucucccguaaccaaauccuucaaccgcggggagugu

SEQ ID NO: 23229 - RNA, 1359 nt, Artificial Sequence
  derived and/or modified sequence opt3 from Firivumab_HeavyChain1
caggugcaacugguccagagcggcgccgagguuaagaugcccggguccucugugaaaguaucaugcaagaccaguggaguguucuuuagcucccacgcuaucucuugggucagacaggcaccuggucagggccucgaauggaugggagggauuucgccaauguucggcacaacucauuacgcccaaaaauuucaggguagggugacgauaaccgcggaccagucaacaacuaccgcuuauauggagcuuacaagccugaccagugaagauacugccguuuacuauugugcacgggacggggccggauccuacuauccguugaacugguucgaucccuggggccagggcacauuagugaccgucucuagcgcuuccacgaaggggccuucaguguuuccacuggcacccaguagcaaaucuacuuccggagguaccgccgcucuaggcugccucguaaaggacuacuucccugagccaguuacagugucauggaauagcggggcccugacaaguggaguccacaccuuucccgcggugcuucaaucuuccggccuguauagcuugucgucuguggucacaguuccuuccucaagucucgguacccagacguacaucuguaacgugaaucauaagccaagcaacacuaaaguagauaagcgcguggaaccgaaauccugcgacaagacacacaccugucccccuugcccagcacccgagcugcucgggggaccuucugucuuccuguuuccacccaaaccgaaggauacuuuaaugauuagccgaacaccugaggugaccuguguuguggucgacgugucacaugaagaucccgagguaaaguucaauugguacguugacggcguggaaguccacaacgccaaaacgaagccacgugaggagcaguauaauaguaccuacagaguggucuccgugcugacaguucuucaccaggauugguugaacggcaaagaauauaagugcaaagugagcaauaaggcucugccugcccccaucgagaaaacuauuucuaaggcaaaggggcaaccaagggaaccccagguauacacccuaccuccaucacgggacgagcucacuaaaaaccaggucagucugacuugucuugugaagggauuuuauccgagcgauaucgcuguugaaugggaguccaauggucaacccgagaacaauuacaaaaccacaccuccagugcuggacucugacggcucguucuuuuuguauagcaagcucaccgucgauaaaucccgcuggcagcaggggaacguguucucaugcaguguaaugcaugaaggacugcacaaucauuacacucagaagucuuuaagccugucccccggcaag

SEQ ID NO: 23230 - RNA, 642 nt, Artificial Sequence
  derived and/or modified sequence opt3 from Firivumab_LightChain1
gagaucgugcugacccagagccccgccacacucucccuuucuccuggcgaaagagcuacucugucaugcagggcaagugagaacauuuggaauaacuuggccugguaccaacagaagccagggcaggcgccgcgguuacugauaagcggagcuuccacgggugccaccggcguccccucucgcuuccgagggucgggaucacguacagaauuuacucuaaccaucagcagucuccaguccgaggacuucgcaauuuauuuuugucaacaguacaauucuuggccuagaacauucggcccagguaccaaaguugaaaucaagaggacuguggccgcucccagcguauuuauuuucccuccauccgaugagcagcugaaaucagggacagcaaguguggucugccuucugaacaauuuuuauccccgggaggccaaggugcaguggaaaguugacaacgcuuugcaaagcggaaauucucaggaauccgugaccgagcaggauucaaaggacagcacguacagucucucuuccacucugacccugagcaaggccgauuaugaaaaacacaaggucuacgcgugugaggugacacaucagggccucucgucuccuguaacuaaauccuucaaccgcggcgagugc

SEQ ID NO: 23231 - RNA, 1347 nt, Artificial Sequence
  derived and/or modified sequence opt3 from Flanvotumab_HeavyChain1
caggugcaacugguccagagcggcuccgagcucaagaaacccggggccucuguuaagaucucaugcaaagcuaguggauacaccuucacaagcuaugcaaugaacugggugagacaggccccuggucagggccuugaauccaugggguggauuaauacuaacacgggaaauccaaccuacgcgcaaggcuuuacagguagguucguauuuucuauggacacuucggugucaaccgcuuaucugcagauaagcaguuugaaggccgaggauacagcaaucuacuauugugccccgcgguacuccucuagcugguauuuagacuacugggggcagggaacccuggucacuguguccucagcuaguacaaaaggccccagcguuuucccucuagcaccaucuuccaagucaaccagcggcgggacggccgcucucggaugccuggugaaggauuacuuucccgaaccugucacugugaguuggaacucuggugcccuuaccuccggcguacacacauucccagcgguucugcagagcucgggguuguauucucucuccucaguggucacugugcccaguagcucccugggaacccaaacauacauuuguaaugugaaccauaaaccuucuaauaccaaggucgacaaacgcguugagccaaagagcugcgauaaaacgcacacuuguccgcccugcccugcaccagaacugcucggcggucccucaguguuuuuauucccuccaaagcccaaggacacacugaugaucagucgaaccccggagguaacuuguguggucguggauguuucccaugaggacccugaagugaaauuuaacugguaugucgaugggguggagguacacaaugccaagacaaaaccccgugaggaacaguacaacagcaccuauagaguugugucuguccuuacgguguugcaucaggacuggcugaauggaaaggaguacaaaugcaaggucucaaacaaagcucuaccagccccuauugaaaagaccaucaguaaggcaaaaggccagcccagggagccacaaguguauacacugcccccuagccgggaagagaugacuaagaaucagguuucccucaccugucuugugaaaggcuucuacccaucugauauagcuguagaaugggagucgaacgggcagccggagaauaacuacaagacaacucccccuguccuggacagcgauggauccuuuuucuuguauucaaaacucaccguggacaagagucgcuggcaacaggguaacguguuuucuugcagcguuaugcacgaagcccugcacaaucauuacacacagaaguccuuaucacugagcccaggcaaa

SEQ ID NO: 23232 - RNA, 645 nt, Artificial Sequence
  derived and/or modified sequence opt3 from Flanvotumab_LightChain1
gagaucgugcugacccagagccccgccacacucucccuuucuccuggcgaaagagcuacucugucaugcagggcaagucaaagcgucuccucuuacuuggccugguaucagcagaagccagggcaggcgccgcgguuacugauuuacgacgcuucgaaccgcgccacgggaauacccgcacgauucucagguagcggcagugggaccgauuuuacacuaacuaucuccucucucgagccugaagacuucgccguuuauuacugucaacagcguagcaauuggcugauguauaccuuuggacagggcacaaaacuugagauuaagagaaccguggcugcaccauccguauucaucuuucccccuucagaugaacagcugaaaagugguacugccagcguggucugcuugcucaacaauuucuacccaagggaggcuaaggugcaauggaaaguugacaacgcccugcagucuggaaauucccaggagucagugacagaacaggauagcaaggacaguaccuauucucuguccagcacgcucacuuuaucgaaggcggauuacgagaaacacaaggucuacgcaugugaagugacccaucaagggcugucuucccccguaacaaaaucauuuaaccggggcgagugc

SEQ ID NO: 23233 - RNA, 1362 nt, Artificial Sequence
  derived and/or modified sequence opt3 from Fletikumab_HeavyChain1
caggugcaacugguccagagcggcgccgagguuaagagacccggggcuuccgugaaaguaucuugcaaggcaucaggauacaccuucacaaacgacaucauucacugggugaggcaggccccuggucagcggcucgaauggaugggcuggauaaaugcgggguauggaaacacucaauacagucagaauuuucaggaucgcgucagcaucacgcgagacaccuccgcuucuacagccuauauggagcuuauuucgcugcguucagaagauacugcaguguacuauugugccagagagccauugugguucggcgaaagcaguccgcaugacuacuaugguauggauguuugggggcagggaaccacagugaccgucuccucugcuagcacuaaaggccccuccguguuuccuuuagcaccaugcucaaggaguacaagcgagucuaccgccgcucugggcugucuaguaaaggacuacuuccccgagccuguuacgguguccuggaacucaggggcccucacuagcggaguccacaccuuuccagcggugcugcaaaguucuggucuuuacucccugagcucgguggucacaguucccucuuccucauugggcacuaaaaccuauacaugcaauguggaucauaagccuaguaacaccaagguagacaaacggguggaaagcaaguacgggccaccgugucccccuugcccagcacccgaguuccucggaggcccuuccgucuuucuguucccacccaaaccgaaggauacgcugaugaucucucgcacuccugaagugacauguguuguggucgacgugagccaggaggaucccgagguacaguuuaauugguauguugacgguguggaaguccacaacgccaaaaccaagccaagagaggaacaguucaauucaacuuacaggguggucagugugcucacaguuuuacaucaagauuggcugaacgggaaggaguauaaaugcaagguguccaauaaaggacuuccuagcucuauugaaaagaccaucucaaaagcuaagggccagccccgggagccacagguauacacguugcccccuagucaagaggaaaugaccaaaaaccaggucagccugacaugucuagugaagggcuuuuauccauccgacauagccguugagugggaaucuaaugggcagccggagaacaauuacaagacuacacccccugugcucgacucggaugguagcuucuuucuguacucccgccuuaccgucgacaaaucacgauggcaggaaggaaacguguucaguugcucuguaaugcacgaggcacugcacaaccauuauacucaaaagagcuugucccucucacugggcaaa

SEQ ID NO: 23234 - RNA, 642 nt, Artificial Sequence
  derived and/or modified sequence opt3 from Fletikumab_LightChain1
gccauccagcugacccaaagccccuccucucucucagcuagugugggcgacagagucacaauuacuugcagggcaagccaggggauauccucugcccuugcgugguaccagcagaagccuggaaaagcuccaaagcuguugaucuaugaugccucgucauuagagagcgguguuccgagucgguucuccggcucugggagcggaacggacuuuacccugacaauuuccucacuacaacccgaagauuucgcaacuuacuauugucagcaguuuaacaguuacccucucaccuucggcggugggacaaaaguggagaucaagcgcaccguagccgcuccaagcguguuuauuuuucccccuucugacgaacagcugaaauccggaacugcaucagucgugugccuucugaauaacuucuauccacgagaggccaagguucaauggaagguggauaaugcuuugcagagcggcaacagucaggaaucugucacagagcaggacuccaaagauagcaccuacucgcucucuuccacgcugacucugucaaaggccgacuaugagaaacacaagguguacgcgugugaaguaacccaucaaggccucaguagccccguuacaaaauccuucaaucguggggagugc

SEQ ID NO: 23235 - RNA, 1341 nt, Artificial Sequence
  derived and/or modified sequence opt3 from Fontolizumab_HeavyChain1
caggugcaacugguccagagcggcgccgagcucaagaaacccggguccucuguuaaggugucaugcaaagcuaguggauacaucuucaccagcuccuggauuaacuggguaaagcaggcaccuggucagggccuugaauggauagggagaaucgacccaucugauggagaggugcacuauaaucaagacuuuaaagauaaggccacacugacugucgacaagucgacgaacaccgcguacauggaauugucuagcuuaaggagugaggauacagcuguguauuacugugcccggggcuuccugccgugguuugcagacuggggucaggggacucuaguuaccguguccucugccagcacaaaaggacccuccgucuucccucucgcuccaucaaguaagagcaccucuggcggcacugcagcccuggggugccuugugaaagauuauuuucccgaaccuguaacaguuuccuggaacucaggagcucugaccagcggugugcauacguucccagccgucuugcagaguucuggccucuacucccugagcucgguggugacuguccccucuuccucacuggggacccagacauauauuuguaauguuaaucacaagccuaguaacacuaaaguggacaagaagguagagccaaaaagcugcgauaagacccauacauguccgcccugcccugcgccagagcucuuaggaggccccuccguguuucuguucccuccaaaacccaaggacacccuuaugaucucucgcacgccggaagucacuugugugguuguggaugucagccacgaggacccugaagugaaauuuaauugguacguagaugguguugaggugcauaacgcaaagacaaaaccccgagaggaacaauacaauucaaccuaucgugucgugagugucuugacugugcugcaccaggacuggcuaaacgggaaggaguacaagugcaaaguuuccaauaaggcccucccagcuccuauugagaaaacaaucagcaaggccaaaggacagcccagagaaccacagguguauacccugcccccuucuagggacgaacuuacgaagaaccaaguaucacugaccuguuuggucaagggcuucuacccaagugauauagcaguggagugggagagcaauggccagccggaaaacaauuauaaaacaacucccccuguucucgacuccgaugggucauuuuuccuguacucgaaguuaaccguggacaaaagccgguggcagcaaggaaacgucuuuuccugcucagugaugcacgaggcucugcauaaccacuauacacagaagagucucucucuuagcccagguaaa

SEQ ID NO: 23236 - RNA, 642 nt, Artificial Sequence
  derived and/or modified sequence opt3 from Fontolizumab_LightChain1
gacauccagaugacccaaagccccuccacacugucugccucagugggcgauagagucacuauuacgugcaaggcuagugagaacguugacaccuacgugagcugguaucagcagaaaccugggaaggcaccaaaacuccuuauauacggagccuccaauagguauacagguguaccgucucgguucucgggcucagggagcggaacugauuuuacccugacaaucaguuccuugcagcccgacgauuucgcgaccuacuauuguggccaaucuuacaacuauccuuuuacuuucggucaggggacaaagguggaagucaaacgcaccguggcugccccaagcguuuuuauuuuucccccuuccgacgagcaguuaaagucaggaacggcaaguguggucugccugcuaaauaacuucuacccacgagaagccaaggugcaguggaaaguagauaaugcucuccaaagcggcaacucucaggaguccguuacugaacaggacucaaaggauagcaccuacagucugucuuccacacuuacucugagcaaagcagacuaugagaagcacaaaguguacgccugugaggucacccaucagggcuugucgucucccgugacaaaguccuucaaucguggggaaugc

SEQ ID NO: 23237 - RNA, 1344 nt, Artificial Sequence
  derived and/or modified sequence opt3 from Foralumab_HeavyChain1
caggugcaacuggucgagagcggcgggggaguugugcagcccgguagaucccucaggcuuucuugcgccgcuucaggcuucaaguuuaguggguacggaaugcacuggguacggcaggcaccuggcaaaggucuggaauggguggccgucaucugguaugacgggagcaagaaauacuauguggauuccguuaagggacgcuucaccauuucucgagacaacucgaaaaauacauuguacuuacagaugaacucacugcgugcggaggauacugcuguguauuacugugccagacaaaugggcuauuggcauuuugaccuauggggcagggggacgcucgucaccgugagcagugcauccacaaagggaccaucuguauucccgcuggcccccagcuccaagucaacuucugguggcaccgcugcacuugggugccugguuaaagauuacuuuccugaaccagugacagucagcuggaauaguggagccuugaccuccggcgugcacacuuuccccgcugugcuccagucaagcggucuguacagucugucuuccgucguuacagugccuagcucgucucucgggacccagacguauauauguaacguaaaucauaagccauccaacacuaaaguggacaagcgggucgagcccaaaucaugcgauaagacccacacauguccuccaugcccggcccccgaagcggagggaggcccuaguguguuuuuauucccacccaagccuaaagacacucugaugaucagccgcaccccagagguuacauguguggucguggauguaucccaugaagaccccgagguuaaguuuaauugguacguggauggcgucgaagugcacaacgcaaaaaccaagccgagagaggagcaguauaauucuacguacagggucgugagcguucuuacuguguugcaccaagacuggcugaacgggaaagaauauaagugcaaaguaucaaauaaggcccuaccugcucccauugagaagacaaucaguaaagccaagggacagccacgggaaccucaggucuacacccugcccccaucccgcgaggaaaugacuaaaaaccaggugagccucacaugucuuguuaaggguuucuaucccucugauauugcaguggagugggagucaaauggccaaccugaaaacaauuacaaaaccacgccaccgguccuggacagugacgggagcuuuuucuuguacuccaagcucaccguggauaagucucgauggcagcagggaaacguauuuucgugcagcgugaugcaugaggcucugcacaaccauuauacacaaaaauccuuaucacugagucccggcaag

SEQ ID NO: 23238 - RNA, 645 nt, Artificial Sequence
  derived and/or modified sequence opt3 from Foralumab_LightChain1
gagaucgugcugacccagagccccgccacacucucccuuucuccuggcgaaagagcuacucugucaugcagggcaagucaaagcgucuccucuuacuuggccugguaucagcagaagccagggcaggcgccgcgguuacugauuuacgacgcuucgaaccgcgccacgggaauacccgcacgauucucagguagcggcagugggaccgauuuuacacuaacuaucuccucucucgagccugaagacuucgccguuuauuacugucaacagcguagcaauuggccaccccugaccuuuggaggcgguacaaaaguggagauuaagagaaccguagcugcaccuuccguguucaucuuuccacccucagaugaacagcuuaaaagugggacugccagcgucgugugccuguugaacaauuucuauccuagggaggcuaagguucaguggaaaguggacaacgcccuccaaucuggaaauucccaggagucagucacagaacaggauagcaaggacaguaccuacucucuguccagcacgcugacucucucgaaggcggauuaugagaaacacaagguguacgcaugugaaguaacccaucagggcuuaucuuccccaguuacaaaaucauuuaaccggggcgagugc

SEQ ID NO: 23239 - RNA, 1344 nt, Artificial Sequence
  derived and/or modified sequence opt3 from Foravirumab_HeavyChain1
caggugcaacuggucgagagcggcgggggagccguucagcccgguagaucccucaggcuuucuugcgcugcaucaggcuucaccuuuaguagcuacgggaugcacugggugcggcaggccccuggaaagggccuggaauggguagcggugaucuuguaugacgguuccgauaaauucuacgcugacucugucaaggggcgcuuuacaauuucgcgagauaacagcaaaaauacuuuauaucugcagaugaacucacuacgugccgaggacacggcaguguacuauugugccaagguugcuguggcaggaacccauuucgauuacuggggccaaggcacacucgucacugugaguuccgccucuaccaaagggccaagcguauuuccgcuggcucccuccucaaagaguacaagcggagguaccgccgcgcuuggcugccugguuaaggacuauuucccugaaccagugacugucucuuggaacuccggggcauugacaucaggagugcacaccuuucccgccgugcuccagagcaguggccuguacucucuguccagcgucguuacggugccuucgucuucccucgguacucagaccuacauauguaauguaaaucauaaaccaucaaacacaaagguggauaaaagagucgagcccaagaguugcgacaaaacucacaccuguccuccaugcccggcucccgaauuacuugggggaccuagcguguuccuguuuccacccaagccuaaggauacauugaugaucuccaggaccccagagguuacguguguggucguggacguaucucaugaggaucccgaaguuaaauucaauugguauguggacggcgucgaggugcacaacgccaagacuaaaccgcgggaggaacaguacaauagcacauaucgcgucgugucaguucugaccgugcuacaccaagauuggcucaacggcaaggaguacaaaugcaagguaaguaauaaagcacugccugcucccauugaaaagacuaucuccaaggccaaagggcagccaagagagccucaggucuauacacuucccccaagcagggaagagaugaccaagaaccaggugucucugacguguuugguuaaaggauuuuaccccucagacauugcgguggaaugggagaguaauggucaaccugagaacaauuauaagaccacaccaccgguccucgacagcgauggcuccuucuuucuguacucuaaauuaacuguggacaagucgcgguggcagcaggggaacguauucagcugcuccgugaugcaugaagcccugcacaaccauuacacccaaaagucacucagucuuucucccgga

SEQ ID NO: 23240 - RNA, 1344 nt, Artificial Sequence
  derived and/or modified sequence opt3 from Foravirumab_HeavyChain
gaggugcagcuggucgaaagcggcgggggagccguucaacccgguagaucccucaggcuuucuugcgcugcaucaggcuucaccuuuaguagcuacgggaugcacugggugcggcaggccccuggaaagggccuggaguggguagcggugaucuuguaugacgguuccgauaaauucuacgcugacucugucaaggggcgcuuuacaauuucgcgagauaacagcaaaaauacuuuauaucugcagaugaacucacuacgugccgaagacacggcaguguacuauugugccaagguugcuguggcaggaacccauuucgauuacuggggccagggcacacucgucacugugaguuccgccucuaccaaagggccaagcguauuuccgcuggcucccuccucaaagaguacaagcggagguaccgccgcgcuuggcugccugguuaaggacuauuucccugagccagugacugucucuuggaacuccggggcauugacaucaggagugcacaccuuucccgccgugcuccaaagcaguggccuguacucucuguccagcgucguuacggugccuucgucuucccucgguacucagaccuacauauguaauguaaaucauaaaccaucaaacacaaagguggauaaaagagucgaacccaagaguugcgacaaaacucacaccuguccuccaugcccggcucccgaguuacuugggggaccuagcguguuccuguuuccacccaagccuaaggauacauugaugaucuccaggaccccagagguuacguguguggucguggacguaucucaugaagaucccgagguuaaauucaauugguauguggacggcgucgaagugcacaacgccaagacuaaaccgcgggaggagcaguacaauagcacauaucgcgucgugucaguucugaccgugcuacaccaggauuggcucaacggcaaggaauacaaaugcaagguaaguaauaaagcacugccugcucccauugagaagacuaucuccaaggccaaagggcaaccaagagaaccucaggucuauacacuucccccaagcagggaggaaaugaccaagaaccaggugucucugacguguuugguuaaaggauuuuaccccucagacauugcgguggagugggagaguaauggucagccugaaaacaauuauaagaccacaccaccgguccucgacagcgauggcuccuucuuucuguacucuaaauuaacuguggacaagucgcgguggcaacaggggaacguauucagcugcuccgugaugcaugaggcccugcacaaccauuacacccagaagucacucagucuuucucccgga

SEQ ID NO: 23241 - RNA, 642 nt, Artificial Sequence
  derived and/or modified sequence opt3 from Foravirumab_LightChain1
gacauccagaugacccaaagccccuccucucugucagccagugugggcgauagagucacaauuacuugcagggcuagccaggggauacggaacgaccucggaugguaccagcagaagccugguaaagcaccaaaacuucugaucuaugccgcguccucuuugcaaucgggcguuccgucacgcuucagcgggaguggauccggcacggauuuuaccuuaacaauuucuagccugcagcccgaggacuucgcuacuuacuauugucagcagcuaaauuccuacccuccaaccuuuggugggggaacaaagguggaaaucaagcgaaccguagccgcacccucaguguucauuuuuccuccaagugaugagcaacucaaaagcggcacugccucugucgugugccugcuuaacaauuucuauccccgugaagcuaagguucaguggaagguggacaacgcacugcaguccggcaauucacaggagagcgucacagaacaagauaguaaagacucuaccuacuccuugagcucgacgcucacucugucuaaggccgauuaugagaaacacaagguguacgcuugugagguaacccaucaggggcuguccucaccuguuacaaaaaguuuuaacagaggagaaugc

SEQ ID NO: 23242 - RNA, 1341 nt, Artificial Sequence
  derived and/or modified sequence opt3 from Fresolimumab_HeavyChain1
caggugcagcugguccagagcggcgccgagguuaagaaacccggguccucugugaagguaucaugcaaagcuaguggauacaccuucagcuccaacgugaucucuugggucagacaggcaccuggucagggccucgaauggaugggaggggugauuccaauaguugacaucgccaauuaugcgcaaagguuuaagggccgggugacaauuacugcugaugagucgacgucaaccacauacauggaacuuagcagucugcgcuccgaggacacugccgucuauuacugugcaucuaccuuggguuuagugcuggaugccauggacuauugggggcagggaacacucguaaccguuagcuccgcuucaacuaaaggcccgaguguguucccccucgcaccuugcagccgaucuacauccgaaucaaccgccgcucugggcugucuugucaaggauuacuuuccagagcccgugacggugagcuggaacaguggggcccugacuucuggaguccacaccuucccugcgguuuugcaguccagcggucucuauucgcugucuuccgugguaacagugccaucaaguagccugggcacuaagaccuacacaugcaaugucgaccauaaacccuccaacaccaagguggauaaacguguugagucuaaguacgggccuccauguccgagcugccccgcaccugaauuucucggaggcccaucaguguucuuauuucccccuaaaccaaaggacacgcugaugaucaguagaacucccgaggucacaugugugguaguugaugugucccaggaagacccggagguccaauucaauugguauguggauggugucgaggugcacaacgccaagaccaaaccuagggaggaacaguuuaauagcacuuaccggguugugucuguacuuacagucuugcaucaggacuggcugaacgggaaggaauauaaaugcaaggugucaaauaaaggacuacccaguagcauugagaagaccaucuccaaagcuaagggccagccacgcgaaccucaaguuuacacgcuacccccaucucaggaggagaugaccaagaaccaggugucgcugacaugucuugucaaaggcuucuaucccagcgauauagccguggaaugggaguccaaugggcaaccugaaaacaauuacaagacuaccccaccgguacuggacucagacggaaguuucuuuuuguauucuagacucacaguggauaaauccagguggcaggaggguaacguuuuuagcugcucagucaugcacgaagcacugcauaaucacuacacucaaaagagcuuaucucugucccucggcaaa

SEQ ID NO: 23243 - RNA, 645 nt, Artificial Sequence
  derived and/or modified sequence opt3 from Fresolimumab_LightChain1
gagaccgugcugacacagagccccggcacucucucccuuucuccuggggaaagagccacgcugucaugcagggcuagucagagcuugggauccucuuacuuagcaugguaucaacagaagccaggucaggccccgcggcugcuaaucuacggcgcgucgucacgcgcucccgggauuccugaccgauucagcggaaguggcuccgguaccgauuuuacacucacuauaucucgucuggagccagaagacuucgccgucuauuacugucaacaguaugcagauagccccaucaccuuugggcagggaacaagacuugagauuaaaaggaccguugccgcuccuuccguguucaucuuuccacccucagacgaacagcugaagaguggcacugcaagcguagugugcuugcucaacaauuucuacccucgggaggccaaaguccaauggaagguggauaacgcucugcagucuggcaauucccaggagucaguuacagaacaggacagcaaagauaguaccuauucucuguccagcacgcucacuuuaucgaaggccgacuacgagaagcacaaaguguacgcgugugaagucacccaucaagggcugucuuccccagugacaaagucauuuaaccgcggagagugc

SEQ ID NO: 23244 - RNA, 1347 nt, Artificial Sequence
  derived and/or modified sequence opt3 from Fulranumab_HeavyChain1
gaggugcagcuggucgaaagcggcgggggacucguucaacccgguggcucccuuagacugucuugcgccgcuucaggguucaccuugaggaguuacagcaugaacugggugcggcaggcaccuggaaagggcuuagaguggguauccuauaucucucgcucgucacacacaauauuuuacgccgacagcgugaaaggucgauucacuauuagucgugauaaugcgaagaacucccuguaucuacagauggacucucucagagaugaagacacggcuauguacuauugugccagggucuacagcuccggguggcaugugucagauuauuuugacuacuggggacagggcauccugguuaccgugaguagcgcaucuacaaaaggcccauccgucuucccgcuugcccccugcucacggagcaccagugagucuacugcugcacugggguguuuggugaaggauuacuuuccugaaccaguaacaguuuccuggaauagcggagcccucaccucgggugugcacacuuuccccgcuguccugcaaucuuccggccuguauucacucaguagcguggugacagucccuuccucuaacuuugggacccagacguacacuugcaauguugaccauaaaccaagcaacaccaagguggauaagacaguagagcgcaaauguugcguggagugucccccuugcccagccccgcccgucgcgggaccuucaguguucuuauuuccacccaagccuaaagacacucugaugauuaguagaaccccagaaguuacauguguggucguggauguaucccacgaggaccccgaaguucaguucaauugguauguggauggcgucgaggugcauaacgcaaagaccaaaccgagggaggaacaguuuaauagcacguuccgggucgugucuguucuuacugugguacaccaagacugguugaacgguaaggaguacaagugcaaagucucaaauaaggggcugccugcccccaucgagaaaacaauuaguaagaccaaaggacagccacgcgaaccucagguguauacucuacccccaagccgagaagagaugacaaagaaccagguuucccucaccugucuggugaaaggcuuuuaccccucugacaucgcugucgagugggaaucgaauggccaaccugagaacaauuauaagacgaccccaccgaugcuugauagcgacggguccuucuuccuguacucaaaguugacaguggauaaaaguagauggcagcagggaaacguauuuucuugcagcgugaugcacgaagcccuccauaaccacuacacucaaaagucccugucauuaagccccgguaaa

SEQ ID NO: 23245 - RNA, 642 nt, Artificial Sequence; identical to SEQ ID NO: 23234
  derived and/or modified sequence opt3 from Fulranumab_LightChain1

SEQ ID NO: 23246 - RNA, 1356 nt, Artificial Sequence
  derived and/or modified sequence opt3 from Futuximab_HeavyChain1
gaggugcagcugcaacagcccggcagcgaacucgucagaccuggggccuccguuaaacuuucuugcaaggcuucaggauacaccuucacaaguuauuggaugcacugggugaagcagaggccaggucagggccuggaguggaucgggaacauuuacccgggaagccgguccacuaauuaugacgaaaaauuuaagucuaaagcaacguugaccguagauacaucgucaagcacugccuacaugcaauuaaguucccugaccucugaggacagcgcgguguauuacuguacacgcaacggcgauuauuacgucuccucaggugacgcuauggauuacugggggcagggaaccagugugacuguuagcucugccuccacaaagggccccucaguguucccucuagcaccaagcaguaagucuaccuccggcgggacggccgcucucggaugccuggucaaagacuauuuucccgaaccugugacuguaagcuggaacucgggugcacuuaccucuggcguucauacauucccagccgugcugcaguccucaggguuguacagucucagcuccgucgugacugugcccucuagcucacugggaacccagacauauauauguaaugucaaucacaagccuaguaacaccaaaguugauaagcgaguggagccaaaauccugcgacaagacgcauacuuguccgcccugcccugcuccagagcugcucggcggucccagcguauuuuuauucccuccaaagcccaaagauacacugaugaucucucguaccccggaagugacuugugucgugguugacgugucacacgaggauccugaagucaaguuuaauugguacguggacgggguagagguucauaacgccaaaacaaagcccagagaggaacaauauaauaguaccuacaggguggucagcgugcuuacggucuugcaccaggauuggcugaacggaaaagaguauaagugcaaaguguccaauaaggcgcuaccagcaccuauugaaaagaccaucucuaaagccaagggccagccccgggagccacagguuuacacacugcccccuucgcgcgaagagaugacuaaaaaccaagugagccucaccugucuuguaaagggcuucuacccauccgacauugcugucgagugggaaucaaaugggcagccggagaacaauuauaaaacaacucccccugugcuggacagugauggaucuuucuuuuuguacagcaagcucaccguugacaaguccagauggcagcaagguaacguguuuucaugcagcgucaugcacgaagcccugcauaaccacuauacacagaaaucuuuaucccugaguccaggc

SEQ ID NO: 23247 - RNA, 642 nt, Artificial Sequence
  derived and/or modified sequence opt3 from Futuximab_LightChain1
gacauccagaugacccaaacaacuagcucccugucugccucacucggcgauagagugacgauuaguugcaggaccagccaggacauagggaacuaccuuaauugguaucagcagaagcccgauggaacagucaaacuguugaucuacuauacuucccgguuacacucugguguuccuucgcgcuucucaggcagcgggaguggaaccgacuuuucccugacaauuaacaauguggagcaagaagauguagcuaccuacuucugucagcauuauaacacugugccaccgacauuuggcggugggaccaagcuagagaucaaacgaacggucgcagcccccucuguguucauuuuuccuccaagcgacgaacagcucaaguccggaacugcgucaguugugugccugcuuaauaacuucuacccccgugaggcuaaaguccaguggaagguggauaaugcccugcaaaguggcaacagccaggaaucuguaaccgagcaggacuccaaggauucaacauauagcuugaguucuacucucacccuguccaaagcagacuacgagaagcacaaaguuuacgccugugaagugacacaucagggccugagcucgccugucaccaagucuuuuaauagaggggagugc

SEQ ID NO: 23248 - RNA, 1335 nt, Artificial Sequence
  derived and/or modified sequence opt3 from Galcanezumab_HeavyChain1
caggugcaacugguccagagcggcgccgagguuaagaaacccggguccucugugaagguaucaugcaaagcuaguggauacaccuucgguaacuauuggaugcagugggugagacaggcaccuggccaagggcucgaauggaugggagccaucuacgagggcacagguaagacugucuauauucagaaauuugcggacagggugacgauaaccgcugauaagagcacauccacugccuacauggaacuuucuucgcugcggucagaggacaccgcaguuuauuacugugcccgcuugagcgauuaugugaguggguucggauacuggggccagggcacaaccgucacuguguccucugcuagcacaaaggggccauccguauuuccguuagcacccugcucacgaaguaccagcgaaucuacggccgcucugggaugucuaguuaaagacuacuucccugagccagugacugucuccuggaauagcggugcccucaccagcggcgugcacacauuucccgcggugcugcagaguucugggcuuuauucccugagcucggucguuacugugccuucuuccucauugggaaccaagacauauaccugcaacguagaucauaaaccaaguaauacgaagguggacaaacgugucgagagcaaguacggucccccuuguccaccgugccccgcaccugaagccgcuggcgggccauccguguuccucuuucccccuaagccaaaagauacucugaugaucucuagaacacccgagguuaccuguguggucguggacguaagccaagaagauccggagguucaguucaacugguacguggacggagucgaggugcacaaugccaagacuaaaccuagggaggaacaguuuaacucaacauaucgggucgugaguguucugaccgugcuccaucaggauugguuaaauggcaaggaauacaaaugcaagguauccaacaaaggccugcccagcucuauugagaagacgaucucaaaggcaaaagggcaaccacgcgaaccucaggucuauacccuucccccaagucaggaggagaugacaaagaaucaagugagcuugacuugucugguuaaaggauucuaccccuccgacauugcuguggaaugggagucuaacggucagccugaaaauaacuacaagaccacaccaccgguccuagauucggacggcagcuuuuuccucuauuccagacugacuguggacaaaucaagguggcaggaggggaauguauuuaguugcucugugaugcacgaagcccuucauaaccacuacacccagaagucacuguccuugucacucgga

SEQ ID NO: 23249 - RNA, 642 nt, Artificial Sequence
  derived and/or modified sequence opt3 from Galcanezumab_LightChain1
gacauccagaugacccaaagccccuccucucugucagccagugugggcgauagagucacaauuacuugcagggcuagcaaggacauauccaaauaccucaacugguaucagcagaagccugggaaagcaccaaaacuucugaucuacuauacgucuggauaccacucggguguuccgucacgguucagcggcaguggguccggaaccgauuuuacauugacuauuucuagcuuacagcccgaggacuucgccaccuauuacugucaacagggcgaugcgcugccuccaacauuuggugggggaaccaagguggaaaucaagcgcacuguagcugcccccuccguguucauuuuuccuccaucagacgagcagcuaaagaguggcacagcaagcgucgugugccuccugaauaacuucuauccccgagaagccaaaguucaguggaagguggauaaugcacuucaaucuggcaacucccaggagucagucaccgaacaggacagcaaagauaguacguacucucuguccagcacuuugacccucucgaaggcugacuacgagaaacauaagguguaugccugugagguaacacaccaggggcugucuuccccuguuacuaagucauuuaaucguggagaaugc

SEQ ID NO: 23250 - RNA, 1371 nt, Artificial Sequence
  derived and/or modified sequence opt3 from Galiximab_HeavyChain1
caagugcaacugcaggagagcggccccgggcucgucaagccuuccgaaacccuuucucugacaugcgccguuucaggagguaguaucagcggcggguacggauggggcuggauuagacagccaccggguaaaggguuggaguggauaggauccuucuauucuucgucaggcaacacuuacuauaaucccagcuuaaagagucaggugacgaucuccaccgacacaucuaaaaaccaauuuagccugaagcuaaauuccaugacugcugcagauaccgccguauacuauugugugagggaccggcuuuucucagucgugggcaugguuuacaacaauugguuugaugugugggggccuggaguccuggugacaguaaguagcgcgucuaccaaagguccauccguuuucccccuugcuccuucaagcaagaguacuucuggcgggacagccgcacugggaugcuuggugaaggacuauuuuccagaacccgucaccguguccuggaacagcggcgcccucacgucgggugugcacacuuucccugcuguccugcagucuuccgggcuguacucacucaguagcguugugaccguaccauccucuagcuuaggaacacagacuuacauuuguaaugugaaccauaaaccgucaaauaccaaggucgauaaaaaggcagagcccaaaaguugcgacaagacacacaccuguccuccaugccccgccccugaacugcuuggcggcccauccguguuuuuguuucccccgaagccuaaagauacgcugaugaucagccgcacucccgagguuacauguguggucguggacguaucucaugaggauccagaaguuaaguuuaacugguauguggacggggucgaggugcacaaugcuaaaaccaagccucgagaggaacaguacaacucaacuuaucgugucgugaguguucuaacagugcuccaucaagauuggcugaauggaaaagaguacaagugcaaaguaagcaacaaggcccuucccgcgccaauugaaaagaccaucuccaaagcaaagggucagcccagagagccucaggucuauacgcugccaccgucuagggacgaauugaccaaaaaucaggugucgcucacaugucugguuaagggcuucuaccccagcgauauagccguggagugggaauccaacgggcaaccugagaacaauuauaaaacuaccccacccgucuuagacucagacggaaguuucuuccuguacucuaagcucacaguggauaagagccgguggcagcagggcaacguauuuuccugcucagugaugcacgaggcucuccacaaucauuacacucagaaaagccugucuuuguccccugguaag

SEQ ID NO: 23251 - RNA, 648 nt, Artificial Sequence
  derived and/or modified sequence opt3 from Galiximab_LightChain1
gagagcgcccugacccagcccccuuccgugucuggcgcuccagggcaaaaggucacaaucucaugcacuggaaguacgagcaacauugguggcuacgaccuccacugguaucagcagcuuccggggaccgcacccaaacuguugauauacgauaucaauaagagaccuuccggaauuucugacagguucucgggcucaaaaagcgguacagccgcgaguuuagcuaucacugggcugcagaccgaagaugaggccgacuauuacugucaauccuaugauucuagccuaaacgcacagguuuuuggaggcggcacacggcucaccgugcuggggcagccaaaggccgcucccacuguaacacuuuucccuccauccucagaggaacugcaggcaaauaaagccaccuuggugugccucauuagugacuuuuaccccggagcugucacgguggccuggaaggcggauagcucuccuguuaaggccgguguggaaacuaccacaccauccaaacaaucaaacaauaaguaugcagcuagcaguuaccugucucugacuccggagcaguggaaaucccaucgcagcuacucgugucaggucacccacgagggcucuacaguggaaaagaccguagcccccacggagugcucc

SEQ ID NO: 23252 - RNA, 1347 nt, Artificial Sequence
  derived and/or modified sequence opt3 from Ganitumab_HeavyChain1
caggugcaacugcaggagagcggccccgggcucgucaagccuuccggaacccuuucucugacaugcgccguuucagguggcaguaucagcuccucuaacugguggucgugggugagacagccaccggggaaaggauuggaauggauuggcgagauauaccacucagguagcacuaauuauaaccccaguuuaaaguccaggguaacgaucucuguggacaaaagcaagaaucaguucucccugaaacuaucaagugucaccgcugcagauacagccguguacuauugugcgcgguggacugggcgcaccgacgcuuuugauauuuggggacaaggcacaaugguuaccgugagcucugccuccacuaagggcccuucagucuucccacucgcacccagcaguaagucuacauccgggggaaccgccgcucuggguugccuugugaaagacuacuuuccugaaccaguaacgguuagcuggaacucgggcgcacugacuucuggggugcauaccuuccccgccgucuugcaguccucaggacucuauagucugagcuccguggugacagucccuucuagcucacugggcacucagaccuacaucuguaauguuaaccacaagccaaguaauacaaaaguggauaagaaaguagagccgaaguccugcgacaagacccauacgugucccccuugcccagcucccgaacucuuaggugggccuagcguguuucuguucccacccaaaccgaaggauacucuuaugauuucucgaacaccugaggucaccugugugguuguggacgucucacacgaggaucccgaagugaaauuuaacugguauguagacggaguugaggugcauaaugccaagacuaaaccacgugaagaacaguacaacaguacauacagagucgugagcgucuugaccgugcugcaccaagauuggcuaaauggcaaggaguauaaaugcaagguuuccaacaaggcgcucccugcacccaucgagaaaacgauaucuaaggccaaaggccagccaagggagccccagguguacacccugccuccaucgcgggacgaacuuacaaagaaucagguaagccugacuuguuuggucaaaggguucuauccguccgauaucgcuguggagugggaaucaaacggacaacccgagaauaacuacaagaccacaccuccaguucucgacagugacgguagcuuuuuccuguauucuaaguuaacuguggauaaaucccgcuggcagcagggcaacgucuuuucaugcagcgugaugcacgaggcccugcauaaucacuacacccaaaagucucucucccuuagucccgggaaa

SEQ ID NO: 23253 - RNA, 657 nt, Artificial Sequence
  derived and/or modified sequence opt3 from Ganitumab_LightChain1
gacguggucaugacccagagcccccugucccucccuguuacaccaggcgagccggccucuaucucaugcagaaguagccaaucccuucugcacucuaacggguacaauuauuuggauugguacuuacagaagcccggacagucgccucagcugcuaauuuaucucgguucaaacagggcuagcggcgugccagaccgguucaguggguccggaucuggcacugauuuuacgcugaaaauaagccgcguagaagcagaggacgugggugucuacuauuguaugcaagggacccauuggccccuuacauucggacagggcacuaagguggaaaucaaacgaaccguugccgcgccuuccguguuuauuuucccacccucagaugagcagcugaagaguggcacagcuagcgucgugugcuugcucaauaacuuuuacccucgugaagccaaaguacaguggaagguugacaaugcacugcaaucugggaacucccaggagucagugaccgagcaggauagcaaggacaguacuuauucucuguccagcacacucaccuuaucgaaagccgauuacgaaaagcacaaagucuacgcuugugaggugacgcaucagggacugucuuccccagugacuaagucauucaauagaggugaaugc

SEQ ID NO: 23254 - RNA, 1368 nt, Artificial Sequence
  derived and/or modified sequence opt3 from Gantenerumab_HeavyChain1
cagguggagcuggucgaaagcggcgggggacucguucaacccgguggcucccuuagacugucuugcgccgcuucaggguucaccuuuaguagcuacgcaauguccugggugaggcaggccccuggaaagggcuuggaguggguaucugcgaucaacgcuucggguacacggacuuauuacgccgacucagugaaagggcgcuucacgauuagccgagauaauaguaagaacaccuuauaucugcagaugaacucccuacgugcagaagacacagccgucuacuauugugcuagaggaaaaggcaauacucacaagccauacggcuaugugagguacuuugauguuugggggcagggaacccucgugacagucucuagcgcauccaccaaagguccgucaguguucccccuggccccuaguagcaagucuacuuccggcgggacagcugcccuuggaugccugguaaaggacuacuuuccagagcccguuaccgugucauggaauagcggcgcguugacgagugguguccauacuuucccugcagugcuccaaucuuccgggcuguauagccugucgucuguggucaccguuccauccucaagucucggaacacagacuuacauauguaacgugaaucacaaacccagcaacaccaagguagauaaaaagguggaaccuaaauccugcgacaagacacauaccuguccaccgugccccgccccugaguuacugggcggcccaucugucuuucuuuuucccccuaagccaaaagauacguugaugaucagccggacucccgaggugacauguguuguggucgacgugucacacgaagauccggagguaaaguucaauugguauguugacgggguggaaguccauaacgcuaaaaccaagccucgcgaggagcaguacaauaguacuuauagaguggucuccgugcugacaguucuacaccaggauuggcucaacggaaaagaauacaagugcaaagugagcaauaaggcccugcccgcaccaauugagaagaccaucucuaaagcuaagggucaaccuagggaaccccagguauauacgcuuccacccucacgggacgagcugaccaaaaaccaggucaguuugacaugucucgugaagggcuucuacccuagcgauauugccguugaaugggaguccaaugggcagccagagaacaacuacaaaacuaccccgcccgugcuggacucugacggaucguuuuucuuauauagcaagcugacagucgauaagucccgcuggcaacagggcaauguguuuucaugcaguguaaugcacgaagcgcuccauaaccacuacacucagaaaucucuuagccuguccccugguaag

SEQ ID NO: 23255 - RNA, 645 nt, Artificial Sequence
  derived and/or modified sequence opt3 from Gantenerumab_LightChain1
gacaucgugcugacccagagccccgccacacucucccuuucuccuggcgagagagcuacucugucaugcagggcaagucaaagcgucuccucuucguacuuggccugguaucagcagaagccagggcaggcgccgcgguuacugauuuacggagcuucaagccgcgccacggguguucccgcacgauucaguggcuccgggucuggaaccgauuuuacacuaacuauaagcucccucgaaccugaggacuucgccaccuauuacugucugcaaaucuauaacaugccaauuacauuuggccaggguaccaaaguggaaaucaagcguacuguagcugcacccucaguguucauuuuuccuccaagugaugagcagcuuaaaagcgggacagccucugucgugugccuguugaauaacuucuaccccagagaagcuaagguucaguggaaaguggacaaugcccuccaauccggaaacucacaggagagcgucaccgagcaggauaguaaggacucuacguauucccugagcucgacucugacccucucuaaggcggauuacgaaaaacacaagguguacgcaugugagguaacacaucagggcuuauccucaccuguuacuaaaaguuuuaauaggggcgaaugc

SEQ ID NO: 23256 - RNA, 348 nt, Artificial Sequence
  derived and/or modified sequence opt3 from Gemtuzumab_HeavyChain1
caggugcaacugcagcagagcggcgccgagcucgcuaagcccggggcauccgucaaaaugucuugcaaggccucaggauacaccuucacaaguuauagaaugcacuggguuaaacagaggccuggucaaggccuugaauggaucggguacauuaacccaagcacuggauauacggaguacaaucagaaguuuaaagacaaggcgacccugacagcugauaaguccucuucgacugccuauaugcaguugagcucauuaaccuucgaagacagugcaguguacuauugugcccggggcggugggguauuugauuacuggggacagggcacaacccugacuguguccucu

SEQ ID NO: 23257 - RNA, 351 nt, Artificial Sequence
  derived and/or modified sequence opt3 from Gemtuzumab_HeavyChain2
caggugcaacugguccagagcggcgccgagguuaagaaacccggguccucugugaagguaucaugcaaagcuaguggagguaccuucagcagauccgcaaucauuugggugaggcaggccccuggccaggggcucgaauggaugggaggcauagucccaauguuugguccgcccaacuacgcgcaaaaguuccaggggcgggugacaaucacugcugacgagucuacgaauaccgccuauauggaacuuucgucacugcgcagcgaggauacagcauuuuacuucugugccggaggcuauggcauuuacaguccugaagaguauaacgggggauugguuacuguguccucu

SEQ ID NO: 23258 - RNA, 321 nt, Artificial Sequence
  derived and/or modified sequence opt3 from Gemtuzumab_LightChain2
gacauccagaugacccaaagccccuccacacugucugccucagugggcgauagagucacuauuacgugcagggcuagucagagcauaaacaccuggcucgcaugguaccagcagaagccugggaaagccccaaaacuucugauguauaaggcguccucuuuggagucgggaguuccgucacgguucaucgguagcggcagugggacagaauuuacuuuaaccauuuccucucugcaacccgacgauuucgcuacauacuauugucagcaguacaauagcgacuccaagauguuuggacagggcaccaaaguggagguaaag

SEQ ID NO: 23259 - RNA, 318 nt, Artificial Sequence
  derived and/or modified sequence opt3 from Gemtuzumab_ozogamicin_LightChain1
cagaucgugcugacccaaagccccgccauuauguccgcuucuccuggcgagaaggucacaauaacuugcucagcaaguagcuccaucucuuacaugcacugguuccagcagaaaccagggacgucgccgaagcucuggauuuauaccacaucaaaccuugccagcggaguucccgcgagauuuagugguuccggcucugggacuagcuacucccugaccaucucaaggauggaagcugaggacgccgcaacauauuacugucaucagcggaguaccuauccuuugacuuucggaagcggcacaaaauuagaacugaag

SEQ ID NO: 23260 - RNA, 1335 nt, Artificial Sequence
  derived and/or modified sequence opt3 from Gevokizumab_HeavyChain1
caggugcaacugcaggagagcggccccgggcucgucaagccuucccagacccuuucucugacaugcucauucaguggauuuagcuuguccacuucugguaugggcguuggguggaucagacagccaucgggaaaaggcuuagaauggcuggcccacauuuggugggacggugaugagucauacaacccgagccuaaagaguaggcucacgauauccaaagacaccucuaagaaucaagugagccugaaaaucacauccguaacugcugcagauaccgccguguauuucugugcgcggaaccgcuacgaucccccuugguuugucgacugggggcagggaacacuugugaccguuucaagugcuagcacuaagggcccaucuguguucccccuggccccuugcucccgaucaacaagcgaaaguaccgcagccuugggcugucucgucaaggacuauuuuccagagcccgugacgguaucuuggaauagcggggcucugacuagcggaguucauaccuucccugcagugcugcagucgucuggucucuacuccuuaucaagugucgugacagugacuagcuccaacuuuggcacccagacauauaccugcaaugucgaucacaaaccaucuaacacgaagguugacaaaacuguggaacguaaguguugcguagaguguccgcccugcccugccccacccguggcugggccuagcgucuuccuguuuccacccaaaccgaaggauacacuuaugauuucaagaaccccugaggugacuuguguuguggucgacgugagucaugaagaucccgagguacaauucaauugguacguugacggaauggaagugcacaacgccaagacaaaaccaagggaggagcaguuuaauuccaccuuccgggucgugagcgucuugacggugguucaucaggauuggcugaacggcaaggaauauaaaugcaaggugucuaauaaaggucuaccugcgcccaucgagaagaccauuucaaaaacaaaggggcagccacgcgaaccccaaguauacacucucccuccaaguagagaggaaaugaccaagaaccaggucagccugacaugucuugugaaaggauuuuacccguccgacaucgcaguugagugggagucuaauggccagcccgaaaacaauuauaagacuaccccuccaaugcuggacucggauggcagcuucuucuuguacuccaaacucacaguggacaagucaagguggcaacaggggaacgucuuuaguugcucugugaugcacgaggcccugcacaaccauuauacccagaaauccuuaucccugucacccgga

SEQ ID NO: 23261 - RNA, 642 nt, Artificial Sequence
  derived and/or modified sequence opt3 from Gevokizumab_LightChain1
gacauccagaugacccaaagcacauccucucugucagccagugugggcgauagagucacuauuacgugcagggcuagccaggacauauccaacuaccucucuugguaucagcagaagcccgggaaagcaguuaaacuucugaucuacuauaccucgaaguugcacucaggagugccuagccgguucagugguuccggcucugggacagauuacacuuuaaccauuagcucccugcaacaggaggacuuugccacauauuucugucuacagggaaagaugcucccauggaccuuuggccaggguacuaaacuggaaaucaagcgcacaguagcggcuccgucaguguucauuuuucccccuagugaugagcaacuuaagagcgggaccgccucugucgugugccuguugaauaacuucuacccacgagaagcaaaaguucaguggaagguggacaaugcccuccaguccggaaacucacaggagagcgucacggaacaagauaguaaagacucuacuuauucccugagcucgacccugacacucucuaaggcugauuacgagaaacauaagguguacgcaugugagguaacucaccagggcuuauccucacccguuaccaagaguuuuaaucguggcgaaugc

SEQ ID NO: 23262 - RNA, 1347 nt, Artificial Sequence
  derived and/or modified sequence opt3 from Girentuximab_HeavyChain1
gacgugaagcuggucgagagcggcgggggacucguuaaacuugguggcucccugaaguugucuugcgccgcuucaggguucaccuuuaguaacuacuauaugagcugggugagacaaacacccgagaaaagguuagaacugguagcagccaucaauuccgauggaggcauuacuuacuaucuagacacggugaagggucgguucaccauaucucgcgauaacgcgaaaaauacacucuaccugcaaaugucgucacuuaagagcgaagacacugcucuguuuuauugugcccgacaccguaguggguacuucuccauggauuauuggggacagggcaccucugucacagugagcuccgcaucaaccaagggcccuaguguuuuuccauuggccccgagcucuaaauccacuucagggggaacagcugcacucgguugccuggugaaggacuacuuccccgagccugucaccgugagcuggaacaguggcgcccugacgucugggguacauacuuuuccagcuguucuccaguccagcggauuauacucgcugucuuccguggucaccgugcccucaaguagccuuggcacacagacuuauaucuguaaugugaaccacaaaccuuccaauaccaaggucgauaaaaagguugaaccaaagucuugcgacaaaacacauaccugucccccuugcccagccccggaguugcugggugggcccagcguguuccuauuuccuccaaagcccaaagauacgcucaugauuucaagaacuccugagguaacauguguggucguggacguuagucacgaagauccagaggugaaguucaacugguacgucgacggaguggaaguacauaaugcgaaaaccaagcccagggaggagcaauauaacuccacuuaccggguugugagcguccugacagugcuucaccaggauuggcugaauggcaaagaauauaagugcaaggucucuaacaaagcauugccggccccuaucgagaagaccauuucaaaagcuaagggccagccccgcgaaccacagguguacacgcucccucccaguagagacgagcugaccaaaaaucaaguuagcuuaacaugucuggugaagggguuuuauccauccgacaucgccguagaaugggagucuaacggacagcccgagaauaacuacaagacuaccccuccaguccucgauucggacgguagcuucuuucuuuacuccaaacugacaguggauaagucaagguggcagcagggcaacguuuucaguugcucugugaugcacgaagcauugcauaaucacuauacucagaaaagccuaucccugucaccggggaag

SEQ ID NO: 23263 - RNA, 642 nt, Artificial Sequence
  derived and/or modified sequence opt3 from Girentuximab_LightChain1
gacaucgugaugacccagagccaaagauucauguccacaacugucggcgauaggguuucuauuacgugcaaggccucacagaacgugguaagugcuguggcaugguaccagcagaaacccgggcaaagcccuaagcugcucauauauuccgccucuaaucgguacaccggagucccagaccgcuuuacagguucgggcucagggacugauuucacccuuacaaucagcaacaugcagagugaggaccuggcggacuuuuucugucagcaguauuccaauuacccguggaccuuuggaggcgguacuaaauuggaaauuaagcgaacaguggcugcccccucuguuuucaucuuuccuccaagcgaugagcaauuaaaauccgggaccgcaucaguggucugccugcuaaacaauuucuauccccgugaagccaaggugcaguggaagguagauaacgcucuccagaguggaaauagccaggagucuguuacggaacaagacuccaaagauucaacuuacagccugaguucuacccuuacacuguccaaggcagacuaugagaaacacaagguguacgccugugaggucacucaucagggcuugagcucgccugugaccaaaucuuuuaacagaggcgaaugc

SEQ ID NO: 23264 - RNA, 1335 nt, Artificial Sequence
  derived and/or modified sequence opt3 from Glembatumumab_HeavyChain1
caggugcaacugcaggagagcggccccgggcucgucaagccuucccagacccuuucucugacaugcacuguuucaggagguaguaucagcuccuucaacuacuauuggucuuggauuagacaccauccaggcaaaggguuggaauggauaggauacaucuauuacucgggcucaacguauagcaauccgaguuuaaaguccagggugaccauuucuguagacacaagcaaaaaccaguuuucccugacucuaucaagugugaccgccgcugauacagcagucuacuauugugcccgggguuacaauuggaacuacuucgacuauugggggcaaggaacccucgugacuguuagcucugcguccacaaagggccccucaguguuuccucuggcuccaugcagccgcaguaccucugaguccacggccgcacuuggcugucuggucaaagauuacuuccccgaaccugugacuguaagcuggaacucgggggccuugaccucuggaguucacacauuuccagcugugcuccaguccucaggucuguauagucugagcuccgucgugacugugcccucuagcaauuucggcacccagacauauaccugcaaugucgaccauaagccuucaaacacgaagguugauaaaacuguggagcgaaaguguugcguagaauguccaccgugccccgcaccuccaguggccgggcccagugucuuucucuucccuccaaaacccaaggacacauuaaugaucucccguaccccggaggugacuuguguuguggucgaugugagccacgaggacccugaaguacaguuuaauugguacguugauggaguggagguccauaacgcuaaaacaaagcccagagaggaacaauucaauucuaccuuuaggguggucucagugcugacgguugugcaccaggacuggcuuaacggcaaggaguacaaaugcaagguaaguaauaaagguuugccagccccuauugaaaagaccaucagcaaaacaaaggggcagccccgggagccacaggucuauacucugcccccuucccgcgaagagaugaccaaaaaccaagugucucuaacaugucucguuaagggauucuacccaucggauauagcgguggaaugggagagcaauggccagccggagaacaacuacaagacuacacccccuaugcuggacuccgauggcucauuuuuccuuuauaguaaacugaccgucgacaagucuagauggcagcaagggaauguguucagcugcuccguaaugcacgaagcauugcauaaccacuacacccagaaaucacucagccugucuccaggaaag

SEQ ID NO: 23265 - RNA, 645 nt, Artificial Sequence
  derived and/or modified sequence opt3 from Glembatumumab_LightChain1
gagaucgugaugacccagagccccgccacacuguccgucucuccuggcgaaagagcuacucucucaugcagggcaagucaaagcguugacaacaaucuugugugguaccagcagaagccagggcaggccccgcggcuguugauuuauggagcguccacgcgcgcuaccgguauacccgcccgauucucuggcucggggucaggaacagaguuuacuuuaaccaucagcagucugcaauccgaagauuucgcaguauacuauugucagcaguacaacaauuggccuccauggacauuuggccaggguaccaaaguggagauuaagcguacugucgccgcucccucuguguucaucuuuccuccaagcgacgaacaacuaaaauccgggacagcaucaguugugugccuccugaacaauuucuaucccagagaggccaagguccaguggaaaguggauaacgcccuucagaguggaaauagccaggagucuguaaccgaacaagacuccaaggauucaacguacagccugaguucuacuuugacccucuccaaggcugacuaugagaaacacaagguuuacgcgugugaagugacacaucagggccugagcucgccugucacuaaaucuuuuaacaggggcgagugc

SEQ ID NO: 23266 - RNA, 1332 nt, Artificial Sequence
  derived and/or modified sequence opt3 from Goilixiab_HeavyChain1
gaggugcagcuggucgaaagcggcgggggacucgccaagcccgguggcucccuuagacugucuugcgcugcaucaggguucagguuuaccuucaacaauuacuaugacuggguucggcaagccccuggacagggcuuggagugggugagucgcaucagcuccucuggugauccaacaugguacgcggacucgguaaaagggcgauuuacuauuucacgugaaaacgcuaagaauacguuauuccugcagaacagccuaagagccgaggauaccgcaguguauuacugugccagucucacaacuggauccgacucuuggggccagggcguccuggugaccguuagcuccgcuucaacaaaagggccgaguguguuuccccuugcaccuagcucuaaguccaccucaggagguacugccgcucugggcugcuuggucaaagauuauuucccagaacccgugacaguaagcuggaauaguggggcccucaccucuggaguucacacguuuccugcggugcugcaauccagcggccuguacucgcucucuuccgucgugacugugccaucaaguagcuuagguacccagacauauauauguaacgucaaucauaagcccuccaacacuaagguugacaaaaagguggagccuaaaucuugcgauaagacccacacauguccaccgugccccgcaccugagcugcuugggggaccaagcguauucuuguuucccccuaaaccaaaggacacccugaucucaaggacgcccgaagugacuugugucgugguugaugugagucaugaggacccggaagucaaguucaauugguacguggauggcguagagguucacaacgccaaaacaaagccucgggaggaacaguacaauuccaccuaucgcguggucagcgugcuaacuguccuccaucaggacuggcugaacggcaaagaguacaagugcaaagugucuaauaaggcccuucccgcuccaauugaaaagacaaucucaaaggcaaaggggcaaccuagagagccccagguuuauacccugccacccaguagggaugaauugacgaaaaaccaggugagccucaccugucugguaaagggauuuuacccuuccgacauugcugucgagugggagucuaauggucagccagaaaacaacuauaaaacaacuccgcccguguuagacucggauggcagcuucuuucuguacuccaagcucaccguugacaaaucacgguggcaacaggggaauguguucaguugcucuguccacgaggcccuucacaaccauuauacacagaaaagccuguccuugucaccuggaaag

SEQ ID NO: 23267 - RNA, 639 nt, Artificial Sequence
  derived and/or modified sequence opt3 from Goilixiab_LightChain1
gacauccagacccaaagccccuccucucugucagccagugugggcgauagagucacaauuacuugcagggcuagccaggacauacgguacuaucucaacugguaccagcagaagccugggaaagcaccaaaacuucugaucuauguugccuccucuuugcaaucgggagugccgucacgcuucagcgguaguggcuccgggacggaguuuaccuuaacaguaucuagccugcagcccgaagauuucgcgacuuacuauugucuacagguguacuccaccccucgaacauuuggacagggcaccaaggucgagauuaagcguacuguggcugccccaucaguuuucaucuuucccccuagugacgaacaacucaaaagcgguacagcaucuguggucugccugcuuaauaacuucuauccaagagaggccaaggugcaguggaagguagauaaugcucugcaguccgggaacucacaggaaagcguuaccgagcaagacaguaaagauucuacguacuccuugagcucgacucucacccugucuaaggcagacuacgagaaacacaagguguaugccugugaagucacacaucagggacuguccucacccgugacuaaaaguuuuaauaggggcgagugc

SEQ ID NO: 23268 - RNA, 1338 nt, Artificial Sequence
  derived and/or modified sequence opt3 from Guselkumab_HeavyChain1
gaggugcagcugguccaaagcggcgccgaaguuaagaaacccggggagucccucaagaucucuugcaaaggaucagguuacaguuucagcaacuauuggauuggcugggugagacagaugccugggaagggacuugaauggaugggcauaaucgacccauccaauucuuacaccagguauucgccgucauuucagggucagguaacaauuagcgcugauaaaaguaucuccacugcauaccugcaauggucuagcuugaaggccuccgacacggcgauguauuacugugcucggugguauuacaagcccuucgaugugugggggcagggaaccuuagucacagugucaagugccagcacuaaaggcccuucuguuuuuccacuggcacccuccucaaagagcaccaguggcgggacagccgcucuaggaugccucgugaaagacuacuucccugagccagucaccgugucuuggaacuccggugcacugacuagcggcguacacacauuucccgccguucuucagucgucugggcuguauuccuugucaaguguggucaccgugccuagcuccucucucggaacgcagacuuacauuuguaaugugaaccauaagccaagcaauaccaaagucgauaagaagguugaaccgaaaucaugcgacaagacacacacuugucccccuugcccagcucccgagcugcugggcgguccuaguguguuccucuuuccacccaaaccgaaggauaccuuaaugaucucccgcacaccugagguaaccuguguggucguggacguuagccaugaagaucccgaggugaaauucaacugguaugucgacgggguggaaguacacaaugccaagacgaaaccacgagaggagcaauacaacucuacuuaucguguugugucaguccugacagugcuucaucaggauugguugaauggaaaggaauacaagugcaaagucaguaacaaggcgcugccugcacccauagagaaaaccaucagcaaggccaaaggccagccaagagaaccccagguguauacucuaccuccauccagggacgagcucacaaagaaucaaguuucucugaccugucuugugaagggcuuuuacccgucggauauugcuguagaaugggagagcaacgggcagcccgagaauaacuacaaaacgaccccuccaguccuggacuccgacggaucauucuuuuuguauaguaagcucacaguggauaaaucucgguggcagcaagguaauguuuucagcugcuccgugaugcacgaagcccugcacaaccauuacacucagaagucauuaagccugucucccggc

SEQ ID NO: 23269 - RNA, 651 nt, Artificial Sequence
  derived and/or modified sequence opt3 from Guselkumab_LightChain1
cagagcgugcugacccaacccccuuccgucucuggcgccccagggcagagaguuacaaucucaugcacuggaaguagcuccaacauugguucuggcuacgacgugcacugguaucagcagcucccggggacggcucccaaguugcugauauacggaaauucgaaaaggccuucaggcguaccagaucgguucagcgguaguaaguccgggaccucugcaagccuugccaucacaggauuacaauccgaggacgaagcggauuauuacugugcuucauggacugacggccugagucuaguggucuuuggcgggggaaccaaacucacagugcugggucagcccaaggccgcaccuagcguuacccuuuucccacccucuuccgaggaacugcaggccaacaaagcuacuuuggugugccucauuucagauuuuuauccuggcgcagucacaguggccuggaaggcugacagcaguccaguaaaggccgggguugagaccacgacuccgucuaaacaguccaauaacaaguacgcggcaagcucguaucugucucugacccccgaacaauggaaaucccaucgcucauacaguugucaggugacacacgagggaagcacugucgagaagaccguggccccuacagaaugcucc

SEQ ID NO: 23270 - RNA, 360 nt, Artificial Sequence
  derived and/or modified sequence opt3 from HuMab-001_HeavyChain_VDJ-Region
caggugcaacugcagcaguggggcgccgggcuccuuaagcccagcgagacccuguccuugacaugcgcugucuacggagguucuuucucaggcuauuacuggaacuggaucagacagccuccagggaaaggauuagaauggauuggcgagauaaaucacagugguagcacuaacuauaauccgucccugaagucuaggguuacgaucucgguggacaccagcaaaaaccaauuuucacuaaagcucaguuccguaacagcagccgauacugcgguguacuauugugcucgggggaauuacggaucuggcuauuacuacuucgaccuguggggccgcgggacccaggucacagugagcucc

SEQ ID NO: 23271 - RNA, 321 nt, Artificial Sequence
  derived and/or modified sequence opt3 from HuMab-001_LightChain_VJ-Region
gacauccagaugacccaaagccccuccucucugucagccagugugggcgauagagucacaauuacuugcagggcuagccaggggauauccucuuggcucgcaugguaccagcagaagccugagaaagccccaaagucgcuuaucuucgcggcuucaagccugcaaaguggaguuccgucccgguuuucugguagcggcuccgggacggacuucaccuugacaauuucaaguuuacagcccgaagauuuugccacuuauuacugucagcaguauaucagcuucccuauuaccuuuggacaaggcacacgccuggagaucaaa

SEQ ID NO: 23272 - RNA, 366 nt, Artificial Sequence
  derived and/or modified sequence opt3 from HuMab-005_HeavyChain_gamma-Chain_VDJ-Region
gaggugcagcugguccaaagcggcgccgaaguuaagaaacccggggagucccucaagaucucuugcaaggcuucaggauacaguuuccacuuuuauuggauugguugggugagacagaugccuggcaaagggcuugaauggaugggaagcauauacccaggcgacuccgauaccagguaucggccgucuuuccagggucagguaacaaucucggcagacaaaucaauuagcacugccuaccugcaauggacgaguuugaaggcguccgauaccgcuaucuauuacugugcccgccagcgaggggacuauuacuacuuuuauggaauggauguguggggccagggcacaacugucaccgugucuagc

SEQ ID NO: 23273 - RNA, 321 nt, Artificial Sequence
  derived and/or modified sequence opt3 from HuMab-005_LightChain_VJ-Region
gagaucgugcugacccagagccccggcacacucucccuuucuccuggggaaagagccacucugucaugcagggcuagucaaagcgucuccucuucguacuuggcaugguaucagcagaagccaggacagguuccgcgguuacugauuuacggugccucaagccgcgcgacgggcauacccgaccgauucaguggguccggaucuggcaccgauuuuacacuaacuaucagccgucucgagccugaagacuucgcuguguauuacugucaacaguaugguuccucacugaccuuugggggaggcacaaaaguagagauuaag

SEQ ID NO: 23274 - RNA, 357 nt, Artificial Sequence
  derived and/or modified sequence opt3 from HuMab-006_HeavyChain_VDJ-Region
gaggugcagcugcucgaaagcggcgggggacuuguccaacccgguggcucccugagauugucuugcgccgcuucaggguucaccuuuaguaacuacgcauuaaucuggguuaggcaggccccuggaaagggccuggagugggugagcauuauacgggguggggcgggauccacauauuacgcugacucuguaaaaggccgcuucacuaucucgcgagauaauucaaagaacacgcuauaucuccagaugaauagccugcgugccgaagacaccgcaguguacuauugugccaaagcuagaauuuggggcccacuuuuugauuacugggggcagggaacacuggucacugugaguucc

SEQ ID NO: 23275 - RNA, 324 nt, Artificial Sequence
  derived and/or modified sequence opt3 from HuMab-006_LightChain_VJ-Region
gagaucgugcugacccagagccccgccacacucucccuuucuccuggcgaaagagcuacucugucaugcagggcaagucaaagcgucuccucuuacuuggccugguaucagcagaagccagggcaggcgccgcgguuacugauuuacgacgcuucgaaccgcgccacgggaauacccgcacgauucucagguagcggcagugggaccgauuuuacacuaacuaucuccucucucgagccugaagacuucgccguuuauuacugucaacagcguagcaauuggccaccccugaccuuuggaggcgguacaaaaguggagauuaag

SEQ ID NO: 23276 - RNA, 360 nt, Artificial Sequence
  derived and/or modified sequence opt3 from HuMab-019_HeavyChain_VDJ-Region
caggugcaacugcagcaguggggcgccgggcuccuuaagcccagcgagacccuguccuugacaugcgcugucuacggagguucuuucucagacuauuacuggaacuggaucagacagccuccaggcaaaggguuagaauggauuggagagauacaccauguuggcaguacuaauuauaacccgagccugaaguccagggugacgaucucuguagauaccucgaaaucacaauuuagccuaaagcucaguuccgugacagcagccgacacugcggucuacuauugugcucgggguuacuaugauucugggguguacuacuucgacuauugggcccagggaacccugguuacagugagcucc

SEQ ID NO: 23277 - RNA, 360 nt, Artificial Sequence
  derived and/or modified sequence opt3 from HuMab-021_HeavyChain_VDJ-Region
caggugcaacugcagcaguggggcgccgggcuccuuaagcccagcgagacccuguccuugacaugcgcugucuacggagguucuuucucagacuauuacuggaacuggaucagacagccuccaggcaaaggguuagaauggauuggagagauacaccauaguggcagcacuaauuauaacccgucccugaagucuaggguuacgaucucgguggauaccagcaaaaaucaauuuucacuaaagcucaguuccguaacagcagccgacacugcgguguacuauugugcucgggguuacuaugccucuggggucuacuacuucgauuauuggggacagggcacccuggugacaguuagcucc

SEQ ID NO: 23278 - RNA, 321 nt, Artificial Sequence
  derived and/or modified sequence opt3 from HuMab-021_LightChain_VJ-Region
gacauccagaugacccaaagccccuccucucugucagccagugugggcgauagagucacaauuacuugcagggcuagccaggggauauccucuuggcucgcaugguaccagcagaagccugagaaagccccaaagucgcuuaucuaugcggcuucaagccugcaaaguggaguuccgucccgguucucugguagcggcuccgggacggacuuuaccuugacaauuucaaguuuacagcccgaagauuucgccacuuacuauugucagcaguacaacagcuauccuaucaccuuuggacaaggcacacgccuggagauuaaa

SEQ ID NO: 23279 - RNA, 360 nt, Artificial Sequence
  derived and/or modified sequence opt3 from HuMab-025_HeavyChain_VDJ-Region
caggugcaacugcagcaguggggcgccgggcuccuuaagcccagcgagacccuguccuugacaugcgcugucuacggagguucuuucucagacuauuacuggaacuggaucagacagccuccaggcaaaggguuagaauggauuggagagauacaccauaguggcagcacuaauuauaacccgucccugaagucuaggguuacgaucucgguggauaccagcaaaaaucaauuuucacuaaagcucaguuccguaacagcagccgacacugcgguguacuauugugcucgggguuacuaugauucuggggucuacuacuucgacuauugggcccagggaacccuggugacaguuagcucc

SEQ ID NO: 23280 - RNA, 321 nt, Artificial Sequence
  derived and/or modified sequence opt3 from HuMab-025_LightChain_VJ-Region
gacauccagaugacccaaagccccuccucucugucagccagugugggcgauagagucacaauuacuugcagggcuagccaggggauaucccgguggcucgcaugguaccagcagaagccugagaaagccccaaagucucuuaucuaugcggcuucgucacugcgcagcggaguuccgagucgauucuccgguucuggcagcgggacggacuuuaccuugacaauuuccucauuacaacccgaagauuucgccacuuacuauugucagcaguacaacaguuauccuaucaccuuuggacagggcacacgucuggagauuaaa

SEQ ID NO: 23281 - RNA, 360 nt, Artificial Sequence
  derived and/or modified sequence opt3 from HuMab-027_HeavyChain_VDJ-Region
caggugcaacugcagcaguggggcgccgggcuccuuaagcccagcgagacccuguccuugacaugcgcugucuacggagguucuuucucagacuauuuuuggaacuggaucagacagccuccaggcaaaggguuagaauggauuggagagauacaccauaguggcagcacuaauuacaacccgucccugaagucuaggguuacgaucucgguggauaccagcaaaaaucaauucucacuaaaccucaguuccguaacagcagccgacacugcgguguauuacugugcucggggucugauugggucuggauauuacuauuuugauuacugggaccagggcacccuugucacagugagcucc

SEQ ID NO: 23282 - RNA, 360 nt, Artificial Sequence
  derived and/or modified sequence opt3 from HuMab-032_HeavyChain_VDJ-Region
caggugcaacugcagcaguggggcgccgggcuccuuaagcccagcgagacccuguccuugacaugcgcugucuacggagguucuuucucaggcuauuacuggaguuggaucagacagccuccagggaaaggauuagaauggauuggcgagauaaaccacagcggugacacuaauuauaacccgucccugacgucuaggguuaccaucucgguggauacaucaaagaaucaauuuagccuaaaacucaguuccguaacugcagccgacaccgcgguguacuauugugcucggcuguucuacgggucuggaauuuauuacuuugauuacuggggccagggcacacuugucaccgugagcucc

SEQ ID NO: 23283 - RNA, 321 nt, Artificial Sequence
  derived and/or modified sequence opt3 from HuMab-032_LightChain_VJ-Region
gacauccagaugacccaaagccccuccucucugucagccagugugggcgauagagucacaauuacuugcagggcuagccaggggauauccucuuggcucgcaugguaccagcagaagccugagaaagccccaaagucgcuuaucuaugcgacguuccggcugcaaucaggaguuccgagccgcuuuagugguuccggcucugggaccgacuucacauugacuauuagcuccuuacagcccgaagauuuugcuaccuacuauugucagcaguacaacucauucccuccaacauuuggacaaggcaccaaaguggagaucaag

SEQ ID NO: 23284 - RNA, 363 nt, Artificial Sequence
  derived and/or modified sequence opt3 from HuMab-033_HeavyChain_VDJ-Region
caggugcaacuggucgagagcggcgggggaguugugcagaccgguagaucccucaggcuuucuugcgccgcuucaggcuucacauuuaguagccacgcaaugcauuggguacggcaggcccccgggaagggacuggaauggguggcggcuaucuccuacgacggcucuaacaaauauuacgccgauucggucaagggucgcuucacuauuucacgagacaauagcaaaaacacguuguauuuacagaugaauagucugcgugcagaggauaccgccguguacuauugugcuagaggggacuacauauccucuagcggaguuuuugauuauuggggccaaggcacucuagugacagucuccuca

SEQ ID NO: 23285 - RNA, 360 nt, Artificial Sequence
  derived and/or modified sequence opt3 from HuMab-035_HeavyChain_VDJ-Region
caggugcaacugcagcaguggggcgccgggcuccuuaagcccagcgagacccuguccuugacaugcgcuaucuacggagguucuuucucaggcuauuacuggaguuggauuagacagccuccagggaaaggauuagaauggauaggcgagaucaaccacagcggugacacuaauuauaacccgucccugacgucuagggucaccauuucgguugauacaucaaagaaucaauuuagccuaaaacucaguuccgugacugcagccgacaccgcgguauacuauugugcucggcuguucuacgggucuggaaucuauuacuuugauuacuggggccagggcacacuugugaccgucagcucc

SEQ ID NO: 23286 - RNA, 360 nt, Artificial Sequence
  derived and/or modified sequence opt3 from HuMab-036_HeavyChain_VDJ-Region
caggugcaacugcagcaguggggcgccgggcuccuuaagcccagcgagacccuguccuugacaugcgcugucuacggagguucuuucucagacuauuacuggaguuggaucagacagccuccaggcaaaggguuagaauggauuggagagauaaaccacagcggcuccacuaauuauaacccgucucugaagucgaggguuacgaucucaguggauaccagcaaaaaucaauuuagucuaaagcucuccucuguaacagcagccgacacugcgguguacuauugugcucggcuguacuaugguagcgggaccuacuacuucgauuauuggggacagggcacacuugucaccguguccuca

SEQ ID NO: 23287 - RNA, 321 nt, Artificial Sequence
  derived and/or modified sequence opt3 from HuMab-036_LightChain_VJ-Region
gacauccagaugacccaaagccccuccucucugucagccagugugggcgauagagucacaauuacuugcagggcuagccaggggauauccucuuggcucacgugguaccagcagaagccugagaaagcaccaaagucgcuuaucuaugccgcgucacggcugcaaagcggaguuccgagucgcuucuccgguucuggcagcgggaccgacuuuacauugacuauuuccucauuacagcccgaagauuucgcuaccuacuauugucagcaguacaacaguuuuccuccaacauucggacaaggcaccaaaguggagaucaag

SEQ ID NO: 23288 - RNA, 366 nt, Artificial Sequence
  derived and/or modified sequence opt3 from HuMab-041_HeavyChain_VDJ-Region
gaggugcagcugguccaaagcggcgccgaaguuaagaaacccggggagucccucaagaucucuugcaaaggaucagguuacaguuucaccagcuauuggauuggcugggugagacagaugccugggaagggacuugaauggaugggcuccauauacccaggugacucucacacaagguaucggccgucguuucaggggcagguaacuaucucagcugauaaaagcauuaguacggcauaccugcaaugguccucuuugaaggccagcgacaccgcgauguauuacugugcucgccagaagggagauuucuauuacuuuuucggcuuagacguguggggccaggggacagccaucacugucuccuca

SEQ ID NO: 23289 - RNA, 366 nt, Artificial Sequence
  derived and/or modified sequence opt3 from HuMab-044_HeavyChain_VDJ-Region
gaggugcagcugguccaaagcggcgccgaaguuaagaaacccggggagucccucaagaucucuugcaaaggaucagguuacagauucaguagcuauuggauuggcugggugaggcagaugccugggaagggacuugaauggaugggcuccauauuuccaggugacucugauacccgguacucgccgucauuccaggggcagguaacaaucagcgcugacaaaaguauuacuacggcauaucugcaaugguccucuuugaaggccagcgauaccgcgauguacuauugugcucgccaggccggagacuacuauuacuacaacggcauggauguguggggccaggggacaacugucaccguguccuca

SEQ ID NO: 23290 - RNA, 357 nt, Artificial Sequence
  derived and/or modified sequence opt3 from HuMab-049_HeavyChain_VDJ-Region
gaggugcagcugcucgaaagcggcggggaccuuguccaacccggagguucccugagauugucuugcgccgcuucaggcuucaccuuuaguagcuacgcaauguccuggguuaggcaggccccugggaagggauuagagugggugucugcgaucucgggccggggugggacaacuuauuacgcugauucaguaaaaggacgcuucacgauuagccgagacaacaguaaguccacccugugucuacagaugaacucucuccgugccgaagauacagcaguguauuacugcgccaaagcuagagcaaauugggacuauuuugauuacuggggccagggcacucuggucaccgugagcucc

SEQ ID NO: 23291 - RNA, 321 nt, Artificial Sequence
  derived and/or modified sequence opt3 from HuMab-049_LightChain_VJ-Region
gacauccagaugacccaaagccccuccucugugucagccagugucggcgauagaguuacaauuacuugcagggcuagccaggggauauccucuuggcuggcaugguaccagcacaagccuggaaaagccccaaagcuccuuaucuaugcggcuucgauucugcagucaggugugccgagccgguucaguggcuccgggucuggaacggacuuuaccuugacaaucagcuccuuacgccccgaggauuucgccacuuacuauugucaacaggcaaacucauuuccuauuaccuucggccaggguacacgacuggaaaucaaa

SEQ ID NO: 23292 - RNA, 357 nt, Artificial Sequence
  derived and/or modified sequence opt3 from HuMab-050_HeavyChain_VDJ-Region
gaggugcagcugcucgaaagcggcgggggacuuguccaacccgguggcucccugagauugucuugcgccgcuucaggguucaccuuuaguagcuacgcaaugaacuggguuaggcaggccccuggaaagggcuuagaguggguguccgcgaucucuggucgcgggggaacaacuuauuacgcugacucgguaaaaggccgguucacgauuucacgagauaauagcaagaacacccuguaucuacagaugaguucccuccgugccgaagacacagcaguguacuauugugccaaagcuagagcaaauugggauuacuuugacuauuggggccaggggacucuggucaccgugucuagc

SEQ ID NO: 23293 - RNA, 321 nt, Artificial Sequence
  derived and/or modified sequence opt3 from HuMab-050_LightChain_VJ-Region
gacauccagaugacccaaagccccuccucugugucagccagugucggcgauagaguuacaauuacuugcagggcuagccaggggauauccucuuggcuggcaugguaccagcacaagccuggaaaagccccaaagcuccuuaucuaugcggcuucgauucugcagucaggugugccgagccgguucaguggcuccgggucuggaacggacuuuaccuugacaaucagcuccuuacaacccgaggauuucgccacuuacuauugucagcaggcaaacucauuuccuauuaccuucggccaggguacacgccuggaaaucaaa

SEQ ID NO: 23294 - RNA, 360 nt, Artificial Sequence
  derived and/or modified sequence opt3 from HuMab-054_HeavyChain_VDJ-Region
caggugcaacugcagcaguggggcgccgggcuccuuaagcccagcgagacccuguccuugacaugcgcugucuacggagguucuuucucaggcuauuacuggaguuggaucagacagccuccagggaaaggauuagaauggauuggcgagauacaccauagcgguuccacuaacuauaauccgucucugaagucgaggguuacgaucucaguggacaccagcaaaaaccaauuuagucuaaagcucuccucuguaacagcagccgauacugcgguguacuauugugcucggcugugguacgggagcggauccuauuacuucgacuacuggggccagggcacccuugucacagugucaagu

SEQ ID NO: 23295 - RNA, 321 nt, Artificial Sequence
  derived and/or modified sequence opt3 from HuMab-054_LightChain_VJ-Region
gacauccagaugacccaaagccccuccucucugucagccagugugggcgauagagucacaauuacuugcagggcuagccaggggauauccucuuggcucgcaugguaccagcagaagccugagaaagccccaaagucgcuuaucuaugcggcuucaagccugcaaaguggaguuccgucccgguucucugguagcggcuccgggacggacuuuaccuugacaauuucaaguuuacagcccgaagauuucgccacuuacuauugucagcaguacaacagcuuuccuccaaccuucggaggcgguacaaaaguggagaucaag

SEQ ID NO: 23296 - RNA, 357 nt, Artificial Sequence
  derived and/or modified sequence opt3 from HuMab-055_HeavyChain_VDJ-Region
gaggugcagcugcucgaaagcggcgggggacuuguccaacccgguggcucccugagauugucuugcgccgcuucaggguucaccuuuaguagcuacgcaaugaacuggguuaggcaggccccuggaaagggcuuagaguggguguccgcgaucucuggucgcgggggaacaacuuauuacgcugacucgguaaaaggccgguucacgauuucacgagauaauagcaagaguacccugugucuacagaugaacucccuccgugccgaagacacagcaguguauuacugcgccaaagcuagagcaaauugggauuauuuugacuacuggggccaggggacucuggucaccgugucuagc

SEQ ID NO: 23297 - RNA, 366 nt, Artificial Sequence
  derived and/or modified sequence opt3 from HuMab-059_HeavyChain_VDJ-Region
caggugcaacugguccagagcggcgccgagguuaagaagcccggggcuuccgugagaguaccuugcaaggcaucuggauacaccuucacaagguaugguaucucaugggugcggcaggccccaggccaggggcucgaauggaugggauggauuagugcguacaacggcaaaacuuauuacgcucaaaaacuucagggucgcgucacgaugaccacagacacuagcaccuccacagccuauauggagcugcgaucuuugcguucggaugacaccgcaguguacuauugugccagaucaccguuacugugguuugaggaacuauacuucgauuacugggggcagggaacucucguuacagugagcagu

SEQ ID NO: 23298 - RNA, 324 nt, Artificial Sequence
  derived and/or modified sequence opt3 from HuMab-059_LightChain_VJ-Region
gagaucgugcugacccagagccccggcacacucucccuuucuccuggggaaagagccacucugucaugcagggcuagucaaagcgucuccucuacguacuuggcaugguaucagcagaagccaggacaggccccgcgguuacugauuuacggugcgucgucacgcgcuaccggcauacccgaccgauucagcgggaguggauccggcacagauuuuacucuaaccaucucucgucucgagccugaagacuucgccguuuauuacugucaacaguaugguacaagccuguuuaccuucgggccaggaacuaaaguggauauuaag

SEQ ID NO: 23299 - RNA, 366 nt, Artificial Sequence
  derived and/or modified sequence opt3 from HuMab-060_HeavyChain_VDJ-Region
gaggugcagcugguccaaagcggcgccgaaguuaagaaacccggggagucccucaagaucucuugcaaaggaucagguuacagauucaccaguuauuggauuggcugggugaggcagaugccugggaagggacuugaauggaugggcagcauauacccaggugacuccuauacacggaacucuccgucguuucaggggcagguaacuaucucagcugauaaaagcauugcaacggccuaccugcaauggaauaguuugaaggcguccgacaccgcuauguauuacugugcccgccacgcaggagauuucuauuacuuugacggcuuagauguguggggccaggggacaacugucaccgugucuagc

SEQ ID NO: 23300 - RNA, 327 nt, Artificial Sequence
  derived and/or modified sequence opt3 from HuMab-060_LightChain_VJ-Region
gagaucgugcugacccagagccccggcacacucucccuuucuccuggggaaagagccacucugucaugcagggcuagucaaagcgucuccucuucguacuuggcaugguaucagcagaagccaggacaggccccgcgguuacugauuuacggugcgucaagccgcgcuacgggcauacccgaccgauucaguggguccggaucuggcaccgauuuuacacuaacuaucagccgucucgagccugaagacuucgccguuuauuacugucaacaguaugguuccucaccacccauuaccuuugggcagggaacaagacuggagaucaaa

SEQ ID NO: 23301 - RNA, 366 nt, Artificial Sequence
  derived and/or modified sequence opt3 from HuMab-067_HeavyChain_VDJ-Region
gaggugcagcugguccaaagcggcgccgaaguuaagaaacccggggagucccucaagaucucuugcaaaggaucagguuacaguuucaccagcuauuggauuggcugggugagacagaugccugggaagggacuugaauggaugggcauaaucuacccaggugacuccgauacaagguauucuccgucguuucaggggcagguaacuauuucaguggacaaaagcaucaguacggcuuaccugcaaugguccucuuugaaggcaagcgauaccgccauguauuacugugcgcggcagaagggagacuauuacuaccacuauggcuuagaugucuggggccaggggacaacugugaccguuuccuca

SEQ ID NO: 23302 - RNA, 366 nt, Artificial Sequence
  derived and/or modified sequence opt3 from HuMab-072_HeavyChain_VDJ-Region
gaggugcagcugguccaaagcggcgccgaaguuaagaaacccggggagucccucaagaucucuugcaaaggaucagguuacaguuucaccagcuauuggauuggcugggugagacagaugccugggaagggacuugaauggaugggcauaaucuacccaggugacuccgauacaagguauucuccgucguuucaggggcagguaacuauuucagcugacaaaagcaucaguacggcauaccugcaaugguccucuuugaaggccagcgauaccgcgauguauuacugugcucggcagaagggagacuauuacuacuucaacggcuuagauguguggggccaggggacaacugucaccguguccuca

SEQ ID NO: 23303 - RNA, 327 nt, Artificial Sequence
  derived and/or modified sequence opt3 from HuMab-072_LightChain_VJ-Region
gagaucgugcugacccagagccccggcacacucucccuuucuccuggggaaagagccacucugucaugcagggcuagucaaagcgucuccucuucguacuuggcaugguaucagcagaagccaggacaggccccgcgguuacugauuuacggugcgucaagccgcgcuacgggcauacccgaccgauucaguggguccggaucuggcaccgauuuuacacuaacuaucagccgucucgagccugaagacuucgccguuuauuacugucaacaguaugguuccucaccaagacugaccuuugggggaggcacaaaaguggagauuaag

SEQ ID NO: 23304 - RNA, 363 nt, Artificial Sequence
  derived and/or modified sequence opt3 from HuMab-084_HeavyChain_VDJ-Region
caggugcaacugguccagagcggcgccgagguuaagaaacccggguccucugugaagguaucaugcaaagcuaguggagguaccuucagaacauacgcaaucaacugggugaggcaggccccuggccaggggcucgaauggaugggacggauuaauacuguccuuggcauagugaaccacgcgcaaaaguuucagggucgcguuacgaucaccgcugacaaaagcacaaauacugccuauauggagcugaacuccuugcgaucugaagauaccgcaguguacuauugugcccgugagaagggggucgacuacuauuacggaauugaaguguggggccagggcacaaccguaacuguuucguca

SEQ ID NO: 23305 - RNA, 321 nt, Artificial Sequence
  derived and/or modified sequence opt3 from HuMab-084_LightChain_VJ-Region
gacauccagaugacccaaagccccuccucugugucagccagugucggcgauagaguuacaauuacuugcagggcuagccaggggauauccucuuggcuggcaugguaccagcacaagccuggaaaagccccaaagcuccuuaucuauguggcgucgacgcugcagucagguguaccgagccgguucaguggcuccgggucuggaaccgacuuuacauugacuauuagcuccuuacaacccgaggauuucgcuaccuacuauugucagcaggccaacucauuuccucugacauucggcggugggaccaaaguggaaaucaag

SEQ ID NO: 23306 - RNA, 360 nt, Artificial Sequence
  derived and/or modified sequence opt3 from HuMab-091_HeavyChain_VDJ-Region
caggugcaacugcagcaguggggcgccgggcuccuuaagcccagcgagacccuguccuugacaugcgcugucucuggagguucauucaguggcuacuauuggacuuggaucagacagccuccagggaaaggauuagaauggauuggcgagauauaccacagcggugacacgaacuauaauccgucccugaagucuaggguuaccaucucgguggauacaagcaaaaaccaauuuucacuaaagcucuacaguguaacugcagccgacaccgcgguguauuacugugcucggcuguauuucggguccggaauuuacuaccuugauuauuggggccagggcacacuggucaccgugucuagc

SEQ ID NO: 23307 - RNA, 321 nt, Artificial Sequence
  derived and/or modified sequence opt3 from HuMab-091_LightChain_VJ-Region
gacauccagaugacccaaagccccuccucucugucagccagugugggcgauagagucacaauuacuugcagggcuagccaggggauauccucuuggcucguuugguaccagcagaagccugagaaagcaccaaagucgcuuaucuaugccgcgucaagccugcaaaguggagugccgucccgguucucugguagcggcuccgggacggacuuuaccuugacaauuucaaguuuacagcccgaagauuucgcuacuuacuauugucagcaguacaacagcuuuccuccaaccuucggacaaggcacaaaaguagagaucaag

SEQ ID NO: 23308 - RNA, 366 nt, Artificial Sequence
  derived and/or modified sequence opt3 from HuMab-093_HeavyChain_VDJ-Region
gaggugcagcugguccaaagcggcgccgaaguuaagaaacccggggagucccucaagaucucuugcaaaggaucagguuacaguuucaccagcuauuggauuggcugggugagacagaugccugggaagggacuugaauggaugggcaggauauacccaggugacuccgauacacgguauucuccgucguuucaggggcagguaacuaucucagcugacaaaagcauuacgaccgcauaccugcaauggaguuccuugcgcgccucugauacagcgauguauuacugugcucgacagcguggagacuauuacuacuucuuuggcuuagauaucuggggccaggggacuaccgugacagucagccug

SEQ ID NO: 23309 - RNA, 372 nt, Artificial Sequence
  derived and/or modified sequence opt3 from HuMab-098_HeavyChain_VDJ-Region
gaggugcagcugcucgaaagcggcgggggacuuguccaacccgguggcucccugagauugucuugcgccgcuucaggguucaccuuuaguaauuacggaaugagcuggguuaggcaggcaccuggcaaggguuuagaguggguguccgccaucucugggucggcguauucaacauacuaugcugacagcguaaaaggacgguucacuauuagucgcgauaauuccaagaacacgcuguggcuacagaugaacucucuccgagccgaagacaccgcaguguacuauugugccaaagcucacuaccauggcagcggcuccuauuacacacuguuugauuacugggggcagggaacucuugucaccgugucaagu

SEQ ID NO: 23310 - RNA, 321 nt, Artificial Sequence
  derived and/or modified sequence opt3 from HuMab-098_LightChain_VJ-Region
gacauccagaugacccaaagccccuccucucugucagccagugugggcgauagagucacaauuacuugcagggcuagccaggggauauccucuuggcucgcaugguaccagcagaagccugagaaagccccaaagucgcuuaucuaugcggcuucaagccugcaaaguggaguuccgucccgguucucugguagcggcuccgggacggacuuuaccuugacaauuucaaguuuacagcccgaagauuucgccacuuacuauugucagcaguacaacagcuauccuuacaccuuuggacaaggcacaaaacuggagaucaag

SEQ ID NO: 23311 - RNA, 372 nt, Artificial Sequence
  derived and/or modified sequence opt3 from HuMab-100_HeavyChain_VDJ-Region
gaggugcagcugcucgaaagcggcgggggacuuguccaacccgguggcucccugagauugucuugcgccgcuucaggguucaccuuuaacaauuacggaaugaacuggguuaggcaggcaccuggcaaggguuuagagugggugagugccaucagcgggacaggauauuccacuuacuaugcggacucuguaaaaggccgguucacgauuucgcgcgauaauucaaagaacacccuguaccuacagaugaauagccuccgagcugaagacacagccguguauuacugugcaaaagcccacuauuuuggcaguggguccuacuacacucuguucgauuauuggggacaggguacccuugucacagugucuagc

SEQ ID NO: 23312 - RNA, 372 nt, Artificial Sequence
  derived and/or modified sequence opt3 from HuMab-106_HeavyChain_VDJ-Region
gaggugcagcugguccaaagcggcgccgaaguuaagaaacccggggagucccucaagaucucuugcaaaggaucagguuacaguuucaccagauauuggauuggcugggugaggcagaugccugggaagggacuugaauggaugggcauaaucuacccaggugacagcgauacacgguauuccccgucuuuucaggggcagguaacuauuucggcugacaaaucaaucagcacggcauaccugcaauggaguuccuugaaggccucugauaccgcgauguauuacugugcucgcuuaacaggagaccgaggcuucgauuauuacagcggcauggacgugugggggcagggaacuaccgucacaguguccuca

SEQ ID NO: 23313 - RNA, 321 nt, Artificial Sequence
  derived and/or modified sequence opt3 from HuMab-106_LightChain_VJ-Region
gagaucgugcugacccagagccccggcacacucucccuuucuccuggggaaagagccacucugucaugcagggcuagucaaagcgucuccucuucguacuuggcaugguaucagcagaagccaggacaggccccgcgguuacugauuuacggugcgucaagccgcgcuacgggcauacccgaccgauucaguggguccggaucuggcaccgauuuuacacuaacuaucagccgucucgagccugaagacuucgccguuuauuacugucaacaguaugguuccucauuuaccuucgggccaggaacaaaaguggauauuaag

SEQ ID NO: 23314 - RNA, 351 nt, Artificial Sequence
  derived and/or modified sequence opt3 from HuMab_10F8_HeavyChain_V-Region
caggugcaacuggucgagagcggcgggggaguugugcagcccgguagaucccucaggcuuucuugcaccgccucaggcuucacauuuagucacuacgggauguauuggguacggcaggcuccuggaaagggccuggaauggguggcagucaucugguacgacgguagcuaugaguacaaugaagauuccgugaaagggcgcuucacuauuucucgagacaauucgaagaacacguuguauuuacagaugaacucacugcgugccgaggauaccgcgguuuacuauugugcuagagacagggugggacuauuugauuacuggggccaaggcacacucgucacugugagcagu

SEQ ID NO: 23315 - RNA, 408 nt, Artificial Sequence
  derived and/or modified sequence opt3 from HuMab_10F8_HeavyChain_V-Region_Precursor
auggaguucggccugagcuggguguuucucgucgcccuucugagagggguucagugccaagugcaguugguagaauccggagguggcgugguccagcccgggaggucuuuacggcugucauguaccgcuaguggauucacauuuagccacuacggcauguauugggugcgccaggcaccugguaaggggcuagaguggguugccgugaucugguacgacggauccuaugaauacaacgcggauucugucaaaggccgauucacuauuucgcgugacaauucaaagaacacgcucuaucugcaaaugaauagccuuagagcugaggauaccgccguguacuauugcgcaagggaccggguaggccuguuugauuacugggggcagggaacauugguuacugugaguucc

SEQ ID NO: 23316 - RNA, 321 nt, Artificial Sequence
  derived and/or modified sequence opt3 from HuMab_10F8_LightChain_V-Region
gagaucgugcugacccagagccccggcacacucucccuuucuccuggggaaagagccacucugucaugcagggcuagucaaagcauuuccucuucguacuuggcaugguaucagcagaagccaggacaggccccgcgguuacugauauacggucccucaagccgcgcgacgggcaucccugaccgauucaguggguccggaucuggcaccgauuuuacacuaacuauuagccgucucgagccagaagacuucgcugucuauuacugucaacaguaugccgguucccugaccuuugggcccggaacaaaaguugauaucaag

SEQ ID NO: 23317 - RNA, 381 nt, Artificial Sequence
  derived and/or modified sequence opt3 from HuMab_10F8_LightChain_V-Region_Precursor
auggagacccccgcccagcuccuguuccuucuguuguuauggcugccugacacaacuggcgaaaucgugcuaacgcaaagcccagggacccucucccugucuccgggagagagagcuacacuuucaugcagggcaagucagagcauuuccucuucguaccuggccugguaucagcagaagcccggucaagcgccucgguugcucauauacggcccaucaagccgcgcuacugggauccccgaucgauuuaguggauccggcucugguaccgacuucacacugaccauuagccgucuggaaccugaggauuuugccgucuauuacugucagcaguaugcagggucccucacuuucggaccaggcacaaaaguugacaucaag

SEQ ID NO: 23318 - RNA, 357 nt, Artificial Sequence
  derived and/or modified sequence opt3 from HuMab-111_HeavyChain_VDJ-Region
caggugcaacugguccagagcggcgccgagguuaagaaacccggguccucugugaagguaucaugcaaagcuaguggagguaccuucagcuccuacggcaucucuugggugagacaggcaccugggccaggacucgaauggaugggcaggauuauaccgauccuugguauugccaacuaugcgcagaaguuucaagggcgggucacaaucacugcugacaaaucgacgaauaccgccuacauggagcugagcucauugcgcagugaagauacagcaguguauuacugugcccgagaccaggaguauuccucuaacugguacuauuggggacagggcacuuuaguuaccgugagcucc

SEQ ID NO: 23319 - RNA, 321 nt, Artificial Sequence
  derived and/or modified sequence opt3 from HuMab-111_LightChain_VJ-Region
gagaucgugcugacccagagccccggcacacucucccuuucuccuggggaaagagccacucugucaugcagggcuagucaaagcguccgguccucuuacuuggcaugguaucagcagaagccaggacaggccccgcgcuuacugauuuacggugcgucgucacgagcuacgggcauacccgaccguuucagcgggaguggauccggcaccgauuuuacacuaacuaucucuagacucgagccugaagacuucgccguuuauuacugucaacuguaugguagcuccccaaccuuugggcccggaacaaaaguggauauuaag

SEQ ID NO: 23320 - RNA, 363 nt, Artificial Sequence
  derived and/or modified sequence opt3 from HuMab-123_HeavyChain_VDJ-Region
caggugcaacugguccagagcggcgccgagguuaagaagcccggggcuuccgugaagguaucuugcaaagcagccggauacaccuucacaaacuaugguaucucaugggugagacaggcgccuggccaggcucucgaauggaugggguggauuacuacguacaguagcaauaccauauaugcccaaaaacuucagggaagggucacaaugacuaccgacacauccaccucuacugcauacauggagcugcggucguugcgcucagaugacacagccguguauuacugugcucgagaucguguuguggucagaccagacuauuuugauuacuggggccaggguaccuuagugacgguaagcagu

SEQ ID NO: 23321 - RNA, 321 nt, Artificial Sequence
  derived and/or modified sequence opt3 from HuMab-123_LightChain_VJ-Region
gagaucgugcugacccagagccccgccacacucucccuuucuccuggcgaaagagcuacucugucaugcagggcaagucaaagcgucuccucuuacuuggccugguaucagcagaagccagggcaggcgccgcgguuacugauuuacgacacgucgaaccgcgcuaccggaauacccgcccgauucucagguagcggcagugggacagauuuuacucuaaccaucuccucucucgagccugaagacuucgcaguuuauuacugucaacagcguagccacuggccaagaacauuuggacagggcaccaaaguggagauuaag

SEQ ID NO: 23322 - RNA, 363 nt, Artificial Sequence
  derived and/or modified sequence opt3 from HuMab-124_HeavyChain_VDJ-Region
caggugcaacugguccagagcggcgccgagguuaagaaacccggggcuuccgugaagguaucuugcaaagcagccggauacaccuucacaaacuaugguaucucaugggugagacaggcgccuggccaggggcucgaauggaugggauggauuauaacuuacaauggcaacacgaucuaugcucaaagguuucaggaccgggucaccaugacaacugauaccaguacaagcaccgccuacauggagcuucgcucccugcgaucugacgauacugcaguguauuacugugcccgugacagaauuaucguuaggccagauuauuucgacuacuggggucaggggacauuggugaccgucucguca

SEQ ID NO: 23323 - RNA, 372 nt, Artificial Sequence
  derived and/or modified sequence opt3 from HuMab-125_HeavyChain_VDJ-Region
gaggugcagcugcucgaaagcggcgggggacuuguccaacccgguggcucccugagauugucuugcgccgcuucaggguucaccuuuacagacuacgcaaugaacuggguuaggcaggccccuggaaagggcuuagagugggugaguacuaucagcgguuccggguaugcgacguacuaugcugauucuguaaaaggacgguucaccauuucgcgcgacaauucaaagacaacucuguaccuacagaugaacagccuccgagccgaagauaccgcaguguauuacugugccaaaggccacacacugggcaguggguccuauuacacccuuuuugacuacuggggacaggguacucuggucacagugucuagc

SEQ ID NO: 23324 - RNA, 321 nt, Artificial Sequence
  derived and/or modified sequence opt3 from HuMab-125_LightChain_VJ-Region
gacauccagaugacccaaagccccuccucucugucagccagugugggcgauagagucacaauuacuugcagggcuagccaggggauaaacuccuggcucgcaugguaccagcagaagccugagaaagccccaaagucucuuaucuaugcggcuucgucacugcaaagcggaguuccgagucgguucuccgguucuggcagcgggacggacuuuaccuugacaauuuccucauuacagcccgaagauuucgccacuuacuauugucagcaguacaauaguuauccuuacaccuuuggacaaggcacaaaacuggagaucaag

SEQ ID NO: 23325 - RNA, 369 nt, Artificial Sequence
  derived and/or modified sequence opt3 from HuMab-127_HeavyChain_VDJ-Region
gaggugcagcugguccaaagcggcgccgaaguuaagaaacccggggagucccucaccaucucuugcaagggaucagguuacaguuucagcauuuauuggauaggcugggugagacagaugccugggaaaggacuugaauggaugggcaucauuuuuccaggugacuccgauaucagguacucuccgucguuccaggggcagguaacaauuucagcugacaagagcaucaguacugcauaucugcaaugguccucuuugaaagccagcgauacggcgauguacuauugugcucggcagcccggagacugguccccucgccacugguacuuugauuuauggggccgaggcacccuggugacagucucaagu

SEQ ID NO: 23326 - RNA, 321 nt, Artificial Sequence
  derived and/or modified sequence opt3 from HuMab-127_LightChain_VJ-Region
gugaucuggaugacccagagccccucccugcucucugccucaacaggcgacagagucacuauuaguugcaggaugagccaagggauauccucuuaccuugcuugguaucagcagaagccuggaaaagcaccagagcuguugaucuacgccgcgucgacguuacagucagguguuccgagccgguucaguggcuccgggucuggaaccgauuuuacacugacuauuagcuaucuacaauccgaagacuucgcuaccuacuauugucagcaguacuauucauuuccccucacauucggcggugggaccaagguggagaucaaa

SEQ ID NO: 23327 - RNA, 357 nt, Artificial Sequence
  derived and/or modified sequence opt3 from HuMab-129_HeavyChain_VDJ-Region
caggugcaacuggucgagagcggcgggggaguugugcagcccgguagaucccucaggcuuucuugcgccgcuucaggcuucaccuuuaguacauucgcaauccacuggguacggcaggccccugggaagggacuggaauggguggcggucauuagcuacgacggcggucauaaauuuuaugcugauuccgugaaggggcgcuucacuauaucucgagacaacucgaaaaauacguuguacuuacagaugaacucacugcgugccgaggauaccgcaauguauuacugugccagaggacuaggcguuuggggcgcuuuugacuauugggggcaaggaacacucgugacugucagcagu

SEQ ID NO: 23328 - RNA, 318 nt, Artificial Sequence
  derived and/or modified sequence opt3 from HuMab-129_LightChain_VJ-Region
gagaucgugcugacccagagccccgccacacucucccuuucuccuggcgaaagagcuacucugucaugcagggcaagucaaagcgucuccucuuacuuggccugguaucagcagaagccagggcaggcgccgcgguuacugauuuacgacgcuucgaaccgcgccacgggaauacccgcacgauucucagguagcggcagugggaccgauuuuacacuaacuaucuccucucucgagccugaagacuucgccguuuauuacugucaacagcguagcaauugguggaccuuuggacagggcacaaaaguggagauuaag

SEQ ID NO: 23329 - RNA, 375 nt, Artificial Sequence
  derived and/or modified sequence opt3 from HuMab-132_HeavyChain_VDJ-Region
caggugcaacugguccagagcggcgccgagguuaagaaacccggggcuuccgugaagguaucuugcaaagcaucaggauacaccuucacaaguuaugguaucagcugggugagacaggccccuggccaggggcucgaauggaugggauggauuuccgcguacaacggcaauucuaacuauguccaaaaguuucaggguagggugacuaugacgaccgacacaacuaccucgacagcuuacauggagcuucggucacugaccagcgaugacacugccguuuauuacugugcacgcgaauauaguuacgauuccgggacauacuucuauuacggaauggacguguggggccagggcaccacggucacugugucuagc

SEQ ID NO: 23330 - RNA, 324 nt, Artificial Sequence
  derived and/or modified sequence opt3 from HuMab-132_LightChain_VJ-Region
gagaucgugcugacccagagccccgccacacucucccuuucuccuggcgaaagagcuacucugucaugcagggcaagucaaagcgucuccucuuacuuggccugguaucagcagaagccagggcaggcgccgcgguuacugauuuacgacgcuucgaaccgcgccacgggaauacccgcacgauucucagguagcggcagugggaccgauuuuacacuaacuaucuccucucucgagccugaagacuucgccguuuauuacugucaacagcguagcaauuggccaauguauaccuuuggacagggcacaaaacuggagauuaag

SEQ ID NO: 23331 - RNA, 360 nt, Artificial Sequence
  derived and/or modified sequence opt3 from HuMab-143_HeavyChain_VDJ-Region
caggugcaacugcagcaguggggcgccgggcuccuuaagcccagcgagacccuguccuugacaugcgcugucuacggagguucuuucucaggcuauuacuggaacuggaucagacagccuccagggaaaggauuagaauggauuggcgagauacaccauagugguagcgcaaauuauaacccgucccugaugucuaggguuacuaucucgguggacacgucaaagaaucaauuuagccuacagcucaguuccguaaccgccgcggauacagcuguguacuauugugcccggggguacuauggaucuggcuacuacuauuucgacuacuggggccaggggacucuggucaccgugagcucc

SEQ ID NO: 23332 - RNA, 321 nt, Artificial Sequence
  derived and/or modified sequence opt3 from HuMab-143_LightChain_VJ-Region
gacauccagaugacccaaagccccuccucucugucagccagugugggcgauagagucacaauuacuugcagggcuagccaggggauauccucuuggcucgcaugguaccagcagaagccugagaaagccccaaagucgcuuaucuaugcggcuucacggcugcaaagcggaguuccgagucgcuucuccgguucuggcagcgggacggacuuuaccuugacaauuuccucauuacagcccgaagauuucgccacuuacuauugucagcaguacaacaguuauccuaucaccuuuggacaaggcacacgacuggagauuaaa

SEQ ID NO: 23333 - RNA, 366 nt, Artificial Sequence
  derived and/or modified sequence opt3 from HuMab-150_HeavyChain_VDJ-Region
gaggugcagcugguccaaagcggcgccgaaguuaagaaacccggggagucccucaagaucucuugcaaaggaucagguuacaguuucaccagcuauuggauuggcugggugagacagaugccugggaagggacuugaauggaugggcuccauauacccaggugacucucacacaagguaucggccgucguuucaggggcagguaacuaucucagcugauaaaagcauuaguacggcauaccugcaaugguccucuuugaaggccagcgacaccgcgauguauuacugugcucgccaggccggagauuauuacuacuauaacggcauggacguguggggccaggggacaacugucaccguguccuca

SEQ ID NO: 23334 - RNA, 321 nt, Artificial Sequence
  derived and/or modified sequence opt3 from HuMab-150_LightChain_VJ-Region
gagaucgugcugacccagagccccggcacacucucccuuucuccuggggaaagagccacucugucaugcagggcuagucaaagcgucuccucuucguacuugacgugguaucagcagaagccaggacaggcaccgcgguuacugauuuacggugccucaagccgcgcgaccggcauacccgaccgauucaguggguccggaucuggcacagauuuuacucuaaccaucagccgucucgagccugaagacuucgcuguuuauuacugucaacaguaugguuccucacugacauuugggggaggcaccaaaguggagauuaag

SEQ ID NO: 23335 - RNA, 363 nt, Artificial Sequence
  derived and/or modified sequence opt3 from HuMab-152_HeavyChain_VDJ-Region
caggugcaagucguugagagcggcgggggagugguacagcccgguagaucccugaggcucucuugcgccgcuucaggcuucaccuuuaguagcuacgcaaugcacugggugcggcaggccccugggaagggacuugaaugggucgcggugaucuccuaugacggcucuuacaaauauuacgcugauucgguuaagggucgcuucacaauuucacgagacaacagcaaaaauacucuguauuugcagaugaacaguuuacgugccgaggauacggcaguguacuauugugccagaggguccauaaccggaucuacaggcgucuuugacuacuggggccaagggacucuggugaccguaagcucc

SEQ ID NO: 23336 - RNA, 321 nt, Artificial Sequence
  derived and/or modified sequence opt3 from HuMab-152_LightChain_VJ-Region
gacauccagaugacccaaagccccuccucucugucagccagugugggcgauagagucacaauuacuugcagggcuagccaggggauaaacuccuggcucgcaugguaccagcagaagccugagaaagccccaaagucucuuaucuaugacgcgucgucacugcaaagcggaguuccgagucgguucuccgguucuggcagcgggacggauuuuaccuugacaauuuccucauuacagcccgaaaauuucgcuacuuacuauugucagcaguacaacaguuauccuaucaccuuuggacaaggcacacgccuggagauuaaa

SEQ ID NO: 23337 - RNA, 363 nt, Artificial Sequence
  derived and/or modified sequence opt3 from HuMab-153_HeavyChain_VDJ-Region
caggugcaacuggucgagagcggcgggggaguugugcagcccgguagaucccucaggcuuucuugcgccgcuucaggcuucaccuuuagugacuacguaauccacugggugcggcaggcaccugggaaaggacuggaaugggucacagugauuagcuaugauggcuccaacaaauacuaugccgacucuguuaagggucgcuucacuauaucgcgagauaauucaaagaacacguuguacuuacagaugaauagccugagugcggaggacaccgcuauguauuacugugcccgugggggaaucacaggcacuaccggcguguuugauuauugggggcaaggaacccuagucacaguguccucu

SEQ ID NO: 23338 - RNA, 321 nt, Artificial Sequence
  derived and/or modified sequence opt3 from HuMab-153_LightChain_VJ-Region
gacauccagaugacccaaagccccuccucucugucagccagugugggcgauagagucacaauuacuugcagggcuagccaggggauauccucuuggcucgcaugguaccagcagaagccugagaaagccccaaagucgcuuaucuaugacgcgucaagccugcaaaguggaguuccgucccgguucucugguagcggcuacgggacggauuuuuccuugaccauuucaaguuuacagcccgaagacuucgcuaucuauuacugucagcaguauaaaagcuacccuauuacauuuggacaaggcacucgccuggagaucaag

SEQ ID NO: 23339 - RNA, 378 nt, Artificial Sequence
  derived and/or modified sequence opt3 from HuMab-159_HeavyChain_VDJ-Region
gaggugcagcugguccaaagcggcgccgaaguuaagaaacccggggagucccucaagaucucuugcaaaggaucagguuacaacuucaccaguuauuggauuggcugggugagacagaugccugggaagggacuugaauggaugggcauaaucuacccaggugacagcgauacaagguauuccccgucuuuucaggggcagguaacuauuucggcugacaaaucaaucagcacggcauaccugcaauggaguuccuugaaggccucugauaccgcgauguauuacugugcucgguggggaacauauuacgacauuuuaacuggcuacuucaauugguuugaucccuggggccaggggacccuggugacagucagcucc

SEQ ID NO: 23340 - RNA, 321 nt, Artificial Sequence
  derived and/or modified sequence opt3 from HuMab-159_LightChain_VJ-Region
gacauccagaugacccaaagccccuccucucugucagccagugugggcgauagagucacaauuacuugcagggcuagccaggggauauccucuuggcucgcaugguaccagcagaagccugagaaagccccaaagucgcuuaucuaugcggcuucaagccugcaaaguggaguuccgucccgguucucugguagcggcuccgggacggacuuuaccuugacaauuucaaguuuacagcccgaagauuucgccacuuacuauugucagcaguacuauaucuacccuuggaccuuuggacaaggcacaaaaguggagauuaag

SEQ ID NO: 23341 - RNA, 363 nt, Artificial Sequence
  derived and/or modified sequence opt3 from HuMab-160_HeavyChain_VDJ-Region
caggugcaacuggucgagagcggcgggggaguugugcagcccgguagaucccucaggcuuucuugcgccgcuucaggcuucaccuuuaguagccacgcaaugcauuggguacggcaggccccugggaagggacuggaauggguggcggcuaucuccuacgacggcucuaacaaauauuacgccgauucggucaagggucgcuucacaauuucacgagacaauagcaaaaacacuauguauuugcagaugaauaguuuacgugcagaggauacggccauguguuacugcgcuagaggguccauaaccggaucuacaggcguguuugacuauuggggccaagggacucugguuaccgugagcucc

SEQ ID NO: 23342 - RNA, 321 nt, Artificial Sequence
  derived and/or modified sequence opt3 from HuMab-160_LightChain_VJ-Region
gacauccagaugacccaaagccccuccucucugucagccagugugggcgauagagucacaauuacuugcagggcuagccaggacauauccucuuggcucgcaugguaccagcagaagccugagaaagccccaaagucgcuuaucuaugcggcuucaagccugcaaagugggguuccgucccgguucucuggaagcgguuccggcacggauuuuaccuugacaauuucaaguuuacagcccgaagacuucgccacuuacuauugucagcaguacaacagcuauccuaucaccuuugggcaaggaacacgccuggagauuaaa

SEQ ID NO: 23343 - RNA, 372 nt, Artificial Sequence
  derived and/or modified sequence opt3 from HuMab-162_HeavyChain_VDJ-Region
gaggugcagcugugggaaagcggcgggggauccguccaacccgguggcucucucagacuuucaugcgccgcuaguggguucaccuuuagcuccuacggaaugucuuggguuaggcaggcaccuggcaagggucuggagugggugucggggaucucaggaagcggcuauaguacauacuaugccgacuccguaaaaggccgguucacuauuucucgcgauaacagcaagaauacguuguacuuacagaugaacucccugcgagcggaagacaccgcuguguauuacugugccaaaggguauuaccacggaucagguaguuacuauacaucuuuugauuacuggggccaggggacucuagucaccgugagcucc

SEQ ID NO: 23344 - RNA, 321 nt, Artificial Sequence
  derived and/or modified sequence opt3 from HuMab-162_LightChain_VJ-Region
gacauccagaugacccaaagccccuccucucugucagccagugugggcgauagagucacaauuacuugcagggcuagccaggggauauccucuuggcucgcaugguaccagcagaagccugagaaagccccaaagucgcuuaucuaugcggcuucaagccugcaaaguggaguuccgucccgguucucugguagcggcuccgggacggacuuuaccuugacaauuucaaguuuacagcccgaagauuucgccacuuacuauugucagcaguacaacagcuauccucugaccuuuggaggcgguacaaaaguggagaucaag

SEQ ID NO: 23345 - RNA, 366 nt, Artificial Sequence
  derived and/or modified sequence opt3 from HuMab-163_HeavyChain_VDJ-Region
gaggugcagcugguccaaagcggcgccgaaguuaagaaacccggggagucccucaagaucucuugccagggaucagguuacagauucauuaguuauuggauaggcugggugaggcagaugccugggaaaggacuugaauggaugggccggaucuacccaggugacagcgauacccgcuauuccccgucuuuucaggggcaaguaacaauuucgguggacaagucaaucagcacugcuuaccugcaguggaguuccuugaaagcaucugauacggccauguauuacugugcgcgacagcguggagacuauuacuacuucaacggcuuagaugucuggggccaggggaccacagugacuguuagcucc

SEQ ID NO: 23346 - RNA, 321 nt, Artificial Sequence
  derived and/or modified sequence opt3 from HuMab-163_LightChain_VJ-Region
gagaucgugcugacccagagccccggcacacucucccuuucuccuggggaaagagccacucugucaugcagggcuagucaaagcgucuccucuucguacuuggcaugguaucagcagaagccaggacaggccccgcgguuacugauuuacggugcgucaagccgcgcuacgggcauacccgaccgauucaguggguccggaucuggcaccgauuuuacacuaacuaucagccgucucgagccugaagacuucgccguuuauuacugucaacaguaugguuccucacugaccuuugggggaggcacaaaaguggagauuaag

SEQ ID NO: 23347 - RNA, 363 nt, Artificial Sequence
  derived and/or modified sequence opt3 from HuMab-166_HeavyChain_VDJ-Region
caggugcaacuggucgagagcggcgggggaguugugcagcccgguagaucccucaggcuuucuugcgccgcuucaggcuucaccuuuaguagcuacgcaaugcacuggguacggcaggccccugggaagggacuggaauggguggcggucaucuccuaugacggcucuaacgaguacuaugcugauucggugaaaggucgcuucacaauuucacgagacaauagcaagaacacuuuguacuuacagaugaauagucugcgugccgaagauacggcaguuuauuacugugccagaggguccauaaucggaucuaccggcguguuugacuauuggggccaagggacucuagucacagugagcucc

SEQ ID NO: 23348 - RNA, 321 nt, Artificial Sequence
  derived and/or modified sequence opt3 from HuMab-166_LightChain_VJ-Region
gacauccagaugacccaaagccccuccucucugucagccagugugggcgauagagucacaauuacuugcagggcuagccaggggauauccaacuggcucgcaugguaccagcagaagccugagaaagccccaaagucucuuaucuaugacgcgucgucacugcaaagcggaguuccgagucgguucuccgguucuggcagcgggacggauuuuaccuugacaauuuccucauuacagcccgaagacuucgcuacuuacuauugucagcaguacaauaguuauccuaucaccuuuggacaaggcacacgccuggagauuaaa

SEQ ID NO: 23349 - RNA, 363 nt, Artificial Sequence
  derived and/or modified sequence opt3 from HuMab-167_HeavyChain_VDJ-Region
caggugcaacuggucgagagcggcgggggaguugugcagcccgguagaucccucaggcuuucuugcgccgcuucaggcuucaccuuuaguagcuacgcaauccacuggguacggcaggccccugggaagggacuggaauggguggcggucauuuccuaugacggcucuaacaaauacuaugcugauucggugaagggucgcuucacaauaucacgagacaauagcaaaaacacuuuguacuuacagaugaauagucugcgugccgaggauacggcaguuuauuacugugccagaggguccaucaccggaucuacaggcguguuugacuauuggggccaagggacucuagucaccgugagcucc

SEQ ID NO: 23350 - RNA, 363 nt, Artificial Sequence
  derived and/or modified sequence opt3 from HuMab-169_HeavyChain_VDJ-Region
caggugcaacugguccagagcggcgccgagguuaagaaacccggggcuuccgugaagguaucuugcaaagcaucaggauacaccuucacaaacuaugguaucaguugggugagacaggccccuggccaggggcucgaauggaugggauggcuuagcgcguacuccggcaauacuauuuaugcucaaaagcugcaggguagggucacgaugaccacagacacuucuaccacaaccgccuacauggaguugcggucguuacgcucagaugacacugcaguguauuacugugcccgagaucguauaguugugagaccagacuauuuugauuacugggggcagggaacacuggucaccgugagcagu

SEQ ID NO: 23351 - RNA, 321 nt, Artificial Sequence
  derived and/or modified sequence opt3 from HuMab-169_LightChain_VJ-Region
gagaucgugcugacccagagccccgccacacucucccuuucuccuggcgaaagagcuacucugucaugcagggcaagucaaagcgucuccucuuacuuggccugguaucagcagaagccagggcaggcgccgcgguuacugauuuacgacgcuucgaaccgcgccacgggaauacccgcacgauucucagguagcggcagugggaccgauuuuacacuaacuaucuccucucucgagccugaagacuucgccguuuauuacugucaacagcguagcaauuggccaagaaccuuuggacagggcacaaaaguggagauuaag

SEQ ID NO: 23352 - RNA, 366 nt, Artificial Sequence
  derived and/or modified sequence opt3 from HuMab-7D8_HeavyChain_VH-Region
gaggugcagcuggucgaaagcggcgggggacucguucaacccgacagaucccuuaggcugucuugcgccgcuucagguuucaccuuucacgauuacgcaaugcauugggugcggcaggccccuggcaagggguuggaguggguaaguacaaucagcuggaacuccggaacuauuggcuaugcggacucugugaaaggucgcuucacgauaucgcgagauaaugcuaagaacucauuauaccugcagaugaauagccuacgugccgaagacaccgcacucuauuacugugccaaagauauccaguaugggaacuacuauuacggaauggacgucuggggccaaggcacaacugugaccguuaguucc

SEQ ID NO: 23353 - RNA, 366 nt, Artificial Sequence; identical to SEQ ID NO: 23352
  derived and/or modified sequence opt3 from HuMab-7D8_HeavyChain_V-Region

SEQ ID NO: 23354 - RNA, 321 nt, Artificial Sequence
  derived and/or modified sequence opt3 from HuMab-7D8_LightChain_VL-Region
gagaucgugcugacccagagccccgccacacucucccuuucuccuggcgaaagagcuacucugucaugcagggcaagucaaagcgucuccucuuacuuggccugguaucagcagaagccagggcaggcgccgcgguuacugauuuacgacgcuucgaaccgcgccacgggaauacccgcacgauucucagguagcggcagugggaccgauuuuacacuaacuaucuccucucucgagccugaagacuucgccguuuauuacugucaacagcguagcaauuggccaauuaccuuuggacagggcacaagacuggagaucaaa

SEQ ID NO: 23355 - RNA, 321 nt, Artificial Sequence; identical to SEQ ID NO: 23354
  derived and/or modified sequence opt3 from HuMab-7D8_LightChain_V-Region

SEQ ID NO: 23356 - RNA, 324 nt, Artificial Sequence
  derived and/or modified sequence opt3 from huMAb-anti-MSP10.1_LightChain_VJ-Region
gagaucgugcugacccagagccccgacauucucucccuuucuccuggcgaaagagccacacugucaugcagggcuagucaagcauugacugccaaguacuuagcgugguaucagcagaaaccagggcaggucccgcggcugcuaauauacggaagcuccacgcgcgcuaccgguauccccgaucgauuccguggcucugggucgggaacagacuuuacucucaccauuucaagacuggagccugccgauagcgcaguuuauuacugucaacaguaugaagacaguccauggacauucggccaggguaccaaacuugagaucaag

SEQ ID NO: 23357 - RNA, 324 nt, Artificial Sequence
  derived and/or modified sequence opt3 from huMAb-anti-MSP10.2_LightChain_VJ-Region
gagaucgugcugacccagagccccgacacacucucccuuucuccuggcgaaacugccacgcugucaugcagagcuagucaaaccgucaggcggaacagcuuggcaugguaccagcagaagccagggcaggccccgcgcuuacugauuuauggagcguccgaucgagcuacagguauacccgaccguuucucuggcucgggguuuggaacugauuucacccuaacaguuucaggccucgagccugaagacuuugccguguacuauugucaacaguacgguaccagcccaagaacuuucgggcagggaacaaaacuggagaucaag

SEQ ID NO: 23358 - RNA, 324 nt, Artificial Sequence
  derived and/or modified sequence opt3 from HUMAB-Clone_18_VJ-Region
gagaucgugcugacccagagccccgccacacucucccuuucuccuggcgaaagagcuacucugucaugcagggcaagucaaagcgucuccucuuacuuggccugguaucagcagaagccagggcaggcgccgcgguuacugauuuacgacgcuucgaaacgcgccacgggaauacccgcacgauucucagguagcggcagugggaccgauuuuacacuaacuaucuccucucucgagccugaagacuucgccguuuauuacugucaacagcguagcaaguggccacccuggaccuuuggacagggcacaaaaguggaguccaag

SEQ ID NO: 23359 - RNA, 324 nt, Artificial Sequence
  derived and/or modified sequence opt3 from HUMAB-Clone_22_VJ-Region
gagaucgugcugacccagagccccgccacacucucccuuucuccuggcgaaagagcuacucugucaugcagggcaagucaaagcgucuccucuuacuuggccugguaucagcagaagccagggcaggcgccgcgguuacugauuuacgacgcuucgaaccgcgccacgggaauacccgcacgauucucagguagcggcagugggaccgauuuuacacuaacuaucuccucucucgagccugaagacuucgccguuuauuacugucaacagcguagcaaauggccacccuggaccuuuggacagggcacaaagguggagauuaaa

SEQ ID NO: 23360 - RNA, 432 nt, Artificial Sequence
  derived and/or modified sequence opt3 from HuMab-L612_Chain_VDJ-Region_Precursor
auggaguucggccugaccuggcucuuucuuguggccaaccugaaggggguccagugcgaaguucaauuguuagacagcggagguggccuggugcagcccgggggaugucuaagacucuccugcgcugcaucuggcuucacauuuucaaguugugccaugagcuggguaaggcaggcgccugguaaagggcuggaguggguguccgcuaucucuggaucgggcggcucaacuuacuaugccgauagcgucaaggggcgguucacgauuagucgcgacaaauccaagaauacccuuuaccugcagaugaacucuuugcgagcagaagauacagccguguauuacugcgcuaaaggagguaaugacauacucacuggcuauuacgcaugggggcaaggaacccugguuacagugagcuccggcucagccagugcu

SEQ ID NO: 23361 - RNA, 321 nt, Artificial Sequence
  derived and/or modified sequence opt3 from HuMab_LC5002-002_LightChain_V-Region
gacauccagaugacccaaagccccuccucucugucagccagugugggcgauagagucacaauuacuugcagggcuagccaggggauaucccgguggguugcaugguaccagcagaagccugagaaagccccaaagucucucaucuaugcggcuucgucacuucaaagcggagugccgagucgcuucuccgguucuggcagcgggacggacuuuacccugacaauuuccucauugcagcccgaagauuucgccacuuacuauugucagcaguacaacaguuauccuuggaccuuuggacaaggcacaaaaguagagaucaag

SEQ ID NO: 23362 - RNA, 357 nt, Artificial Sequence
  derived and/or modified sequence opt3 from HuMab_LC5002-002_gamma1-Chain_V-Region
gaggugcagcugcucgaaagcggcgggggacuuguccaacccgguggcucccugagauugucuugcgccgcuucaggguucaccuuuaacaucuacgcaaugaauuggguuaggcaggccccuggaaagggcuuagagugggugaguguaauuagcggucgggggauaacaacuuauuacgcggacuccgugaaaggacgcuucacgaucucucgagauaacucgaagaauacccuguaucuacagaugaacucacuccgugcugacgauacagccgucuacuauugugcaaaaggcagcaguuccuggacugacuuugauuacuggggccaggggacccuggugacaguuucuagc

SEQ ID NO: 23363 - RNA, 321 nt, Artificial Sequence
  derived and/or modified sequence opt3 from HuMab_LC5002-003_LightChain_V-Region
gacauccagaugacccaaagccccuccucucugucagccagugugggcgauagagucacaauuacuugcagggcuagccaggggauauccucuuggcucgcaugguaccagcagaagccugagaaagccccaaagucgcuuaucuaugcggcuucaagccugcaaaguggaguuccgucccgguucucugguagcggcuccgggacggacuuuaccuugacaauuucaaguuuacagcccgaagauuucgccacuuacuauugucagcaguacaacagcuauccuuggaccuuuggacaaggcacaaaaguggagaucaag

SEQ ID NO: 23364 - RNA, 357 nt, Artificial Sequence
  derived and/or modified sequence opt3 from HuMab_LC5002-003_gamma1-Chain_V-Region
gaggugcagcugcucgaaagcggcggggaccuuauccaacccggagguucccugagauugucuugcgccgcuucaggcuucaccuuuaacauuuacgcaaugaauugggucaggcaggccccugggaagggauuagaguggguuagugugauaagcggccgggguaucacaacuuauuacgcggauuccguaaaagggcgcuucacgauuucucgagacaacucgaagaauacccuguaucuacagauggauucacuccgugcugaagacacagccguguacuauugugcaaaaggaagcaguuacuggacugauuuugacuauuggggccagggcacccuggucacaguguccucu

SEQ ID NO: 23365 - RNA, 321 nt, Artificial Sequence
  derived and/or modified sequence opt3 from HuMab_LC5002-005_LightChain_V-Region
gacauccagaugacccaaagccccuccucucugucagccagugugggcgauagagucacaauuacuugcagggcuagccaggggauauccucuuggcucgcaugguaccagcagaagccugagaaagccccaaagucgcuuaucuaugcggcuucaagccugcaaaguggaguuccgucccgguucucugguagcggcuccgggacggacuuuaccuugacaauuucaaguuuacagcccgaagauuucgccacuuacuauugucagcaguacaacagccacccuccaaccuuuggacaaggcacaaaacuggagaucaag

SEQ ID NO: 23366 - RNA, 354 nt, Artificial Sequence
  derived and/or modified sequence opt3 from HuMab_LC5002-005_gamma1-Chain_V-Region
gaggugcagguccuggacagcggcgggggacucguucaacccgguggcucccuuagacugucuugcaccgccucaggguucacauuuagguuguacacuaugaguugggugcggcagacgccuggacgcggcuuagaauggguaagcgguaucuccgggucuggacugucgaccuauuucgcugauucagugaagggccgauuuacaauuagccgugacaacaguaaaaauacugucuaccuacagaugaacucccucagagcagaggauaccgccguguauuacugugcgaaggaaggcgacuggauauauuucgauucuugggggcagggaacacugguuaucgugagcucc

SEQ ID NO: 23367 - RNA, 321 nt, Artificial Sequence
  derived and/or modified sequence opt3 from HuMab_LC5002-007_LightChain_V-Region
gagaucgugcugacccagagccccggcacacucucccuuucuccuggggaaagagccacucugucaugcagggcuagucaaagcgucuccucuucguacuuggcaugguaucagcagaagccaggacaggccccgcgguuacugauuuacggugcgucaagccgcgcuauaggcauccccgaccgauucaguggguccggaucuggcacggauuuuacccuaacaauuagccgucucgagccugaagacuucgccguuuauuacugucaacacuaugguuccucacugacuuuugggggaggcaccaaaguggagaucaag

SEQ ID NO: 23368 - RNA, 369 nt, Artificial Sequence
  derived and/or modified sequence opt3 from HuMab_LC5002-007__gamma1-Chain_V-Region
caggugcaacugguccagagcggcgccgagguuaagaaacccggguccucugugaagguaucaugcaaagugaguggagguaccuucagcuccuacgcuuuuucuugggucagacaggcaccuggccaggggcucgaauggaugggaaggaucauuccaauacuuggccggacaaacuaugcccaaaaguuccagggucgcgugacuaucacggcggacaaaucgaccucaacagcuuacauggagguuagcagucugcgauccgaagauacugccguguauuacugugcacgugagggggaaaccuuggacuauuuuuacuauggaauggaugucuggggccagggcacaaccgugacuguaucuagc

SEQ ID NO: 23369 - RNA, 357 nt, Artificial Sequence
  derived and/or modified sequence opt3 from HuMab_LC5002-018_gamma1-Chain_V-Region
gaggugcagcugcucgaaagcggcgggggacuuguccaacccgguggcucccugagauugucuugcgccgcuucaggguucaccuuuaacaucuacgcaaugaauuggguuaggcaggccccuggaaagggcuuagagugggugaguguaauuagcgguuccggggugacaacuuauuacgcggacucugucaaaggacgguucacgauaucgcgcgauaacucaaagaauacccuguaucuacagaugaacagccuccgagcugaagacacagccguguacuauugugcaaaaggcaguuccugguacguugauuuugacuauuggggccaggggacucuggugaccgucucuagc

SEQ ID NO: 23370 - RNA, 1347 nt, Artificial Sequence
  derived and/or modified sequence opt3 from Ibalizumab_HeavyChain1
caggugcagcugcagcagagcggccccgaggucguuaagccuggggccuccgugaaaaugucuugcaaggcuucaggauacaccuucacaaguuauguaauccacugggugagacagaaaccaggucaaggccucgacuggauuggguacauaaacccguauaaugauggaacugacuacgaugaaaaguuuaaaggcaaggcaacgcuuaccagcgacacauccacuucuaccgccuauauggagcugucgucauugaggagcgaagauacagcggucuacuauugugcucgggagaaggacaacuacgccaccggugcaugguucgccuacugggggcagggaacuuuagugacaguuaguuccgcuucuaccaaaggccccagcguguuuccucuggcaccaugcucccgcucaacgagugaaagcacugccgcucuaggcugucucgucaaggauuauuuccccgagccugugaccguaucuuggaauagcggggcccugacaucaggaguucauacuuuuccagcggugcuucagagcaguggucuguacucuuuguccagcgucgugaccgugcccucgucuucccucggcacaaaaaccuauacgugcaacgucgaccacaagccuucaaauacuaaaguugauaagcgaguggagaguaaguacgggccaccgugucccagcugcccugcaccagaguuccugggaggccccuccguauuucuguucccuccaaaacccaaggacacacucaugaucucucguaccccggaggugacuugugucgugguugaugugagccaggaagacccugagguccaauuuaacugguauguggaugguguagagguucauaaugccaaaacaaagcccagagaagaacaguucaacucaaccuacaggguggucaguguguuaacgguccugcaccaggacuggcuuaaugggaaagaauauaagugcaaaguguccaacaagggauugccaagcucuauugagaagaccaucucaaaagcuaagggccagccucgggaaccccaaguuuacacacugccacccagucaggaggagaugacuaaaaaucaggugagccuaaccugucucguaaagggcuuuuacccuuccgacauugccgucgaaugggagucuaacgggcaaccagaaaauaacuauaaaacaacuccgcccgugcuggauucggacggauccuucuuucuuuacucccgccugaccguugauaagucaagauggcaggaggguaauguguucaguugcucugucaugcaugaagcauugcacaaccacuauacacaaaagagccucucccugucauuaggcaaa

SEQ ID NO: 23371 - RNA, 657 nt, Artificial Sequence
  derived and/or modified sequence opt3 from Ibalizumab_LightChain1
gacaucgugaugacccagagccccgauucccuggccgucucucucggcgagagaguuacaaugaacugcaagucaagucaaagccuucuguacuccacuaaucagaaaaacuauuuggcuugguaccagcagaagccugggcaaucuccaaaauuacugauuuauugggcaucgacgagggaaucaggagugccggaccgguucagcgguaguggcuccgggaccgauuuuacacuaacuauaucuagcguacaggccgaggacguggcggucuacuauugucagcaguacuauuccuaccgcaccuucggaggcgguacaaagcucgaaaucaaacgaaccguggcugcccccucaguuuuuauuuucccuccaagugaugagcaacuuaagagcgggacugcaucuguggucugccugcugaauaacuuuuacccccgugaagccaaggugcaguggaaaguagacaaugcuuugcaguccggaaacucacaggagagcguuacagagcaagauaguaaggacucuaccuauucccucagcucgacgcugacucugucuaaagcagauuacgaaaagcacaaaguguaugccugugaggucacccaucagggccucuccucaccugugacaaagaguuucaauagaggcgaaugc

SEQ ID NO: 23372 - RNA, 1329 nt, Artificial Sequence
  derived and/or modified sequence opt3 from Ibritumomab_tiuxetan_HeavyChain
caggccuaccugcaacagagcggcgcugagcucgugagacccggggcauccgucaagaugucuugcaaagccucaggauauaccuucacaaguuacaacaugcacuggguuaagcagacuccuaggcagggucuugaauggaucggcgcgauuuauccagggaauggagacacgagcuacaaccaaaaauuuaagggcaaagcuacccugacaguggauaaguccucuucgacugccuauaugcaguugucaagccugaccagugaggacuccgcaguauacuucugugcccggguggucuauuacucuaauagcuacugguauuuugaugugugggguacagggaccacuguuacaguguccgcuccgucagucuacccccuggcaccugugugcggagacaccacgggcaguagcguaacucuaggcugucucguuaagggguauuucccagaacccgugacccugacauggaacucuggaucccuuucaagcgguguccauacuuuuccugccgugcugcagagugauuuguacacccucucuuccagcgugacagucaccucgucuacguggccaucccagucaauaacuugcaauguugcucaccccgccaguagcacaaaaguggacaagaaaaucgagccucgcggcccaaccauuaagccgugucccccuugcaaauguccagcgcccaaccuguuagggggaccuuccguauucaucuuuccacccaagauuaaggaugugcucaugaucucuuuaagcccgauagucacuugcgugguuguggacgucucagaagaugacccugaugugcaaaucaguugguucguaaauaacguugaggugcauacagcacagacccagacgcaccgagaggacuauaauuccacccugcgugucgugagcgcccuucccauucagcaucaagauuggaugucuggcaaagaauuuaaguguaaagucaacaauaaggacuugccagcuccuaucgagagaacaauuucaaaacccaaggguagugugagggccccacagguuuacgugcugcccccuccagaagaggagaugacuaaaaagcagguaacccuaacaugcauggucacugacuucaugccggaagauaucuauguggaguggaccaacaaugggaagacagaacucaacuacaaaaauaccgagcccguucuggacagcgauggauccuacuuuauguauucuaaacuucggguggaaaagaagaacugggucgagcgcaacucguacagcuguuccgugguacacgagggccugcacaaucaucacacuacgaaaucauucaguaga

SEQ ID NO: 23373 - RNA, 627 nt, Artificial Sequence
  derived and/or modified sequence opt3 from Ibritumomab_tiuxetan_LightChain
cagaucgugcugagccaaucccccgccauucucucugcuucaccuggcgagaaggucaccaugacaugcagagcaaguagcuccguuucuuacaugcacugguaucagcagaaaccagggucgucaccgaagcccuggauauacgccccuagcaaccuugcgaguggagugccagcuagguucuccgguucuggcagcgggacuuccuauucacugacgaucagucggguagaagccgaggacgcagccaccuacuauugucagcaauggagcuuuaaucccccuacauucggagcuggcacuaaauuggaauuaaagcgcgcagaugccgcuccaaccguguuuauuuuucccccuucugacgagcagcugaaauccgguacagccucagucgugugccuacucaacaauuucuacccacgagaagcgaagguucaguggaagguggauaacgcacugcagagcgggaauagucaagagucugucaccgagcaggacuccaaagauagcacuuauucgcuuucuuccacacugaccuugucaaaggccgacuacgaaaaacauaagguguacgcuugugagguaacgcaccagggacucaguagcccgguuacuaaauccuucaac

SEQ ID NO: 23374 - RNA, 1368 nt, Artificial Sequence
  derived and/or modified sequence opt3 from Icrucumab_HeavyChain1
caggcccaaguggucgagagcggcgggggaguugugcaguccgguagaucucugaggcucucaugcgcugcaaguggcuucgccuuuagcuccuacgggaugcacuggguacggcaggcgcccggaaagggccuugaauggguggcugucaucugguaugacgguucuaacaaauacuaugccgauucggugcgcgggcgauucaccauuucacgugacaauagcgagaacacacuguacuugcagaugaauaguuuaagagcagaagauacugccguuuauuacugugcuagggaccauuauggauccggcgugcaccauuacuuuuacuauggccuggaugucugggggcaaggaacgaccgugacaguaucuagcgcauccacuaaggguccuucaguuuucccacuagccccgaguagcaaaucuaccuccggcgggacagcugcccucggaugccuggugaaggacuacuuucccgagccugucaccgugucauggaacagcggcgcgcuuacaaguggugugcacacuuucccagcaguccugcagucuuccggguuguauagccucucgucuguugugaccguacccuccucaagucugggaacgcagacuuacauauguaaugugaaccauaaaccuagcaauaccaaggucgauaagcggguggaaccaaaauccugcgacaagacacacacuugucccccuugcccagccccggagcugcucggcggccccucuguguuuuuauucccuccaaaacccaaggauacccugaugaucagccgcacaccugagguuaccugugucgugguagacguuucacacgaagauccagaggugaaauuuaacugguaugucgacgggguggaaguccauaaugcuaagacgaagcccagagaggagcaguacaacaguacuuauagggugguuuccgugcuuacaguauugcaccaagauuggcugaauggaaaagaauacaagugcaaagucagcaacaaggcccuaccggcaccuauugagaaaaccaucucuaaggcuaaaggucagccccgggaaccacagguguacacucucccucccucacgcgaggaaaugacaaagaaucagguuagucugaccugucuugugaagggcuucuauccaagcgacauugccgucgagugggaguccaacgggcaacccgaaaauaacuacaaaacgaccccuccagugcuggacucugauggaucguuuuucuuguauagcaagcucacaguagacaaaucccgauggcagcagggcaacguguuuucaugcaguguuaugcaugaggcgcugcacaaucacuacacucaaaagucuuuaagccuguccccggguaaa

SEQ ID NO: 23375 - RNA, 645 nt, Artificial Sequence
  derived and/or modified sequence opt3 from Icrucumab_LightChain1
gagaucgugcugacccagagccccggcacacucucccuuucuccuggggaaagagccacucugucaugcagggcuagucaaagcgucuccucuucguacuuggcaugguaucagcagaaaccaggacaggccccgcgguuacugauuuacggugcgucaagccgcgcuacgggcauacccgaccgauucaguggguccggaucuggcaccgauuuuacacuaacuaucagccgucucgagccugaagacuucgccguuuauuacugucaacaguaugguuccucaccacugaccuuugggggaggcacaaaaguggagauuaagagaaccguagcagcccccaguguguucaucuuuccuccaagcgaugaacagcuuaaaucuggcacugcuuccgucgugugccuguugaacaauuucuaccccagggaggcaaagguucaguggaaaguggacaacgcccuccaaucagggaauagccaggagagugucacagaacaggauucuaaggacuccaccuauagccugucgucuacgcugacucucuccaaggcugauuacgagaaacacaagguguacgccugugaaguaacccaucagggauuaucaaguccuguuacaaagagcuuuaaccggggugagugc

SEQ ID NO: 23376 - RNA, 675 nt, Artificial Sequence
  derived and/or modified sequence opt3 from Idarucizumab_HeavyChain1
caggugcaacugcaggagagcggccccgggcucgucaagccuuccgaaacccuuucucugacaugcacuguuucaggauucaguuugacgagcuacaucguggacuggauuagacagccaccggguaaaggcuuagaguggauagggguaaucugggccggaggcuccaccgguuauaacucugcucugaggucgcgggugucaauuacaaaggauacuagcaaaaaucaguuuagucuaaagcucuccucugucaccgcagccgacacagcgguguacuauugugcuagcgccgcauacuauuccuacuauaacuacgauggguucgccuacuggggacaaggcacccugguuacugugucaagugcuagcacaaaaggccccucugucuuuccucuugcaccauccucaaagagcaccagugggggaacggccgcucuggguugcuuggugaaggacuauuuccccgaaccuguaacuguuucuuggaacuccggcgcccucaccagcggggugcacacauuuccagcgguccugcagucgucuggacuguacucccucucaaguguggugacuguccccagcuccucuuuaggcacccagacauauaucuguaauguuaaucauaaaccuagcaacaccaagguggauaaaaagguagagccaaaaucaugc

SEQ ID NO: 23377 - RNA, 657 nt, Artificial Sequence
  derived and/or modified sequence opt3 from Idarucizumab_LightChain1
gacguggucaugacccagagcccccugucccucccuguuacacuuggccaaccagccucuaucucaugcaagaguagccagucccuguuguacacugaugggaaaacguauuuauacugguuccugcagagaccgggacagucucccaggcggcuaauuuaucucgugucgaagcuggacucagguguaccugaucgcuuuagcggcaguggguccggaaccgacuucacacuuaaaauaucucgaguggaggcugaagaugucggcguguacuauugucugcaaagcacucacuuuccacauaccuucggugggggaacaaagguugagaucaaacguaccguggcagcccccuccgucuuuauuuucccuccaucagacgaacaguugaagaguggcacugcgagcgugguaugccuccugaacaauuuuuaccccagagaggcuaagguucaguggaaaguggauaacgcccugcagucuggcaauucccaagaaucagucacagagcaggacagcaaggauaguaccuauucucucuccagcacguuaacucugucgaaagcagacuacgagaagcacaaaguguacgccugugaagugacccaucaggggcuuucuuccccugucacaaagucauucaacaggggagagugc

SEQ ID NO: 23378 - RNA, 1332 nt, Artificial Sequence
  derived and/or modified sequence opt3 from Igatuzuab_HeavyChain1
caggugcaacugguccagagcggcgccgagguuaagaaacccggguccucugugaagguaucaugcaaagcuaguggauucaccuuuacagacuacaagauccacugggugagacaggcaccuggucagggccucgaauggggguauuucaacccaaauagcggauacuccacuuaugcccaaaaauuucagggcagggucacgauuaccgcggauaagucuacaucgacugcuuacgagcuuucaagccugcggagugaagacaccgccguguauuacugugcacgcuuguccccggguggguauuacguugaugccuggggacagggcacaaccgugacugucucuagcgcuuccacaaagggccccucaguguucccuuuagcaccaaguagcaaaucuaccuccgggggaacggccgcucuggguugccuaguaaaggacuacuuucccgagccuguuacugugucauggaacagcggcgcccucaccagugggguccauacauucccagcggugcugcagucuuccggacuuuauagccugucgucuguggucacuguucccuccucaaguuugggcacccaaacauacauauguaaugugaaccacaaaccuagcaauaccaagguagauaaaaagguggaaccaaaguccugcgacaaaacgcauacuuguccgcccugcccugcaccagagcuccugggugggcccucugucuuucuguucccuccaaagcccaaagauacacucaucagccgaaccccggaggugacuuguguuguggucgacgugucacacgaagauccugagguaaaguuuaacugguauguugacggaguggaaguccauaaugccaaaacaaagccccgugaggagcaguacaacaguaccuauagaguggucuccguguuaacgguucugcaccaggauuggcuuaauggcaaagaauacaagugcaaggugagcaacaaggcuuugccagccccuauugagaaaaccaucucuaaagcaaagggccagcccagggaaccacaaguauauacacugcccccuucacgggacgagcuaacuaaaaaucaggucagucucaccugucuggugaagggguucuacccaagcgauauugcuguugaaugggaguccaacggacagccggagaauaacuacaagacaacucccccugugcuugacucugacgguucguuuuuccuguauagcaaauugaccgucgauaagucccgcuggcaacagggcaauguguuuucaugcaguguacacgaagcccuccauaaccacuacacacagaaaucucugagcuuauccccaggg

SEQ ID NO: 23379 - RNA, 636 nt, Artificial Sequence
  derived and/or modified sequence opt3 from Igatuzuab_LightChain1
gacauccagacccaaagccccuccucucugucagccagugugggcgauagagucacaauuacuugcagggcuagccaggggauaaacaauuaccucaacugguaucagcagaagccuggaaaagcaccaaagcggcuuaucuacaauacgaacaaucugcaaaccgguguuccgucccgcuucucuggcucggggucaggaacagaguuuacuuugaccauuagcaguuuacagcccgaagacuucgccacauauuacugucugcagcacaacuccuuuccuaccuucggccaggguacuaaacuagagaucaagcgaacaguggcggcuccaucuguauuuauuuuucccccuagcgaugaacaacucaaauccgggaccgccucaguggucugccugcuuaauaacuucuauccacgugaggcaaaggugcaguggaagguugacaaugcccugcagaguggaaacagccaggaaucugugacggagcaagauuccaaagacucaacuuacagcuugaguucuacccucacacuguccaaggcugauuaugagaaacauaaggucuacgcaugugaagugacucaccagggccugagcucgcccguaaccaaaucuuucaauagaggcgagugc

SEQ ID NO: 23380 - RNA, 357 nt, Artificial Sequence
  derived and/or modified sequence opt3 from IGF-IR_HUMAB-1A_HeavyChain
gaggugcagcugguccaaagcggcgggggacucguucaccccgguggcucccuuagacugucuugcgccgggucaggauucaccuuuaggaacuacgcuauguauugggugcggcaggcaccuggcaaggguuuggaauggguaagugccaucgggagcggaggcggcacauacuaugcggacuccgugaaagggcgcuucacuauuucucgagauaaugcuaagaacucguuauaccugcagaugaacucacuacgugccgaggacauggcagucuauuacugugccagagcuccaaauuggggaagcgaugcauuugacauauggggucagggcacgauggugaccguuaguucc

SEQ ID NO: 23381 - RNA, 357 nt, Artificial Sequence
  derived and/or modified sequence opt3 from IGF-IR_HUMAB-23_HeavyChain
gaggugcagcugguccaaagcggcgggggacucguucaccccgguggcucccuuagacugucuugcgccgggucaggauucaccuuuaguaacuacgcuauguauugggugaggcaggcaccuggcaaggguuuggaauggguaagcgccaucggguccggaggcggcacauacuaugcggacucugugaaagggcgguucacuauuucgcgcgauaaugcuaagaacucauuauaccugcagaugaauagccuacgagccgaggacauggcagucuaucauugugcccgugcuccaaacuggggaagugaagcauuugauauauggggucagggcacgauggugaccguuuccucu

SEQ ID NO: 23382 - RNA, 321 nt, Artificial Sequence; identical to SEQ ID NO: 23278
  derived and/or modified sequence opt3 from IGF-IR_HUMAB-23_LightChain

SEQ ID NO: 23383 - RNA, 357 nt, Artificial Sequence
  derived and/or modified sequence opt3 from IGF-IR_HUMAB-8_HeavyChain
gaggugcagcugguccaaagcggcgggggacucguucaccccgguggcucccuuagacugucuugcgccgggucaggauucaccuuuaggaguuacgcuauguauugggugcggcaggcaccuggcaaggguuuggaauggguaagcgccaucggguccggaggcggcacauacuaugcggacucugugaaggggcgcuucacuauuucgcgagauaacgcuaaaaauucauuauaccugcagaugaacagccuacgugccgaggacauggcagucuauuacugugccagagcuccaaauuggggaagugaugcauuugacauauggggucagggcacgauggugaccguuuccucu

SEQ ID NO: 23384 - RNA, 321 nt, Artificial Sequence
  derived and/or modified sequence opt3 from IGF-IR_HUMAB-8_LightChain
gacauccagaugacccaaagccccuccucucugucagccagugugggcgauagagucacaauuacuugcagggcuagccaggggauauccucuuggcucgcaugguaccagcagaagccugagaaagccccaaagucgcuuaucuaugcggcuucaagccugcaaaguggaguuccgucccgguucucugguagcggcuccgggacggacuuuaccuugacaauuucaaguuuacagcccgaagauuucgccacuuacuauugucagcaguacaacagcuauccuccaaccuuuggacccggcacaaaaguggacaucaag

SEQ ID NO: 23385 - RNA, 708 nt, Artificial Sequence
  derived and/or modified sequence opt3 from ImAb1_LightChain
auggacaugagagcccccgcucaguucuuuggcauccugcuccuuugguucccugggauuaggugcgauauaaagaugacccaaagcccauccucuauguacgcaucacugggagagcgggugacaaucacuuguaaagccagucaggacauuaagagcuauuuguccugguaccagcagaaaccguggaagucucccaaaaucuuaauuuauuacgcgacgucgcuggcugauggugucccuucacgcaucagcggcaguggguccggacaagacuauucucuaaccauaagcucccucgaaucagaugacacagccacuuacuauugccugcagcacggcgagaguccauacaccuuuggugggggaacaaaguuggaaaucaagcgagcagaugccgcucccaccguuagcauuuucccuccaucuuccgagcagcugacuucaggcggcgcaagcgugguauguuuucuuaacaauuucuaccccaaagacaucaacgugaaguggaaaauugaugggagugaacgucagaauggaguccucaacucuuggacagaccaagauuccaaggacagcaccuauucgaugucuuccacgcugacucugaccaaagaugaguacgagagacauaauucauauacaugcgaagccacucacaagaccaguacaagcccuaucgugaaguccuuuaacaggaaugagugu

SEQ ID NO: 23386 - RNA, 681 nt, Artificial Sequence
  derived and/or modified sequence opt3 from ImAb1_gamma1-Chain
augaauuucggcuuuagccugaucuuccucgugcuuguccugaaggggguucagugcgaggugaaauugguagaauccggagguggcuuagugaagcccgggggaucucugaaacuaucaugugccgcuaguggcuuuaccuucagcaauuacgcaauguccugggucagacaaacaccugagaagaggcucgaauggguggccucuauuucgucagacggugauacuuauuuuccagacaacguuaaagggcgguucacgauaagccgcgagaaugcgggaaacauccuguuucuucagaugaguucccugcgaucugaagauaccgcuauguacuauugcgcccguggcuucaugauuacauuuuggggccaggggacuuuggugaccgucagcgcagccaagacaaccccgcccuccguguacccucucgcuccaggauguggugacacuacaggcucaaguguaacccuggggugccugguuaagggauauuuccccgagagcgugacggucacuuggaacucuggcucccucucaagcagugugcacaccuuuccugcauuacugcagucuggucuuuacacaauguccagcucggugacugucccaucuuccaccuggcccucacaaacaguuaccuguaguguggcccauccugcuagcuccacgacuguagau

SEQ ID NO: 23387 - RNA, 1344 nt, Artificial Sequence
  derived and/or modified sequence opt3 from Imalumab_HeavyChain1
gaggugcagcugcucgaaagcggcgggggacuuguccaacccgguggcucccugagauugucuugcgccgcuucaggguucaccuuuaguaucuacagcaugaacuggguuaggcaggcaccuggaaagggcuuagaguggguguccucuauugguucgucagggggaacaacuuauuacgccgacagcguaaaaggccgguucacgauaagucgcgauaauuccaagaacacccuguaucuacagaugaauagccuccgagcggaagacacagcuguguacuauugugccggcucucaguggcuguacgggauggaugucuggggacaagguacuaccgugacaguuuccucagcaaguaccaaaggcccaagcguguuuccgcuugcccccucuuccaagucaacuagcgggggaacagcugcacugggcugcuuggucaaagacuauuucccugagccagugaccguaaguuggaacucuggugcccucacguccgggguucacacuuuucccgcugugcugcagagcucgggacuguacucucucuccucagucgugaccgugccuaguagcuccuuaggcacacagacuuacaucuguaaugucaaccauaagccaucuaauaccaagguugauaaacguguggaacccaagagcugcgacaaaacacacaccuguccuccaugcccggcccccgagcugcuuggcgggccuucaguauucuuguuuccacccaagccuaaagauacgcugaugauuaguagaacuccagaggugacaugugucgugguugacgugucccaugaagaucccgaggucaaguucaacugguauguggacggaguagaaguucacaaugcgaagaccaaaccgagggaggagcaguacaacagcacuuaucggguggucucugugcuaacaguccuccaucaagauuggcugaaugguaaggaauacaaaugcaaggugucaaacaaagcacuuccugcccccaucgagaagaccauuaguaaagcuaagggccagccacgcgaaccucagguuuauacgcugcccccaagcagagaggaaaugaccaagaaucagguguccuugacaugucucguaaaaggguuuuaccccucugacaucgccgucgagugggagucgaacggacaaccugaaaauaacuauaagacuaccccaccggugcuggauagcgacggcuccuucuuuuuauacucaaaacugacaguugacaagaguagguggcagcaggguaacguguucucuugcagcgucaugcacgaggcacuccacaaucauuacacucaaaaaucccuuucacugagccccgggaag

SEQ ID NO: 23388 - RNA, 642 nt, Artificial Sequence
  derived and/or modified sequence opt3 from Imalumab_LightChain1
gacauccagaugacccaaagccccuccucucugucagccagugugggcgauagagucacaauuacuugcaggagcucccagcggauaaugacguaccucaacugguaucagcagaagccugggaaagcuccaaaacuucugaucuucguugcaucucacucgcaaucaggagugccgagccgcuuucgagguaguggcuccgagaccgacuucacauugacuauuucuggguuacagcccgaagauagcgccaccuacuauugucagcaguccuuuuggacaccucugaccuucggaggcgguacuaagguagagaucaagcguacaguggcggcuccaucagucuuuauuuuucccccuagugacgaacaacuaaaaagcgggaccgccucugugguuugccuccugaauaacuucuacccaagagaggcaaaggugcaguggaaggucgauaaugcccuucaguccggaaacucacaggaaagcgugacggagcaagacaguaaagauucuacuuauucccugagcucgaccuugacacucucuaaggcugacuacgagaaacauaagguauaugcaugugaaguuacucaccagggccuguccucacccgugaccaaaaguuucaauaggggcgagugc

SEQ ID NO: 23389 - RNA, 1347 nt, Artificial Sequence
  derived and/or modified sequence opt3 from Imgatuzumab_HeavyChain1
caggugcaacugguccagagcggcgccgagguuaagaaacccggguccucugugaagguaucaugcaaagcuaguggauucaccuuuacagacuacaagauccacugggugagacaggcaccuggucagggccucgaauggaugggguauuucaacccaaauagcggauacuccacuuaugcccaaaaauuucagggcagggucacgauuaccgcggauaagucuacaucgacugcuuacauggagcuuucaagccugcggagugaagacaccgccguguauuacugugcacgcuuguccccggguggguauuacguuauggaugccuggggacagggcacaaccgugacugucucuagcgcuuccacaaagggccccucaguguucccuuuagcaccaaguagcaaaucuaccuccgggggaacggccgcucuggguugccuaguaaaggacuacuuucccgagccuguuacugugucauggaacagcggcgcccucaccagugggguccauacauucccagcggugcugcagucuuccggacuuuauagccugucgucuguggucacuguucccuccucaaguuugggcacccaaacauacauauguaaugugaaccacaaaccuagcaauaccaagguagauaaaaagguggaaccaaaguccugcgacaaaacgcauacuuguccgcccugcccugcaccagagcuccugggugggcccucugucuuucuguucccuccaaagcccaaagauacacucaugaucagccgaaccccggaggugacuuguguuguggucgacgugucacacgaagauccugagguaaaguuuaacugguauguugacggaguggaaguccauaaugccaaaacaaagccccgugaggagcaguacaacaguaccuauagaguggucuccguguuaacgguucugcaccaggauuggcuuaauggcaaagaauacaagugcaaggugagcaacaaggcuuugccagccccuauugagaaaaccaucucuaaagcaaagggccagcccagggaaccacaaguauauacacugcccccuucacgggacgagcuaacuaaaaaucaggucagucucaccugucuggugaagggguucuacccaagcgauauugcuguugaaugggaguccaacggacagccggagaauaacuacaagacaacucccccugugcuugacucugacgguucguuuuuccuguauagcaaauugaccgucgauaagucccgcuggcaacagggcaauguguuuucaugcaguguaaugcacgaagcccuccauaaccacuacacacagaaaucucugagcuuauccccaggg

SEQ ID NO: 23390 - RNA, 639 nt, Artificial Sequence
  derived and/or modified sequence opt3 from Imgatuzumab_LightChain1
gacauccagaugacccaaagccccuccucucugucagccagugugggcgauagagucacaauuacuugcagggcuagccaggggauaaacaauuaccucaacugguaucagcagaagccuggaaaagcaccaaagcggcuuaucuacaauacgaacaaucugcaaaccgguguuccgucccgcuucucuggcucggggucaggaacagaguuuacuuugaccauuagcaguuuacagcccgaagacuucgccacauauuacugucugcagcacaacuccuuuccuaccuucggccaggguacuaaacuagagaucaagcgaacaguggcggcuccaucuguauuuauuuuucccccuagcgaugaacaacucaaauccgggaccgccucaguggucugccugcuuaauaacuucuauccacgugaggcaaaggugcaguggaagguugacaaugcccugcagaguggaaacagccaggaaucugugacggagcaagauuccaaagacucaacuuacagcuugaguucuacccucacacuguccaaggcugauuaugagaaacauaaggucuacgcaugugaagugacucaccagggccugagcucgcccguaaccaaaucuuucaauagaggcgagugc

SEQ ID NO: 23391 - RNA, 1353 nt, Artificial Sequence
  derived and/or modified sequence opt3 from Inclacumab_HeavyChain1
gaggugcagcuggucgaaagcggcgggggacucguuagacccgguggcucccuuaggcugucuugcgccgcuucaggguucaccuuuaguaacuacgacaugcacugggugcggcaagcaacaggaaagggcuuggaguggguaagcgccaucacugcggcuggugauauuuauuacccuggguccgugaaaggacgcuucacgauaucucgagaaaaugccaagaacucguuauaucugcagaugaacucacuacgugcaggcgacaccgccgucuacuauugugcuagaggcagguacagcgggaguggauccuauuacaaugauugguuugacccauggggucagggcacacucgugacuguuucuagcgcauccaccaaagggccgucaguguucccccuggccccuugcagucggagcacaucugaguccaccgcugcccuuggaugucuggucaaggauuacuuuccagaacccgugacuguaucauggaauagcggcgcguugacaagugguguucauaccuucccugcagugcuccagucuuccgggcuguauagccugucgucugucgugacggugccauccucaagucucggaacuaaaaccuacacaugcaacgucgaccacaagcccagcaauacuaagguugauaaacgcguggaguccaaguauggcccuccauguccgcccugcccugccccagaguuugaaggcgggcccucuguauucuuauuuccuccaaaacccaaggacacccugaugaucagcagaacaccggaggugaccugugucgugguugaugugucacaagaagacccugagguccaguucaacugguacguggauggaguagagguucauaaugcuaaaacgaagcccagggaggaacaguuuaacaguacuuaucggguggucuccgugcuuacagucuugcaccaggacuggcugaaugguaaggaauacaaaugcaaggugagcaacaaaggccuaccaucuucaauugagaagaccaucaguaaagccaaggggcaaccucgcgaaccccagguuuauacucucccacccagccaggaggagaugaccaaaaaucaggugucccugacaugucuuguaaagggauucuacccuucugauauugcagucgaaugggagucgaacggccaaccagaaaauaacuacaagacgaccccgcccgugcuggacagcgacgguuccuuuuucuuguauucacgacucacaguugauaaaaguagauggcaggaggggaacguguucucuugcagcgucaugcaugaagcucugcacaaucacuacacucagaaguccuuaucacugagccucggcaaa

SEQ ID NO: 23392 - RNA, 642 nt, Artificial Sequence
  derived and/or modified sequence opt3 from Inclacumab_LightChain1
gagaucgugcugacccagagccccgccacacucucccuuucuccuggcgaaagagcuacucugucaugcagggcaagucaaagcgucuccucuuacuuggccugguaucagcagaagccagggcaggcgccgcgguuacugauuuacgacgcuucgaaccgcgccacgggaauacccgcacgauucucagguagcggcagugggaccgauuuuacacuaacuaucuccucucucgagccugaagacuucgccguuuauuacugucaacagcguagcaauuggccacugaccuuuggaggcgguacaaaaguggagauuaagagaaccguagcugcacccuccguguucaucuuuccuccaucagaugaacagcuuaaaagugggacugccagcgucgugugccuguugaacaauuucuaucccagggaggcuaagguucaguggaaaguggacaacgcccuccaaucuggaaauucccaggagucagucacagaacaggauagcaaggacaguaccuacucucuguccagcacgcugacucucucgaaggcggauuaugagaaacacaagguguacgcaugugaaguaacccaucagggcuuaucuuccccuguuacaaaaucauuuaaccggggcgagugc

SEQ ID NO: 23393 - RNA, 1347 nt, Artificial Sequence
  derived and/or modified sequence opt3 from Indatuximab_ravtansine_HeavyChain1
caggugcaacugcagcagagcggcuccgagcucaugaugcccggggccucugucaagaucucaugcaaagcuaccggauacacauucaguaacuauuggauugaauggguuaagcagagaccuggucacggccuugaguggauaggggaaauccugccaggaacuggcaggacgauuuacaaugagaaauuuaaggguaaagcaaccuucacagccgacaucagcuccaacacugugcaaaugcaguugucuucguuaaccucagaagauagcgcgguauauuacugugcucggcgcgacuauuacgggaauuuuuauuacgccauggauuacuggggacagggcacaagugugaccgucuccucugcaagcacuaagggcccguccguguucccccuggccccuugcucacgaaguacaagcgagucuaccgcugcacuagggugucucguuaaggacuauuuuccagagcccgugacggucuccuggaacucaggagcccugacuagcggugugcauaccuucccugcuguacuucagaguucuggccuguacuccuugagcucgguugugacagucccaucuuccucacucgggacuaaaaccuauacaugcaauguggaucacaagcccaguaacaccaaaguggacaagcgugucgaaagcaaauacggaccuccauguccguccugccccgccccugaguuucugggcgguccaucuguuuuccuguuucccccuaagccaaaggauacgcucaugauuagcagaacucccgaagugacauguguaguggucgacgugucacaagaggauccggagguucaguucaauugguauguggacggggucgaagugcauaacgcgaaaaccaagccuagggaggaacaguuuaauaguacuuaccggguaguuuccguguuaacaguccugcaccaggauuggcuuaacggaaaagaguauaagugcaaagugagcaauaagggcuugcccucuucaaucgagaaaaccauaaguaaggcaaagggccaaccacgcgaaccucaggucuacacgcugcccccaagccaggaggaaaugaccaaaaaccaagugucccuaacaugucucguuaagggguucuaccccucugacaucgccguggagugggaaucgaauggacagccugagaacaauuauaaaacuaccccaccgguacuggauagcgacgguuccuuuuuccuuuacucaagacugacagucgacaagaguagguggcaggaaggcaacguguucucuugcagcguuaugcaugaggcuuugcacaaccacuauacucagaaaucccucucacugagcuuagggaag

SEQ ID NO: 23394 - RNA, 642 nt, Artificial Sequence
  derived and/or modified sequence opt3 from Indatuximab_ravtansine_LightChain1
gacauccagaugacccaaagcacauccucucugucagccagucucggcgauagagugacuauuagcugcuccgcuucucaggggauaaacaauuaccuuaacugguaucagcagaagcccgacggaacggucgagcuguugaucuacuauaccucgacauuacaaucagguguuccuagcagguucaguggcuccgggucuggaacugauuacagccugaccauuuccaaucuagaaccagaggacaucggcacauauuacugucagcaguauucaaaacucccgcggaccuuuggugggggaacuaagcuggaaauuaaacgcacaguggcagcccccaguguauucaucuuuccuccaagcgaugagcagcuuaagucuggcaccgcguccguggucugccuguugaacaauuucuacccccgagaagcuaaagugcaauggaagguugacaacgcccuccagucaggcaauagccaggagagugugacggagcaggauucuaaggacuccacuuacagccugucgucuacccugacacucuccaaagcagauuaugaaaagcacaaagucuacgccugugaggugacucaucaaggguuaucaaguccuguaaccaagagcuuuaaccguggagaaugc

SEQ ID NO: 23395 - RNA, 1347 nt, Artificial Sequence
  derived and/or modified sequence opt3 from Indusatumab_vedotin_HeavyChain1
caggugcaacugcagcaguggggcgccgggcuccuuaagcccagcgagacccuguccuugacaugcgcugucuucggagguucuuuuucaggcuacuauuggaguuggaucagacagccuccagggaaaggauuagaauggauuggcgagauaaaccacagggguaauacuaacgacaauccgagccugaagucccggguuacgaucucuguggauaccucgaaaaaccaauucgcacuaaagcucucaagcguaacagccgcggacacugcuguguacuauugugcccgcgaacgaggguacaccuauggaaauuuugaucauuggggccagggcacacuggucaccgugaguuccgcaucuacuaaagggcccagcguuuucccucuugccccauccucaaagaguacaagcggagguaccgcugcacugggcugcuuggugaaggacuacuuucccgagccugucacggugucuuggaacuccggggcccucacuucaggaguacacaccuucccagcuguucugcagagcaguggccuguauucucucuccagcguggucacagugcccucgucuuccuuagguacucagaccuacauuuguaaugugaaccauaaaccuucaaauacaaaggucgauaaaaagguugaaccaaaaaguugcgacaagacccacacguguccgcccugcccugccccagagcugcuugggggacccagcguguuuuuguucccuccaaagcccaaagauacucugaugaucucccguacaccggagguaaccuguguggucguggacguuucucaugaagauccugaggugaaguuuaacugguacgucgacggcguggaaguacacaaugcgaaaacuaagcccagagaggagcaauauaacagcacauacaggguugugucaguccuaaccgugcuccaccaggauuggcugaauggcaaagaauauaagugcaaagucaguaacaaggcacuuccagccccuauugagaagacgaucuccaaagcuaaggggcagccccgggaaccacagguguacacccugcccccuagccgcgacgaguugacuaaaaaucaaguuucucucacaugucuggugaagggauucuauccaucagauauagccguagaaugggagaguaacggucagccggagaacaauuacaaaaccacacccccugucuuagacagcgacggcuccuuuuuccuguauucuaagcucacuguggauaagucgagauggcagcaagggaacguuuuuagcugcuccgugaugcaugaagcacuucacaaucauuacacccagaaaucacugaguuugucuccaggaaag

SEQ ID NO: 23396 - RNA, 642 nt, Artificial Sequence
  derived and/or modified sequence opt3 from Indusatumab_vedotin_LightChain1
gagaucgugaugacccagagccccgccacacuguccgucucuccuggcgaaagagcuacucucucaugcagggcaagucaaagcguuucccggaaccuugccugguaccagcagaagccagggcaggcgccgcgccuguugauuuauggagcuucuacgcgagccaccgguauacccgcacguuucucgggcucagggagcggaacagaguuuacuuuaaccaucggcagucugcaauccgaagacuucgccguguacuauugucagcaguacaaaacauggccuagaaccuuuggucaggggacuaauguagagauuaagaggacaguggcugcaccaucugucuucaucuuucccccuagcgaugaacaacuaaaauccggaaccgccucagugguuugccuccugaacaauuucuauccacgggaggcuaaggugcaguggaaagucgacaacgcccuucagaguggcaauagccaggagucugugacggaacaagauuccaaggacucaacuuacagccugaguucuaccuugacacucuccaaggcggauuaugagaaacacaagguauacgcaugugaaguuacucaucagggccugagcucgcccgugaccaaaucuuuuaaccgcggggagugc

SEQ ID NO: 23397 - RNA, 1353 nt, Artificial Sequence
  derived and/or modified sequence opt3 from Inebilizumab_HeavyChain1
gaggugcagcuggucgaaagcggcgggggacucguucaacccgguggcucccuuagacugucuugcgccgcuucaggguucaccuuuaguagcuccuggaugaacugggugaggcaggcaccuggaaagggcuuggaguggguaggucggaucuacccaggggacggagauacaaauuauaacgugaaauucaagggccgcuuuacuauuucucgagacgauucgaaaaauucauuauaccugcagaugaacagccuaaagacggaagacaccgccgucuauuacugugcgcguaguggcuucauaacaacugugagagauuuugacuauugggggcagggaacccucguuacaguguccucugcuagcaccaaagguccguccgucuucccccuggccccuucaaguaagagcacuucuggcgggacagcagcccuuggaugccuggugaaggauuacuuuccagagcccguaaccguuuccuggaacucaggcgcuuugacgagcggugugcacacuuucccugcaguccuccaaaguucugggcuguauucccugagcucgguggugaccgucccaucuuccucacucggaacacagacuuacaucuguaauguuaaucauaaacccaguaacaccaagguggacaaaaggguagaaccuaagagcugcgauaaaacacacaccuguccaccgugccccgccccugaguuacugggcggcccauccguguuucuuuuucccccuaagccaaaggacacguugaugauuucucggacucccgaggucacaugugugguuguggaugucagccaugaagacccggaggugaaauuuaauugguacguagaugggguugaagugcacaacgcuaagaccaaaccucgcgaggagcaguauaauucaacuuacagagucgugaguguccugacagugcuacaucaggacuggcucaacggaaaggaauauaaaugcaagguuuccaauaaagcccugcccgcgccaaucgagaagaccauuagcaaggcaaaaggucaaccuagggaaccccagguguacacgcuuccacccucucgggaggaaaugaccaagaaccagguaucacugacauguuuggucaaaggcuucuauccuagugacaucgccguggagugggagagcaaugggcagccagaaaacaacuacaagacuaccccgcccguucucgauuccgacggaucuuucuuccuguauucgaaauuaacaguggauaagagccgcuggcaacagggcaaugucuucuccugcucagugaugcacgaggcucugcacaaccauuacacucagaagagucucucucuuagcccugguaaa

SEQ ID NO: 23398 - RNA, 654 nt, Artificial Sequence
  derived and/or modified sequence opt3 from Inebilizumab_LightChain1
gagaucgugcugacccagagccccgacuuccaauccgucacaccuaaggaaaaaguuacuauuacgugcagagccucugagucaguggauaccuuuggcauaaguuucaugaacugguuucagcagaagccagaccagagcccgaaacuccuuauccacgaggcuuccaaucaagggucuggaguacccucgagguucucagguagcggcagugggacagauuuuacucugaccauuaacuccuuggaagcagaagacgccgcgacauacuauugucagcagucuaaggaggugccuuucaccuuuggaggcgguacuaaagucgagaucaagcggacaguggcugccccaagcguuuucauuuuucccccuuccgaugaacaguuaaagucagggaccgcaaguguggucugccugcuaaauaacuucuacccacgcgaggccaaagugcaauggaagguagacaaugcucuccagagcggaaacucucaggaauccguuacggagcaggauucaaaagacagcacuuauagucugucuuccacccuuacacugagcaaggcagauuacgagaaacauaagguguaugccugugaagucacucaccaaggcuugucgucucccgugaccaaguccuuuaaucgaggcgagugc

SEQ ID NO: 23399 - RNA, 90 nt, Artificial Sequence
  derived and/or modified sequence opt3 from Insulin_peglispro_Fragment1
uucgugaaccagcaccugugcggcagccaucucgucgaggcccuuuaccugguuuguggggaaagaggauuuuucuauaccaagcccaca

SEQ ID NO: 23400 - RNA, 63 nt, Artificial Sequence
  derived and/or modified sequence opt3 from Insulin_peglispro_Fragment2
ggcaucguggagcagugcuguaccagcauuugcucccuguaccaacucgaaaacuauuguaau

SEQ ID NO: 23401 - RNA, 495 nt, Artificial Sequence
  derived and/or modified sequence opt3 from Interferon_beta-1b_chain1
agcuacaaccugcucggcuuccuucagagauccucuaauuuucaaucacagaagcuguuguggcaguuaaacgggaggcuggaguauugccuaaaagaccggaugaauuucgauauccccgaagagauuaagcagcuccaacaguuucagaaagaagacgccgcucugaccauauacgagaugcuucagaacaucuucgcaauuuuucgccaagauaguagcuccacaggauggaaugaaacuaucguggagaaccuguuggccaaugucuaucaccagauuaaccaucucaagacgguucuggaggaaaaacuggagaaggaagacuucacccgagguaagcucaugucuucguuacaccugaaacguuacuauggcagaauccuucauuacuugaaggcgaaagaguauucacacugugcuuggacaauagugaggguagagauccugcggaauuuuuacuucauuaaccgccuaacuggguaccucagaaau

SEQ ID NO: 23402 - RNA, 1347 nt, Artificial Sequence
  derived and/or modified sequence opt3 from Intetumumab_HeavyChain1
caggugcaacuggucgagagcggcgggggaguugugcagcccgguagauccaggcggcucucuugcgccgcuucaggcuucaccuuuagucgcuacacaaugcacuggguacgacaggcaccugggaagggacuugaauggguggccgucaucagcuucgacggcuccaacaaauauuacguggauucuguuaagggucguuuuacuauuucgagagacaauucagagaacacgcuguauuuacaggugaauauauugagggcggaagauaccgcugucuacuauugugcccgggaggcacgcgggagcuacgccuucgacaucuggggacaaggcacaauggugacuguaaguuccgcuucuaccaaaggcccaagcguuuuuccgcuggcacccuccucaaagaguacaagcgggggaaccgccgcucuagguugccucgugaaagauuauuucccugaaccagucacugugucuuggaacuccggcgcccugacaucaggggugcauaccuuucccgcgguccuucagagcaguggacuguacucuuuguccagcguugugacgguaccuucgucuucccucggcacucagaccuacauuuguaaugugaaccacaagccaucaaauacaaaggucgacaaaaagguggagcccaaaaguugcgauaagacucauaccuguccuccaugcccggcacccgagcugcugggugggccuagcguuuuccucuuuccacccaaaccuaaggacacauuaaugaucuccagaaccccagaagugacgugugucgugguagauguuucucacgaggaccccgaagugaaguucaacugguaugucgauggaguggagguccauaaugccaaaacuaagccgagggaggaacaguacaacagcacauaucgggugguuucagugcugaccguacuucaccaagacugguugaauggcaaagaguacaagugcaaagucaguaacaaggcucugccugcccccauugagaaaacuaucuccaaggcaaagggccagccacgcgaaccucagguguauacacuacccccaagccgagaugaacucaccaaaaaucagguuucucugacgugucuugugaagggguuuuaccccucagacauagcugucgagugggagaguaacggacaaccugaaaauaacuauaaaaccacaccaccggugcuggacagcgaugguuccuucuuuuuguacucuaagcucacuguagacaaaucgagauggcagcagggcaacguguucagcugcuccguuaugcacgaggcccugcauaaucacuacacccaaaagucauuaagucugucucccgggaag

SEQ ID NO: 23403 - RNA, 645 nt, Artificial Sequence
  derived and/or modified sequence opt3 from Intetumumab_LightChain1
gagaucgugcugacccagagccccgccacacucucccuuucuccuggcgaaagagcuacucugucaugcagggcaagucaaagcgucuccucuuacuuggccugguaucagcagaagccagggcaggcgccgcgguuacugauuuacgacgcuucgaaccgcgccacgggaauacccgcacgauucucagguagcggcagugggaccgauuuuacacuaacuaucuccucucucgagccugaagacuucgccguuuauuacugucaacagcguagcaauuggccacccuuuaccuucggaccuggcacaaaaguggauauuaagagaaccguagcugcaccauccguguuuaucuuucccccuucagacgagcagcugaaaagugguacugccagcgucgugugccuucugaacaauuucuauccaagggaagcuaagguucaguggaaaguggauaacgccuugcaaucuggaaauucccaggagucagucacagagcaggacagcaaggauaguaccuacucucucuccagcacgcugacucugucgaaggcggacuaugaaaaacacaagguguacgcaugugagguaacccaucaggggcucucuuccccgguuacaaaaucauucaaccggggcgaaugc

SEQ ID NO: 23404 - RNA, 1347 nt, Artificial Sequence; identical to SEQ ID NO: 23262
  derived and/or modified sequence opt3 from Iodine_(124I)_Girentuximab_HeavyChain1

SEQ ID NO: 23405 - RNA, 642 nt, Artificial Sequence; identical to SEQ ID NO: 23263
  derived and/or modified sequence opt3 from Iodine_(124I)_Girentuximab_LightChain1

SEQ ID NO: 23406 - RNA, 1335 nt, Artificial Sequence
  derived and/or modified sequence opt3 from Iodine_(131I)_derlotuxiab_biotin_HeavyChain1
caggugcaacugaaggagagcggccccgggcucgucgccccuucccagucucuuucaauuaccugcacaguuaguggauucagccugacugacuacggugugagauggaucaggcagccaccgggcaaaggguuggaaugguuaggaguaauauggggcgguggguccacguauuacaacucugcucugaagucgcggcuaucaaucagcaaagauaauaguaagucccagguguuucucaaaaacucucugcaaaccgacgauacagcauauuacugugccaaggagaagcgccgaggauauuacuaugcggacuacuggggccagggcacuagcgucaccguguccucagcuaguacaaaagggcccagcguuuucccucuugccccaucuuccaagucaaccagcggagguacugcagcccugggcugcuuggugaaagauuacuuucccgaaccugucacagugaguuggaacucuggggcucucaccuccggaguacacacguucccagcaguucugcagagcucgggccuguauucucucuccucaguggucacugugcccaguagcuccuuagguacccagacauacauuuguaaugugaaucauaagccuucuaacacuaaagucgacaagaaggccgagccaaaaagcugcgauaagacccacacauguccgcccugcccugcuccagaacugcuugggggacccucaguguuuuuguucccuccaaaacccaaggacacccugaucagucguacgccggagguuacuuguguaguggucgaugugucccaugaggacccugaaguuaaauuuaauugguauguggauggcgucgaggugcacaacgccaagacaaaacccagagaagaacaauacaauagcaccuauaggguaguuucugugcuaacuguccuccaucaggacuggcugaacggcaaggaguacaagugcaaagugucaaauaaggcgcuuccagcaccuauugagaaaacaaucaguaaggccaaagggcagccccgggagccacaggucuauacccugcccccuagccgcgaugaauugacgaagaaccaagugucccucaccugucugguuaagggauucuacccaucugacauagcuguggagugggaaucgaauggucagccggagaacaauuacaaaacaacucccccuguauuagacagcgauggcuccuuuuuccuguauucaaagcucaccgucgacaaaaguagauggcagcaagggaacguguuuucuugcagcguucacgaggcccuucacaaccauuacacacagaagucccugucauugagcccaggaaaa

SEQ ID NO: 23407 - RNA, 639 nt, Artificial Sequence
  derived and/or modified sequence opt3 from Iodine_(131I)_derlotuxiab_biotin_LightChain1
gagaacgugcugacccagagccccgccaucuccgcuucuccuggcgaaaaggucacaacuugcagagcaucaaguagcguuuccucuucguaccuccacugguaucaacagaaaucaggggccagcccaaaacuuuggauuuacaguacguccaaucuggcgucuggagugccggcuagguucagcgguuccggcucagggaccaguuauagcuugacaauaucuuccguagaggccgaagacgcagccacuuacuauugucagcaguacucaggauaucccuuaaccuuuggcggugggacaaagcuggagaucaagcggaccguggcugcaccuagcgucuucauuuuuccacccagugaugaacaacuaaaaucuggaacugccuccgugguuugccuccugaacaauuucuacccucgcgaggcuaaggugcaguggaaggucgacaacgcccuucagagcggcaauucgcaggagucugugacagaacaagauuccaaagacucaaccuacagucugagcuccacguugacucucucuaaggcggauuaugagaaacauaagguauacgcaugugaaguuacccaccagggccugagcucaccagugacaaaaaguuuuaaccgaggggagugc

SEQ ID NO: 23408 - RNA, 1350 nt, Artificial Sequence
  derived and/or modified sequence opt3 from Iodine_(131I)_Derlotuximab_biotin_HeavyChain1
caggugcaacugaaggagagcggccccgggcucgucgccccuucccagucucuuucaauuaccugcacaguuaguggauucagccugacugacuacggugugagauggaucaggcagccaccgggcaaaggguuggaaugguuaggaguaauauggggcgguggguccacguauuacaacucugcucugaagucgcggcuaucaaucagcaaagauaauaguaagucccagguguuucucaaaaugaacucucugcaaaccgacgauacagcaauguauuacugugccaaggagaagcgccgaggauauuacuaugcgauggacuacuggggccagggcacuagcgucaccguguccucagcuaguacaaaagggcccagcguuuucccucuugccccaucuuccaagucaaccagcggagguacugcagcccugggcugcuuggugaaagauuacuuucccgaaccugucacagugaguuggaacucuggggcucucaccuccggaguacacacguucccagcaguucugcagagcucgggccuguauucucucuccucaguggucacugugcccaguagcuccuuagguacccagacauacauuuguaaugugaaucauaagccuucuaacacuaaagucgacaagaaggccgagccaaaaagcugcgauaagacccacacauguccgcccugcccugcuccagaacugcuugggggacccucaguguuuuuguucccuccaaaacccaaggacacccugaugaucagucguacgccggagguuacuuguguaguggucgaugugucccaugaggacccugaaguuaaauuuaauugguauguggauggcgucgaggugcacaacgccaagacaaaacccagagaagaacaauacaauagcaccuauaggguaguuucugugcuaacuguccuccaucaggacuggcugaacggcaaggaguacaagugcaaagugucaaauaaggcgcuuccagcaccuauugagaaaacaaucaguaaggccaaagggcagccccgggagccacaggucuauacccugcccccuagccgcgaugaauugacgaagaaccaagugucccucaccugucugguuaagggauucuacccaucugacauagcuguggagugggaaucgaauggucagccggagaacaauuacaaaacaacucccccuguauuagacagcgauggcuccuuuuuccuguauucaaagcucaccgucgacaaaaguagauggcagcaagggaacguguuuucuugcagcguuaugcacgaggcccuucacaaccauuacacacagaagucccugucauugagcccaggaaaa

SEQ ID NO: 23409 - RNA, 645 nt, Artificial Sequence
  derived and/or modified sequence opt3 from Iodine_(131I)_Derlotuximab_biotin_LightChain1
gagaacgugcugacccagagccccgccaucauguccgcuucuccuggcgaaaaggucacaaugacuugcagagcaucaaguagcguuuccucuucguaccuccacugguaucaacagaaaucaggggccagcccaaaacuuuggauuuacaguacguccaaucuggcgucuggagugccggcuagguucagcgguuccggcucagggaccaguuauagcuugacaauaucuuccguagaggccgaagacgcagccacuuacuauugucagcaguacucaggauaucccuuaaccuuuggcggugggacaaagcuggagaucaagcggaccguggcugcaccuagcgucuucauuuuuccacccagugaugaacaacuaaaaucuggaacugccuccgugguuugccuccugaacaauuucuacccucgcgaggcuaaggugcaguggaaggucgacaacgcccuucagagcggcaauucgcaggagucugugacagaacaagauuccaaagacucaaccuacagucugagcuccacguugacucucucuaaggcggauuaugagaaacauaagguauacgcaugugaaguuacccaccagggccugagcucaccagugacaaaaaguuuuaaccgaggggagugc

SEQ ID NO: 23410 - RNA, 1344 nt, Artificial Sequence
  derived and/or modified sequence opt3 from Ipilimumab_HeavyChain
caggugcaacuggucgagagcggcgggggaguugugcagcccgguagaucccucaggcuuucuugcgccgcuucaggcuucaccuuuaguagcuacacaaugcacuggguacggcaggcaccugggaagggacuggaaugggugacuuucaucuccuaugacggcaacaauaaauacuaugccgauucugucaagggucgcuuuacgauuucgcgagacaacagcaaaaauaccuuguacuuacagaugaacucacugcgugcggaggauacagcuauauauuacugugccagaacuggguggcuaggaccauucgacuauuggggccaaggcacccucgugacaguuaguuccgcaucuaccaaggggccgagcguguuuccccuggccccuuccucaaaaaguacuagcggagguacagcugcacuuggcugccuggucaaggauuacuucccagaacccgugaccguaucuuggaacuccggggccuugacgucaggaguucauacuuuuccugcugugcuccagagcaguggccuguacucucuguccagcgucgugaccgugccaucgucuucccucgguacacagacuuauaucuguaaugucaaucacaagcccucaaacaccaaaguugacaagaggguggagccuaaaaguugcgauaagacacauaccuguccaccgugccccgccccugaauuacuugggggaccaagcguauuccuguuucccccuaaaccaaaggacacguugaugauuucccggacucccgaggugacaugugucgugguugaugugucucacgaggacccggaagucaaguucaauugguacguggauggcguagagguucauaacgcgaaaaccaagccucgcgaagaacaguauaauagcacuuacagaguggucucagugcugacaguccuacaccaagacuggcucaacggcaaagaguauaagugcaaagugaguaauaaggcacugcccgccccaaucgagaaaaccauuuccaaggcuaaggggcagccuagggagccccagguuuacacgcuuccacccagccgggaugaacugaccaaaaaccaggugucuuugacaugucucguaaagggauuuuauccuucagacaucgccgucgagugggaaaguaauggucaaccagagaacaacuacaaaacuaccccgcccgugcuggacagcgauggcuccuucuuuuuauacucuaagcugacaguugacaaaucgcgcuggcagcaggggaauguguucagcugcuccgucaugcacgaggcacuccauaaccacuauacucaaaagucacuuagucugucuccuggaaag

SEQ ID NO: 23411 - RNA, 645 nt, Artificial Sequence
  derived and/or modified sequence opt3 from Ipilimumab_LightChain
gagaucgugcugacccagagccccggcacacucucccuuucuccuggggaaagagccacucugucaugcagggcuagucaaagcgucggauccucuuacuuggcaugguaucagcagaagccaggucaggccccgcgguuacugauuuacggcgcguucucgcgcgcuacggggauacccgaccgauuuucaggaagcggcagugguaccgauuucacacuaacuaucucccgucucgagccugaagacuuugccguuuauuacugucaacaguaugggucuagcccauggaccuucggacagggcacaaaaguggagauuaagagaaccguagcagcccccuccguguuuaucuucccuccaucagaugaacagcugaaaaguggcacugcuagcgucgugugccuucugaacaauuuuuaccccagggaggcaaagguucaauggaaaguggacaacgccuugcagucuggaaauucccaggagucagucacagaacaggauagcaaggacaguaccuauucucucuccagcacgcugacucugucgaaggcugauuacgagaaacacaagguguacgccugugaaguaacccaucaagggcucucuuccccuguuacaaaaucauucaaccggggugagugc

SEQ ID NO: 23412 - RNA, 186 nt, Artificial Sequence
  derived and/or modified sequence opt3 from Iratumumab_HeavyChain1
caggugcaacugcagcaguggggcgccgggcuccuuaagcccagcgagacccuguccuugacaugcgcugucuacggagguucuuucucagcauauuacuggaguuggaucagacagccuccaggcaaaggguuagaauggauuggagacuauuggggccaagguagccugguuacuguguccucu

SEQ ID NO: 23413 - RNA, 321 nt, Artificial Sequence
  derived and/or modified sequence opt3 from Iratumumab_LightChain1
gacauccagaugacccaaagccccacaucccugucugccucagugggcgauagagucacuauuacgugcagggcuagucaggggauaagcuccuggcucaccugguaccagcagaagccugagaaagcaccaaagucucuuaucuaugccgcgucgucacugcaaagcggaguuccgagucgguucuccgguucuggcagcgggacagacuuuacuuugaccauuuccucauuacagcccgaagauuucgcuacauacuauugucagcaguacgacaguuauccuaucaccuuuggacaaggcacucgccuggagauuaaa

SEQ ID NO: 23414 - RNA, 1350 nt, Artificial Sequence
  derived and/or modified sequence opt3 from Isatuximab_HeavyChain1
caggugcaacugguccagagcggcgccgagguugcuaagcccgggaccuccgugaaacucucuugcaaggcaucaggauacacauucacugacuauuggaugcaguggguaaaacagagaccuggucaaggccuugaauggaucgggacgauuuacccaggagauggcgacaccgguuaugcccagaaguuucaggggaaagcgacacugacugcugauaagaguagcaagaccguguacaugcacuuguccucuuuagccucggaggacucagcagucuauuacugugccaggggagauuauuacggcagcaacagucuggacuacuggggccaggggacauccgugaccguuucuagcgcuuccacuaaaggaccgucaguguucccccuagcaccuaguagcaagucuacauccgguggcaccgccgcucucgggugccuggucaaagauuauuuuccagaacccgugacgguaucauggaauagcggagcccuuaccaguggcguucauacuuucccugcggugcugcaaucuuccgguuuguacagccucucgucugucgugacagugccauccucaagucuggggacucagaccuauauauguaacgucaaucacaagcccagcaacacaaaaguugacaagaagguggagccuaaauccugcgauaagacccauacguguccaccgugccccgcaccugaacugcucggaggcccaucuguauuuuuauuucccccuaaaccaaaggacacucugaugaucagccggacacccgaggugaccugugucgugguugaugugucacacgaggacccggaagucaaauucaauugguacguggauggcguagagguucauaacgccaagacuaaaccucgcgaagaacaguauaauaguacauaccgaguggucuccgugcuuaccgucuugcaccaggacuggcugaacgggaaggaguauaagugcaaagugagcaauaaggcucuacccgccccaauugagaaaacgaucucuaaggcaaaaggacaaccucgugagccccagguuuacacccucccacccucaagagacgaacugacaaagaaccaggugagucuuacuugucugguaaaggguuucuacccuagcgauauugcugucgagugggaauccaauggccaaccagagaacaauuauaaaaccacaccgcccguguuggacucugaugggucguuuuuccucuacagcaagcugacuguugacaaauccagguggcagcagggaaacguguuuucaugcagugucaugcacgaggccuuacauaaucacuauacccagaagucucugagccucuccccuggcaaa

SEQ ID NO: 23415 - RNA, 642 nt, Artificial Sequence
  derived and/or modified sequence opt3 from Isatuximab_LightChain1
gacaucgugaugacccagagccaccuguccaugucuacaucacucggcgaucccgucaguauuacuugcaaggccagccaagacguuuccacggugguagcuugguaccagcagaaaccugggcagucuccaagaaggcuuauauauucggcaucauaccgguauaucggagugccggaucgcuucaccgguagcggcgccgggacagacuuuacuuucaccauuaguuccguccaagcggaggaucuggcuguguacuauugucagcagcauuacucucccccuuauacauuuggaggcgguaccaaguuggaaaucaaacgaacuguugccgcaccaagcguguucauuuuucccccuuccgacgagcaguuaaagucagggacagccagugucgugugccugcuaaacaauuucuacccacgugaagcuaaaguacaauggaagguugauaacgcacuccagagcggaaauucucaggaguccgugaccgaacaggacucaaaggauagcacguacagucugucuuccacucuuacccugagcaaagccgacuaugagaagcacaaagucuacgcuugugaggugacacaucaaggcuugucgucucccgugacuaaguccuuuaacagaggcgaaugc

SEQ ID NO: 23416 - RNA, 1347 nt, Artificial Sequence
  derived and/or modified sequence opt3 from Itolizumab_HeavyChain1
gaggugcagcuggucgaaagcggcgggggacucguuaagcccgguggcucccuuaaacugucuugcgccgcuucaggguucaaguuuaguagauacgcaaugagcugggugaggcaagccccuggaaaacgguuggaguggguagcgaccaucuccucuggcgguucguauauuuacuauccagacucagugaaggggcgcuucacaauaagccgagauaacgucaaaaauacuuuauaccugcagaugaguucccuacguucugaagacacggcuauguauuacugugccagaagggauuaugaccucgauuacuuugacagcuggggacagggcacccuggugacaguuuccucagcaaguacuaagggcccgagcguguucccccuugccccuucuuccaagucaaccagcgggggaacagcugcacuggguugcuuggucaaagauuacuuuccagagcccgugaccguaaguuggaacucuggcgcccucacuuccgggguucacacauucccugcugugcugcagagcucgggacuguauucucucuccucagucgugaccgugccaaguagcuccuuaggcacgcaaacuuacaucuguaaugucaaccauaagcccucuaauaccaaaguugacaagaaaguggaaccuaagagcugcgauaagacacacacuuguccaccgugccccgccccugagcugcuuggugggccaucaguauuuuuguuucccccuaaaccaaaggacacccugaugauuagucggacacccgaggugaccugugucgugguugaugugucccaugaagacccggaggucaaauucaacugguauguggauggaguagaaguucacaaugcgaagacgaaaccucgcgaggagcaguacaacagcacuuauagaguggucucugugcuaacaguccuccaucaggacuggcugaauggcaaggaauacaaaugcaaggugucaaacaaggcacuucccgccccaaucgagaaaaccauuaguaaggcuaaaggccagccuagggaaccccaaguuuauacucugccacccagccgggacgaguugacaaagaaucaggugucccucaccugucugguaaaaggguucuacccuucugauaucgccgucgaaugggagucgaacggacagccagagaauaacuacaagacgaccccgcccguguuagacagcgaugguuccuuuuuccuguauucaaagcucacaguugacaaaagucgcuggcagcaaggcaauguguuuucuugcagcgucaugcacgaagcacuucacaaccauuacacucagaagucccugucauugagcccugggaaa

SEQ ID NO: 23417 - RNA, 642 nt, Artificial Sequence
  derived and/or modified sequence opt3 from Itolizumab_LightChain1
gacauccagaugacccaaagccccuccucucugucagccagugugggcgauagagucacaauuacuugcaaggcuagcagggacauacgguccuaccucacgugguaucagcagaaaccugggaaggcaccaaaaacccuuaucuacuaugccacaucucuggcggauggaguuccgucgcgcuucucagguagcggcagugggcaggacuacuccuugacuauuucuagcuuagaguccgaugacaccgcuacauauuacugucugcaacacggagaaucacccuuuacccuaggcagugguacuaagcucgagaucaaacgaacaguggccgcaccuagcguauucauuuuuccacccucugaugaacagcugaaguccgggaccgccucaguggucugccuucugaacaauuucuauccucgugaggcuaaggugcaguggaaaguugacaacgcauugcagagcggaaauagucaagaaucugugacggagcaggauuccaaggacagcacuuacucgcucucuuccacccugacacugucaaaagccgauuacgagaagcauaaagucuaugcuugugaagugacucaccagggccucaguagcccaguaaccaaguccuuuaacagaggcgagugc

SEQ ID NO: 23418 - RNA, 1335 nt, Artificial Sequence
  derived and/or modified sequence opt3 from Ixekizumab_HeavyChain1
caggugcaacugguccagagcggcgccgagguuaagaaacccggguccucugugaagguaucaugcaaagcuaguggauacagcuucaccgacuaucacauccauugggugagacaggcaccuggucagggccucgaauggaugggggucauuaacccaauguacggaacaacugauuauaaucaaagguuuaagggccgggugacgauaaccgccgacgaguccacaucuacugcguacauggaacuuucgucacugcgcagcgaggauaccgcuguuuauuacugugcccgauaugacuacuucacagguaccgggguguacuggggacagggcacuuuggucacagugaguuccgcaucuaccaaaggcccgagcguauuucccuuagccccuugcucccguucaacgagugaaagcacugcugcacuggggugucuaguuaaggauuauuucccagagcccgugaccgucucuuggaacuccggagcccucacaucaggugugcacacuuuuccugcugugcugcagagcaguggccuuuacucucuguccagcgucguuaccgugccaucgucuuccuuggggacaaagaccuauacgugcaauguagaccauaaacccucaaacacuaagguggauaaaagagucgagaguaaguacggaccuccauguccgcccugcccugccccagaguuccucggcggucccagcguguuucuguucccuccaaaacccaaggacacacugaugaucuccaggaccccggagguuacuuguguggucguggauguaucucaggaagacccugagguucaauuuaauugguauguggauggggucgaggugcacaacgcgaagacaaaaccccgggaagaacaguucaauagcaccuaccgcgucgugucaguucucacgguguuacaucaggacuggcugaacggaaaggaauauaaaugcaagguaaguaauaaaggccuuccauccagcauugagaagaccaucucuaaagcaaagggccagccuagagaaccccaagucuacacauugccacccucacaggaggagaugacuaagaaccaggugagucugaccugucuaguuaaaggguuuuacccuagcgauauugccguggaaugggaguccaauggacaaccagaaaacaauuauaagacaacuccgcccguccucgacucugacgguucguucuuucuguacagcaggcuuaccguggauaaaucccgguggcaggagggcaacguauucucaugcagugugaugcacgaagcucugcacaaucauuauacacagaagucuuugagccucucccugggg

SEQ ID NO: 23419 - RNA, 657 nt, Artificial Sequence
  derived and/or modified sequence opt3 from Ixekizumab_LightChain1
gacaucgugaugacccagacaccccugagccucuccgucacuccuggccaaccagccucuauuucaugccggaguagcaggucccuuguucacucucgggggaacacguaccugcauugguauuugcagaagccgggacagucgccccaguuacugauauacaaagugucaaaucgcuucaucgguguaccugaucgauuuagcggcaguggguccggaaccgacuucacacuaaagauuucucguguggaggcugaagaugucggcguguauuacuguagccaauccacucaccucccauuuaccuucggucaggggacaaaacuggagaucaagagaaccguugcagcccccucaguguuuauuuucccuccaagugacgaacagcuuaaaagcggaacugcgucugucgugugccuguugaacaauuuuuaucccagggaggcuaagguacaguggaagguugauaacgcccuccaauccggcaauucacaggaaagcgugacagagcaggacaguaaagauucuaccuacucccugagcucgacgcugacucucucuaaggcagacuaugagaaacauaaggucuacgccugugaagugacccaccagggcuuauccucaccugugacaaaaaguuucaacagaggggagugc

SEQ ID NO: 23420 - RNA, 1347 nt, Artificial Sequence
  derived and/or modified sequence opt3 from Labetuzumab_govitecan_HeavyChain1
gaggugcagcuggucgaaagcggcgggggaguugugcaacccgguagaucccucaggcuuucuugcucagccaguggcuucgacuuuaccacauacuggaugagcuggguacggcaggcuccugggaagggacuggaguggaucggcgaaauucacccagauuccucuacuauaaacuaugcaccgucguugaaagaccgcuucacgaucucacgagauaaugccaagaacaccuuauuucugcagauggacagccuacgucccgaggauacagguguguacuucugugcgagucucuauuuuggguucccuugguuugcuuacuggggacagggcacuccagucaccguguccucugccagcacaaaaggccccuccguuuucccucuggcaccaucaaguaagagcaccucugggggaacugccgcucuugguugccuggugaaagacuauuuucccgaaccugucacaguguccuggaacucaggcgcauugaccagcgggguacauacguucccagccguucuccaaaguucuggacuguacucccugagcucgguggucacugugccgucuuccucacucggcacccagacauauauuuguaaugugaaucacaagcccaguaacacuaaggucgauaaaagaguugagccuaagagcugcgacaaaacccauacauguccacccugcccugcuccagaguuacugggugggcccuccguguuucuuuucccgccuaagcccaaagauaccuugaugaucucuaggacgccagaaguaacuuguguggucguggacguuagccacgaggauccugaagugaaguuuaauugguacgucgacggaguggagguacauaacgccaagacaaaaccccgggaggaacaguacaauucaaccuaucgcguugugaguguccugacugugcuacaccaggauuggcucaacggcaaggaguacaaaugcaaggucuccaauaaagcgcugccagcacccauugaaaagacaaucagcaaagccaagggccaaccuagagagccacagguguauacccuuccgcccucuagggaagagaugacgaagaaccagguuucacugaccuguuuggugaaaggguucuacccuagugacauagcuguagagugggaaagcaauggacagccagagaacaauuauaagacaacucccccuguccucgacuccgaugguucuuucuuucuguacucgaaauuaaccguggacaagagccgguggcaacagggcaacguuuucuccugcucagugaugcacgaagcccugcauaaccacuauacacagaaaagucucucucuuagcccagggaag

SEQ ID NO: 23421 - RNA, 639 nt, Artificial Sequence
  derived and/or modified sequence opt3 from Labetuzumab_govitecan_LightChain1
gacauccagcugacccaaagccccuccucucucucagccagugugggcgauagagucacaauuacuugcaaggcuagccaggacguugggacguccguggcaugguaccagcagaaaccuggaaaggccccaaaacuucugauauauuggaccucuacaaggcacacugguguaccgucgcgguucucaggcagcgggaguggaaccgauuuuacauucaccaucuccucuuugcaacccgaggacauugcgacuuacuauugucagcaguacagcuuauaucgcuccuuuggccaggguacaaagguggaaaucaaacgaaccgucgcugccccuucaguguucauuuuuccacccagugaugagcaacuaaagagcgggacggcaucuguugugugccugcucaacaauuucuacccucgugaagccaagguccaguggaaaguggacaacgcucugcaguccggaaauucacaggagagcguaacugaacaagauaguaaggacucuaccuauucccuuagcucgacacugacuuugucuaaagcagauuacgagaagcauaaaguuuacgccugugaggugacccaccagggccucuccucaccagucacaaagaguuuuaacagaggcgaaugc

SEQ ID NO: 23422 - RNA, 1341 nt, Artificial Sequence
  derived and/or modified sequence opt3 from Lambrolizumab_HeavyChain1
caggugcaacugguccagagcggcguugaggugaagaaacccggggccuccguaaaggugucuugcaaggcuucaggauacaccuucacaaacuauuacauguauugggucagacaggcaccuggucagggccucgaauggaugggagggaucaauccaaguaacggcgguacuaauuuuaacgagaaauucaaaaauagggugacgcuuaccacagacagcuccacuaccacagccuacauggaacugaagucuuugcaauuugaugacaccgcgguuuauuacugugcucggcgcgauuaucgauucgacaugggguuugauuacuggggacagggcacuacagugaccgucucgucagccagcacgaagggcccgaguguguuccccuuagcaccuugcucccguucuacuagcgaguccaccgccgcucuggggugucuaguaaaagacuacuuuccagaacccguuacagugucauggaacaguggagcacucacuagcgguguccacaccuucccugccgugcugcagucuuccggccuuuauucacugagcaguguggucacaguuccaucuuccagcuuggggaccaagacguacacuugcaauguggaucauaaacccucgaacacaaagguagacaaaagaguggagucuaaguauggaccuccauguccgcccugcccugcuccagaguuucucggcggucccuccgucuuccuguuuccuccaaagcccaaagauacccugaugauuucaaggacuccggaagugacauguguuguggucgacgugagucaggaggauccugaaguacaauucaauugguacguugacgggguggagguccacaacgccaagaccaaaccccgggaggaacaguuuaauagcacguaucgcguggucuccgugcucaccguuuuacaucaggauuggcugaacggaaaggaguacaaaugcaaggugucuaauaaaggccuuccaagcucaauagaaaagacaaucaguaaggcgaaaggccagccuagagagccccaaguauauacuuugccacccucccaggaagagaugaccaagaaccaggucagccugacaugucuagugaaaggguucuacccuucugacauugcaguugagugggaaucaaauggacaaccagagaacaacuacaagacuaccccgcccgugcucgacagugaugguagcuucuuucuguauuccaggcuuacagucgacaaaucucgguggcaggaaggcaauguguucucgugcagcguaaugcacgaggcccugcauaaccacuacacccagaaguccuugucacucagucuggggaag

SEQ ID NO: 23423 - RNA, 654 nt, Artificial Sequence
  derived and/or modified sequence opt3 from Lambrolizumab_LightChain1
gagaucgugcugacccagagccccgccacacucucccuuucuccuggcgaaagagcuacucugucaugcagggcaaguaagggggucagcacguccggauacucuuauuugcacugguaccaacagaaaccaggucaggccccgcgguuacugauuuaucuagcgucguaccucgagucaggcguucccgcucgcuucagcgggaguggauccggcaccgacuuuacacugacuauaucuagccuugaaccugaggauuucgccguguauuacugucagcauucccgagaccugccauugaccuuuggugggggaacaaagguagaaaucaaacguaccguggcagcccccucagucuucauuuuuccuccaagugaugagcaacucaagagcggcacugcuucugugguuugccugcugaacaauuucuaucccagagaggcaaaagugcaguggaaggucgacaacgcccuccaguccggcaauucacaggaaagcgugacagagcaagauaguaaggacucuaccuacuccuuaagcucgacgcugacucuuucuaaagcugauuacgaaaagcacaaaguauaugccugugagguuacccaucagggguuguccucaccugugacaaagaguuuuaacaggggagagugc

SEQ ID NO: 23424 - RNA, 669 nt, Artificial Sequence
  derived and/or modified sequence opt3 from Lampalizumab_HeavyChain1
gaggugcagcugguccaaagcggccccgaacucaagaaaccuggggccuccguuaaggugucuugcaaggcuucaggauacaccuucacaaacuaugguaugaauuggguaagacaggcaccaggccaggggcuugaguggaugggauggaucaacacuuacacgggcgaaaccacauaugccgacgauuuuaaagguagguucguguuuagucuggacacuagcgucuccaccgcguacuugcagauuucuucguuaaaagcugaggauacagccguguauuacugugaacgggaagggggaguuaauaacuggggccaaggcacccuggugacugucucaagcgcaaguacaaaggggccguccguguucccccuagccccuucuagcaaguccaccucaggagguacggcugcacucggcugccugguaaaagacuauuuuccagagcccguuacugugaguuggaauagcggggcccuuaccucuggaguccacacauucccugcugugcugcaguccucaggcuuguacagccucaguucuguggucacuguuccauccagcucgcuggguacccagacauacauauguaacgugaaucauaagcccucuaacaccaaaguagauaagaaaguggagccuaaguccugcgacaagacgcacacu

SEQ ID NO: 23425 - RNA, 642 nt, Artificial Sequence
  derived and/or modified sequence opt3 from Lampalizumab_LightChain1
gacauccaggugacccaaagccccuccucucugucagccagugucggcgauagaguuacaauuacuugcauaacgagcaccgacaucgaugacgauaugaacugguaccagcagaagccugggaaagugccaaagcuccuuauuuccggagguaauacacugaggccgggcguacccucucgguucucggggucaggaagcggcacugacuuuaccuugacaaucaguuccuuacagccugaggauguggcuaccuauuacugucugcaaucugacagccuaccauauacuuucggucaggggacaaaagucgaaauuaagcgcaccguggcagcccccuccguuuuuaucuucccuccaucagaugagcagcucaaaaguggaacggcgagcguggucugccugcuuaacaauuuuuacccccgagaagcuaaggugcaguggaagguagacaacgcccugcaaucuggcaauucccaggagucaguuacugaacaggauagcaaagacaguaccuauucuuuguccagcacacucacucugucgaaggcagauuacgagaaacacaagguguaugccugugaggucacccaucagggccugucuuccccugugacaaaaucauucaaccguggggaaugc

SEQ ID NO: 23426 - RNA, 1353 nt, Artificial Sequence
  derived and/or modified sequence opt3 from Lanadelumab_HeavyChain1
gaggugcagcugcucgaaagcggcgggggacuuguccaacccgguggcucccugagauugucuugcgccgcuucaggguucaccuuuagucacuacaucaugauguggguuaggcaggcaccuggaaagggcuuagagugggugagcgguauuuauuccucugggggaauaacaguauacgccgacucggugaaaggccgguucacuaucucacgcgauaacagcaagaauacgcuguaucuacagaugaacagucuccgagcggaagacaccgcugucuacuauugugccuaccguagaauuggcgugccaaggcgggaugaguuugacaucugggggcagggaacaaugguuacuguguccucugcaagcaccaaagguccguccgucuucccccuggccccuucaaguaagagcacaucuggcgggaccgcugcacuuggaugccuggugaaagauuauuuuccagaacccguaacuguuuccuggaacucaggcgccuugacaagcggugugcauaccuucccugcuguccuccaaaguucugggcuguacucccugagcucgguggugacggucccaucuuccucacucggaacucagaccuacauuuguaauguuaaucacaagcccaguaacacaaagguggacaaacgcguagagccuaagagcugcgauaaaacucauaccuguccaccgugccccgccccugaguuacugggcggcccauccguguuucuuuuucccccuaagccaaaagacacauugaugaucucuagaacccccgaagucacgugugugguuguggaugucagccacgaggacccggaagugaaguuuaauugguauguagaugggguugaggugcauaacgcgaagacuaaaccuagggaggaacaguacaauucaacauaucgggucgugaguguccugaccgugcuacaccaggacuggcucaacggaaaggaguacaaaugcaagguuuccaauaaagcacugcccgccccaauagaaaagacuaucagcaaagcuaagggucaaccucgcgagccccagguguauacacuuccacccucucgagaagagaugaccaagaaccagguaucacugacguguuuggucaaaggcuucuacccuagugauauugccguggagugggaaagcaaugggcagccagagaacaauuauaagaccacaccgcccguucucgacuccgacggaucuuucuuccuguacucgaaauuaacuguggauaagagcagauggcaacagggcaacgucuuuuccugcucagugaugcacgaagcacugcauaaccacuacacccagaaaagucucucucuuagcccuggu

SEQ ID NO: 23427 - RNA, 639 nt, Artificial Sequence
  derived and/or modified sequence opt3 from Lanadelumab_LightChain1
gacauccagaugacccaaagccccuccacacugucugccucagugggcgauagagucacuauuacgugcagggcuagucagagcauauccucuuggcucgcaugguaccagcagaagccugggaaagccccaaaacuucugaucuauaaggcgucgaccuuggagucaggaguuccgagccgguucagugguuccggcucugggacagaauuuacuuuaaccauuagcucccugcaacccgacgauuucgcuacauacuauugucagcaguacaacaccuauuggacuuuuggacagggcacaaagguggagaucaaacgcaccguagccgcaccuucaguguucauuuuuccacccagugacgaacaacuaaagagcgguacggccucugucgugugccuccugaauaacuucuacccucgagaggcuaagguucaguggaaaguggauaaugcacuucaguccgggaacucacaggaaagcgucacugagcaagacaguaaggauucuaccuauucccugagcucgacauugacucucucuaaagccgacuacgagaagcacaaaguguacgcuugugaaguaacccaucagggacuguccucaccaguuacaaagaguuuuaaucguggcgagugc

SEQ ID NO: 23428 - RNA, 1317 nt, Artificial Sequence
  derived and/or modified sequence opt3 from Landogrozumab_HeavyChain1
gaggugcagcuggucgaaagcggcgggggacucguucaacccgguggcucccuuagacugucuugcgccgcuucaggguugaccuucaguagguacccuaugagcugggugcggcaggcaccaggaaagggcuuaguauggguguccgccaucacaucuucgggugggucaacuuauuacagcgacacggucaaaggacgcuuuaccauuagucgagauaacgcgaagaauacacuguaucuacagaugaacucccuccgugcugaggacacugccguguacuauugugcaagacugccggauuacuggggccagggcacccuuguuacagugucuagcgccuccaccaaagggcccucagucuucccucuggcuccaugcaguaggagcacuucugaauccacagcagccuugggaugucucgugaaggacuauuuucccgagccuguaaccguuucauggaauagcggugcucugacgaguggcgugcacacuuucccagccguccugcaaucuuccgggcucuacagcuuaucgucuguggugaccguccccuccucaagucugggaacaaaaacuuauaccugcaacguugaucauaagccuagcaauacaaagguggacaaacggguagaauccaaguacggcccaccgugucccccuugcccagcgcccgaguuucuuggugggccuucuguguucuuguuuccacccaaaccgaaggauacccugaugauaagccgcacgccugaggucacuugugugguuguggacgucucacaggaagaucccgaggugcaguucaacugguacguagacggaguugaagugcacaaugcaaaaacaaagccaagagaggagcaguuuaacaguaccuauagggucguguccguccuaacugugcuccaucaagauuggcugaauggcaaggaauacaaaugcaagguuagcaacaaaggccuuccuucuucaaucgagaagacaauuaguaaagccaaggggcagccccgggaaccacagguguauacccugcccccuagccaggaggaaaugacgaaaaaucaaguauccuugaccugucucgucaagggauucuacccaucugacaucgcuguggagugggagucgaacggucagccggaaaauaacuauaagacaacucccccuguucuggauagcgacggcuccuuuuucuuauacucacgccugaccguggacaaaagucgauggcaggaggggaaugucuuuucuugcagcgugaugcacgaagcccuccauaaccacuacacacaaaagucccuuucacugagcuuggga

SEQ ID NO: 23429 - RNA, 645 nt, Artificial Sequence
  derived and/or modified sequence opt3 from Landogrozumab_LightChain1
gagaucgugcugacccagagccccggcacacucucccuuucuccuggggaaagagccacucugucaugcagggcuaguagcuccgucucuucgucauacuugcacugguaucaacagaaaccaggacaggcaccgcgguuacugauuuacagcacgaguaaccuaguugccgguauacccgaccgcuucuccggcucugggagcggaaccgauuuuacacucacuaucucccgacuggagccugaagacuucgcgguguauuacugucagcaucacucaggcuaucauuuuaccuucggugggggaacaaaaguagagauuaagcguaccguggcugccccaagugucuuuaucuuucccccuagcgaugaacaacuuaaaucuggcacugcauccgugguuugccuguugaauaacuucuacccaagagaggccaaggugcaguggaaagucgacaaugcucuccagucaggcaacagccaggagagugugacagaacaagauucuaaggacuccaccuauagccugucgucuacgcugacucucuccaaggcagauuacgagaaacacaagguauacgccugugaaguuacccaucagggguuaucaagucccgugacaaagagcuucaauaggggagagugc

SEQ ID NO: 23430 - RNA, 1344 nt, Artificial Sequence
  derived and/or modified sequence opt3 from Laprituximab_emtansine_HeavyChain1
caggugcaacugguccagagcggcgccgagguugcuaagcccggggcauccgugaaacucucuugcaaggccucaggauacaccuucacaaguuauuggaugcaguggguaaaacagagaccuggucaaggccuugaauguaucgggacuauuuacccaggagacggcgauacgaccuauacacagaaguuucaggguaaagcgacucugaccgcugacaagagcuccucuacagccuacaugcaguugucgucauuaaggagcgaggauagugcaguguauuacugcgcccgguaugacgcuccgggguacgcaauggauuacuggggacaaggcacccuggucacuguguccucugccagcacaaagggccccuccguuuucccucuagcuccaucaaguaaaagcaccucugggggaacggccgcgcucgguugucuggugaaggacuauuuucccgaaccugucacuguguccuggaacucaggcgcacuuaccagcgggguacacacauucccagccguucugcagaguucuggauuguacucccucagcucgguggucacugugcccucuuccucacugggcacccagacauauauaugcaaugugaaccauaaaccuaguaauaccaaggucgauaaaaagguugagccaaagagcugugacaaaacgcacacuugcccgcccuguccugcuccagaacugcucggugggcccuccguguuuuuauucccuccaaagcccaaagauacacugaugaucucucgcaccccggagguaacuugcguggucguggacguuagccaugaggauccugaagugaaguuuaacugguacgucgacggaguggagguacacaaugccaaaacaaagccccgagaggaacaguauaacucaaccuaccguguugugaguguccuuacgguguugcaucaagauuggcugaauggcaaagaguauaaguguaaggucuccaacaaagcacuaccagcuccuauugaaaagaccaucagcaaagccaagggccagcccagagagccacagguguacacacugcccccuucuagggacgaacucacuaaaaaucaaguuucacuuaccugccuggugaagggguucuacccaagugacauugcgguagagugggaaagcaacggacagccggagaauaacuauaagacaacucccccugucuuggauuccgacgguucuuucuuucucuacucgaaacugaccguggauaagagccgguggcagcagggcaauguuuuuaguuguucagugaugcacgaggccuuacacaaccauuauacacaaaaaucccugucucucagcccaggg

SEQ ID NO: 23431 - RNA, 642 nt, Artificial Sequence
  derived and/or modified sequence opt3 from Laprituximab_emtansine_LightChain1
gacauccagaugacccaaagccccuccucucugucagccagugugggcgauagagucacaauuacuugcagggcuagccaggacauaaacaauuaccucgcaugguaucagcacaagccugggaaaggaccaaaacuucugauccauuacacguccaccuugcacccggguauucccucucgguucucgggcucagggagcggacgcgauuauaguuuuuccaucucuagcuuagagccugaagacauugccacauacuauugucugcaguacgauaaccuacucuauacuuucggccaagguaccaagcuggagaucaagcgaacaguugcggcuccauccguguuuauauuucccccuucagacgaacagcuuaaaagugggaccgccagcguagugugccuguugaauaacuucuacccacgugaggcaaagguccaguggaagguggauaaugcccuccagucuggaaacucccaagaaucaguuacugagcaggacagcaaagauaguacauacucucuguccagcacccugacgcucucgaaggcugacuaugagaaacauaagguguacgcaugugaagucacucaccagggcuuaucuucccccgugaccaaaucauucaauagaggcgagugc

SEQ ID NO: 23432 - RNA, 1314 nt, Artificial Sequence
  derived and/or modified sequence opt3 from Lealesoab_HeavyChain1
caggugcaacugcaggagagcggccccgaacucaagaaaccuggggagaccgucaagaucuccugcaaagccucuggauacacauucagaaacuaugguaauuggguuaagcaggcuccaggcaaagggcuuaaguggggauggauuaacacuuacacgggcgaaccgaccuaugcagacgauuuuaaggguagguucgccuuuucacuggagacaagugcgagcacugcuuacuugcagauaaauaacgugaaaaaugaagacaccgccacauauuucugugcacggaaggggugggauuuuaacggauccucuuuagacuacuggggccaaggcaccacuguaacagugucgucagccaaaaccacgcccccuagcgucuauccacuggcucccgggagugcagcccagacuaauuccgugacccuaggaugccucguuaaggguuacuucccugagccagugacagucacuuggaacucuggcagccuguccucaggggugcacaccuuucccgcuguacuucagagugaucuguacacauugucuagcuccguuaccgugccuucaagcccacgcccgagugagacggucacuuguaauguggcccaucccgcgucuuccacaaaaguggacaagaagaucgucccucgagauugcggauguaaaccaugcauuuguaccguucccgaagugagcucgguauucaucuuuccuccaaagcccaaagacgugcucacuauuacacugaccccgaaggucacgugcgugguuguggauaucucuaaagacgauccugagguccaguucuccugguuuguggacgauguagaaguucacaccgcacaaacacagccccgugaggagcaguucaacucaacuuuuagaagugugagcgaacugccaauacaucaggacuggcucaauggcaaggaguucaaauguagggucaacuccgccgcuuucccugcccccaucgaaaagaccauuucuaagacaaaaggucggccaaaggcaccccaaguguauacuaucccuccaccgaaagagcaggcuaaggacaaagucagcuuaaccugcauuacagacuuuuuccccgaagauaucaccguggaguggcaguggaaugggcaaccugccgagaacuacaagaauacucagccaauaaacacgaacggaucauauuuuguuuacaguaagcugaaugugcagaaauccaacugggaagcgggcaauacauucaccuguagcguacuucacgagggcuugcauaaccaccacacugaaaagucucugucacauagucccgggaaa

SEQ ID NO: 23433 - RNA, 654 nt, Artificial Sequence
  derived and/or modified sequence opt3 from Lealesoab_LightChain1
gacauccagcugacccaaacaccccucagccuuccugugucccugggcgaucaggccucuauuucaugcagaaguagccaguccauaguccacucuaacgggaauacuuacuuggagugguauuuacagaagccaggacaaucgccgaaccugcuaaucuacaaaguuucaaauagguucagcggugugcccgaccgguuuaguggcuccgggucuggaacggauuucacccucaagauuagccgcguagaagcugaggaccugggcguguauuacuguuuucaggguucccaugucccuccaacauucgggggaggcacuaaacuugaaaucaagcgagcagaugccgcgcccaccgugucaauuuuuccuccaaguagcgagcagcugacaucuggcggggcuuccguugugugcuucuugaacaauuuuuaucccaaagacaucaacgucaaguggaagauagauggaucagaacgucagaauggugugcucaacagcuggaccgaccaagauaguaaagacucuacuuacuccagcucgacacugacccugacgaaggaugaguaugagagacacaauucuuacacuugugaagccacccauaaaacauccacuucaccuaucguaaagaguuucaacaggaaugagugc

SEQ ID NO: 23434 - RNA, 1335 nt, Artificial Sequence
  derived and/or modified sequence opt3 from Lebrikizumab_HeavyChain1
caggugacccugagagagagcggccccgcccucgucaagccuacacaaacucuuacgcugaccugcacaguuuccggguucucuuugucagcuuacagugugaacuggaucaggcagccaccgggaaaagcauuagaauggcuggccaugauuuggggugacggcaagauaguauauaauagcgcgcuaaaaucccggcucacuaucucuaaggauaccucgaaaaaccaggugguccugacaaugaccaauauggaccccguggauacugcuacauacuauugugccggggacggauacuauccuuacgcaauggauaacuggggccaggguucacuuguuaccgugagcagugccuccacgaaggggccaucugucuuuccccuggcuccuugcagccgcuccacuucagagaguaccgcagccuugggaugucucgugaaggacuauuucccagaacccguaacaguuagcuggaauaguggcgcucugacuuccggcgugcacaccuuuccugccguccugcaaucaagcgggcucuacaguuuaucuuccguggugacagucccaagcucgucucugggaaccaaaacguacacuugcaacguugaucauaagccguccaauacaaaaguggacaagcgaguagagucaaaauauggucccccuuguccacccugcccugcgccagaguuccuuggcgggcccaguguguuuuuguucccgccuaagcccaaggauacccugaugauuagccguacuccagaggucacaugugugguuguggacgucucccaggaggauccugaagugcaguuuaacugguacguagacggaguugaggugcacaaugcaaaaaccaagcccagagaagaacaguucaacucuacguauagggucgugagcguccuaaccgugcuccaucaagauuggcugaauggcaaagaguacaagugcaaaguuucaaacaagggucuuccaaguuccaucgagaaaacaauuagcaaggccaaggggcagccccgggaaccucagguguauacucugccaccgucucaggaagagaugaccaaaaaucaaguaucauugacaugucucgucaagggauuuuaccccagugacaucgcuguggaaugggagagcaacggccagccugagaauaacuauaaaacuaccccacccguucuggacuccgauggcucuuucuuuuuauacucgcgccugacaguggacaagagcagauggcaggaagggaacgucuucuccugcucagugaugcacgaggcccuccauaaucacuacacccaaaaaucucuuucucugagcuugggaaag

SEQ ID NO: 23435 - RNA, 654 nt, Artificial Sequence
  derived and/or modified sequence opt3 from Lebrikizumab_LightChain1
gacaucgugaugacccagagccccgauucccugucugucucacucggcgagagagccacaauuaacugcagggcuaguaagagcguugacuccuacggaaauucuuucaugcacugguaucaacagaaaccugggcagccaccgaaacuucugauauacuuggcaucgaacuuagaaucaggugugcccgaucgguuuagcggcaguggguccggaacugacuucacgcugaccaucucuagccuacaggccgaggauguagcgguguauuacugucaacagaauaacgaagacccucgcacauuuggcggugggacuaaggucgagauuaagcgaaccguggcugccccauccguuuucaucuuucccccuucagaugaacagcucaaaaguggaacagcaagcguggucugccugcuuaauaacuucuauccacgugaggccaaggugcaguggaagguagacaaugcucugcaaucuggcaacucccaggagucaguuaccgaacaggauagcaaagacaguacuuacucuuuguccagcacacucacccugucgaaggcagauuaugagaaacauaagguguacgccugugaagucacgcaccagggccugucuucccccgugacuaaaucauuuaauagaggggagugc

SEQ ID NO: 23436 - RNA, 1227 nt, Artificial Sequence
  derived and/or modified sequence opt3 from Lenercept_chain1
cuggugccccaccucggcgacagagagaagagggauagcgucugcccucaggggaaauacauccauccacaaaacaauuccauuuguugcaccaagugucacaaaggaacauaucuuuacaacgacugcccgggucccggccaggauacugacugucgggaaugcgagucugggucauucacggccagugaaaaucaucugcgccacuguuugagcugcuccaagugucgaaaagagaugggacagguugaaauaucuucgugcaccguggaucgugacacaguauguggcugcagaaagaaccaguauaggcauuacuggucagagaauuuauuucaaugcuucaacuguagccugugccuaaaugguacugugcaccucaguugucaggagaagcagaacaccgucugcacaugucacgcuggguuuuuccugcgggaaaaugagugcguguccuguucuaacugcaaaaagagccuugaauguaccaaacugugcuugccucagaucgagaauguuaagggaacugaggauuccggcacaaccgacaaaacgcauacuuguccacccugcccugcaccagaacuccugggcgggcccucaguguuucuguucccuccaaagccgaaggauacccucaugauuagucgcacacccgaggucacuugcgugguaguugacgugagccacgaagauccugaggucaaauuuaacugguauguggacggaguggaaguccauaaugccaagaccaaaccaagagaggagcaauacaacucuacauauaggguuguguccguauuaaccgugcugcaccaggauuggcuuaaugguaaggaauacaaauguaaggucucaaacaaagcguugcccgcuccuaucgagaagacgauuagcaaggccaaaggccagccacgggaaccccagguguacacucugccgccuagucgcgaggaaaugacaaagaaccaaguuucucuaaccugccucgugaaaggguucuaucccuccgacaucgcagucgagugggagagcaauggacagccagaaaacaauuacaagacuacaccucccgugcuggacucggauggcuccuuuuuccuuuauucuaaacugaccguagacaagucacgauggcagcaagguaacguuuuuaguuguagcgugaugcacgaggccuugcauaaucacuacacgcagaagucccucucucugagcccagggaaa

SEQ ID NO: 23437 - RNA, 1347 nt, Artificial Sequence
  derived and/or modified sequence opt3 from Lenzilumab_HeavyChain1
caggugcaacugguccagagcggcgccgagguuaagaaacccggggcuuccgugaagguaucuugcaaagcaucaggauacaguuucaccaacuauuacauccacugggugagacaggccccuggucagaggcucgaauggaugggcuggauuaaugcggggaacggaaauacaaaguauagccaaaaauuucagggccgggucacuauaacgcgcgacaccuccgcuucuacagccuacauggagcuuucgucacugcgaagcgaagauacugcaguguauuacuguguucguagacagagguucccauauuacuuugacuacuggggucaggggaccuuggugacagucaguuccgccucuaccaagggaccgagcguguuccccuuagcuccuuccucaaagaguacuagcggcggcacagcagcccuggggugccuaguaaaagauuauuuuccagagcccguuaccgugucuuggaacuccggagcucucacgucagguguccauacuuucccugccgugcugcaaagcaguggccuuuacucucuguccagcguggucaccguuccaucgucuuccuuggggacacagacuuauaucuguaaugugaaccacaagcccucaaauaccaaaguagacaagcggguggaaccuaaaaguugcgauaagacacauaccuguccaccgugccccgcgccugagcuccugggaggcccaagcgucuuucuguuucccccuaagccaaaagacacgcucaugauuucccgcacucccgaggugacauguguuguggucgaugugucucacgaagacccggagguaaaguucaacugguacguugaugguguggaaguccauaaugcaaaaaccaagccuagagaggagcaguauaacagcacuuacaggguggucucaguguuaacaguucugcaccaggacuggcuuaaugggaaagaauauaagugcaaagugaguaacaaggccuugcccgcuccaaucgagaagaccauuuccaaagccaagggacaaccucgggaaccccagguauacacgcugccacccagccgcgaggaaaugaccaaaaaucaggucucucuaacaugucucgugaagggcuucuacccuucagauaucgcaguugagugggagaguaacggccaaccagaaaauaacuauaaaacuaccccgcccgugcuggacagcgauggguccuuuuuccuuuacucuaagcugacagucgacaagucgcgauggcagcagggaaacguguuuagcugcuccguaaugcacgaggcuuugcauaaucacuauacucagaaaucacucagucugucuccugguaag

SEQ ID NO: 23438 - RNA, 642 nt, Artificial Sequence
  derived and/or modified sequence opt3 from Lenzilumab_LightChain1
gagaucgugcugacccagagccccgccacacucuccgucucuccuggcgaacgggcuacucuuucaugcagggcaagucaaagcguugggacgaacguggccugguaccagcagaagccaggacaggcgccgcggguacugauuuauuccaccucuucgcgcgcuacagguauaacugaccgauucucaggcagcgggaguggaaccgauuuuacauugaccaucucccguuuagagcccgaagacuucgccguguacuauugucaacaguuuaauaaaucuccucugacuuucggcggugggacaaaggucgagauuaaaagaaccguggcagccccaagcguuuuuaucuuucccccuuccgaugaacagcuaaagucaggaacggcuaguguggucugccuccugaacaauuucuacccaagggaggcaaaagugcaguggaagguagacaacgcccuucaaagcggcaauucucaggaguccguuacugaacaggauucaaaggacagcaccuauagucugucuuccacauugacucucagcaaagcugauuacgagaagcacaaaguguaugccugugaagucacccaucagggccugucgucucccgugacaaaguccuucaacagaggggagugc

SEQ ID NO: 23439 - RNA, 1326 nt, Artificial Sequence
  derived and/or modified sequence opt3 from Lerdelimumab_HeavyChain1
gaggugcagcuggucgaaagcggcgggggaguugugcaacccgguagaucccucaggcuuucuugcgccgcuucaggcuucaccuuuaguagcuacgggaugcacuggguacggcaggcaccuggaaagggccuggaguggguggccgucaucugguaugacgguuccaacaaauacuaugcggauucugugaaggggcgcuucacaauuucgcgagacaauagcaaaaacacuuuguacuuacagauggauucacugcgugcugaagacacggccguuuauuacuguggaagaacccuagagaguucccucuggggccagggcacacuggugacugucucuagcgcauccaccaaggggccaucaguguuuccgcuugcccccugcaguaggagcacaucugaauccaccgcugcacugggauguuugguaaaagauuauuucccugagccaguuacugugucauggaauagcggugcccucacaaguggcguccauaccuuucccgcugugcugcaaucuuccgggcuguacagccucucgucuguggucacgguuccuuccucaaguuuaggaacuaagaccuacacaugcaacguggaccacaagccaagcaauacuaaaguagauaagcggguggaguccaaauauggucccccuuguccaucuugcccggcccccgaguuccugggcgggccuagcgucuuucuuuucccacccaagccuaaagacaccuugaugauaucacgcacaccagaggugaccuguguuguggucgaugugagucaggaagaccccgagguacaguuuaacugguacguugauggaguggagguccauaaugcgaagacgaagccgagagaagaacaguucaacuccacuuauaggguggucagcgugcugacaguucuacaccaagacuggcucaauggcaaagaauacaagugcaaagugucuaacaagggccugccuucaaguaucgagaaaaccauuagcaaggcaaaagggcagccccgggaaccacagguauauacucuuccucccucccaggaggagaugacaaagaaucaagucucucugaccuguuuggugaagggauuuuacccaucggauaucgccguugaaugggagagcaacggucagcccgaaaauaacuauaaaacgaccccuccagugcucgacuccgacggcucauucuuucuguacagucgcuuaacagucgauaagucucgauggcaggaggggaauguguucagcugcuccguaaugcaugaagcucugcacaaccacuacacucaaaaaucacucagccuuucucugggaaag

SEQ ID NO: 23440 - RNA, 645 nt, Artificial Sequence
  derived and/or modified sequence opt3 from Lerdelimumab_LightChain1
agcuccgagcugacccaggaccccgccgugucugucgcucucggccaaacaguuagaaucacuugccagggggauucacuuaggaguuacuaugcaagcugguaccagcagaagccuggacaagccccagugcugguaauuuaugguaaaaacaaucggccguccggcauacccgaccgcuucucugggucgucaagcggaaacacggcgaguuugaccaucacaggcgcucaggccgaagaugaggcagacuacuauuguaauucccgagauucuagcuccacucaccgugguguguuugggggaggcaccaaguuaacaguccugggccagccuaaagccgcuccaucagugacccuauuucccccuaguagcgaagaacuccaggcaaacaaggccacucugguuugccuuauuucugacuucuacccaggggcugugacagucgccuggaaagcggauuccucacccgugaaggcaggaguagaaaccacgacuccuagcaagcaaaguaauaacaaauaugccgcuucuuccuaccugagcuugaccccagagcaguggaagucgcauagaucuuacuccugucagguuacacacgaggguucaacuguggagaaaaccgucgccccgacagagugcagu

SEQ ID NO: 23441 - RNA, 1353 nt, Artificial Sequence
  derived and/or modified sequence opt3 from Lexatumumab_HeavyChain1
gaggugcagcugguccaaagcggcgggggaguugaaagacccgguggcucccucaggcuuucuugcgccgcuucaggguucaccuuugacgauuacggaaugaguugggugcggcaggcaccuggcaagggucuggaguggguaagcgggaucaacuggaauggaggcuccacaggcuaugccgacucugugaaagggcgcgucacuauuucgcgagauaacgcgaaaaauucauuguacuuacagaugaacagccugcgugcugaagacacggccguguauuacugugcaaagauacuaggagccgguagaggcugguauuucgaucucugggggaagggaaccacaguuacugugaguuccgcuucuaccaaaggcccaagcgucuuuccgcuggcacccuccucaaagaguacaagcggugggaccgccgcucuuggaugccuggugaaggacuacuucccugagccaguaacuguuucuuggaacuccggcgccuugacaucaggcgugcacaccuuucccgcgguccuccagagcagugggcuguauucucuguccagcguggugacggucccuucgucuucccucggaacucaaaccuacaucuguaauguuaaucauaaaccaucaaacacaaagguggauaaaaggguagaacccaagaguugcgacaaaacucacaccuguccuccaugcccggcacccgaguuacuggguggcccuagcguguuccuuuuuccacccaagccuaaggauacauugaugauuucccggaccccagaggucacgugugugguuguggacgucucucaugaagaucccgaggugaaauucaauugguacguagacgggguugaagugcacaacgccaagacuaaaccgcgcgaggagcaguauaauagcacauacagagucgugucaguccugaccgugcuacaucaggauuggcucaacggaaaggaauauaaaugcaagguuaguaauaaagcucugccugcccccaucgagaagacuauuuccaaggcaaaaggccagccaagggaaccucaaguguacacacuucccccaagccgggaggaaaugaccaagaaccagguaucucugacguguuuggucaaagguuuuuaucccucagacaucgcuguggagugggagaguaaugggcagccugaaaacaacuacaagaccacaccaccgguucucgacagcgauggcuccuucuuucuguauucuaaauuaacuguggacaagucgcgcuggcagcaaggaaaugucuucagcugcuccgugaugcacgaggcccugcacaaccauuacacccagaagucacucagucuuucucccggcaaa

SEQ ID NO: 23442 - RNA, 1353 nt, Artificial Sequence; identical to SEQ ID NO: 23441
  derived and/or modified sequence opt3 from Lexatumumab_HeavyChain

SEQ ID NO: 23443 - RNA, 642 nt, Artificial Sequence
  derived and/or modified sequence opt3 from Lexatumumab_LightChain1
agcuccgagcugacccaggaccccgccgugucugucgcucucggccaaacaguuagaaucacuugccagggggauucacuuaggaguuacuaugcaagcugguaccagcagaagccuggacaagccccagugcugguaauuuaugguaaaaacaaucggccguccggcauacccgaccgcuucucugggucgucaagcggaaacacggcgaguuugaccaucacaggcgcucaggccgaagaugaggcagacuacuauuguaauucccgagauucuagcgguaaccacguggucuuugggggaggcacuaaguuaaccgugcugggccagccuaaagccgcuccauccguuacacuauuucccccuucaagugaggaacuccaggcaaauaaggccacccuggugugccuuauuagcgacuucuacccaggggcugucacuguggccuggaaagcggauucuucccccguaaaggcaggaguugaaacaaccacgccuucaaagcaaagcaacaauaaauaugccgcuaguucuuaccuguccuugacuccagagcaguggaaaagccaucguucguacucuugucaggugacccacgaggguuccacagucgaaaagacuguggccccgaccgagugcuca

SEQ ID NO: 23444 - RNA, 642 nt, Artificial Sequence; identical to SEQ ID NO: 23443
  derived and/or modified sequence opt3 from Lexatumumab_LightChain

SEQ ID NO: 23445 - RNA, 1377 nt, Artificial Sequence
  derived and/or modified sequence opt3 from Libivirumab_HeavyChain1
caggugcaacuggucgagagcggcgggggaguugugagacccgguaggucccuccggcuuucuugcgccgcuucaggcuucgcauuuagugacuacagcaucaacuggguacgccaggccccugggaagggacuggaauggguggcgauuauauccuaugauggccgaaucaccuacuaucgugacucugucaaagguagauucacaauuucgagggaugacucaaagaauacuuuguacuuacagaugaacagccugcggacggaggauaccgcuguguauuacugugcccgccaguauuacgacuuuuggaguggguccucuguuggaagaaauuacgauggcauggacguguggggccuagggacaacugucaccgugagcuccgcaucaacaaaaggaccaaguguauucccgcucgcccccagcucuaaguccaccucagguggcacugcugcacuggggugccuuguuaaagauuauuuuccugaaccagugacagucagcuggaacaguggagcccugaccucuggcgugcacacguuccccgcuguguugcaauccagcggucucuacucgcugucuuccgucguuacugugccuucaaguagccuggggacccagacauauaucuguaauguaaaccauaagccauccaauacuaagguggacaaaagggucgagcccaagucuugcgauaaaacccacacauguccuccaugcccggcccccgaacucuuaggaggcccuagcguguuucuguucccacccaagccuaaagacacccuuaugauuucacggacgccagagguuacuuguguggucguggauguaagucaugaggaccccgaaguuaaguuuaacugguacguggacggcgucgaggugcacaaugcgaagacaaaaccgcgcgaggaacaguauaacuccaccuaccgagucgugagcguuuugacugugcugcaucaggauuggcuaaaugggaaggaguauaaaugcaagguaucuaacaaagcacucccugcccccaucgaaaagacaauaucaaaagcuaagggacaaccaagagagccucaggucuacacccugcccccaaguagggaagagaugacgaagaaucaggugagccuuaccugucugguuaaagguuucuaccccuccgacaucgccguggaaugggagucuaacggccagccugagaauaacuauaagacaacuccaccggucuuggauucggacgggagcuuuuuccucuacuccaaacugaccguggauaagucacgguggcaacagggaaacguauuuaguugcucugugaugcacgaagcauuacacaaucauuauacacagaaaagccugucccucucacccggcaag

SEQ ID NO: 23446 - RNA, 657 nt, Artificial Sequence
  derived and/or modified sequence opt3 from Libivirumab_LightChain1
gacaucgugaugacccagagcccccugucccucucugucacaccuggcgagccagccucaauuaguugcagaagcucccaaucucuucugcacaggucggggaacaauuacuuggauugguauuuacagaagccgggacauucaccccagcugcuaauauacguugguagcaaccgggcuaguggcgugccugaccgcuucuccgggucuggaagcggcacugaauauacgcucaaaaucucccgaguagaggcagaagaugugggugucuacuauuguaugcaggcccugcaaaccccacguacauuugggcagggaacuaagcuggagauuaaaagaaccguggcggcucccucaguuuucaucuuuccuccaagugacgaacagcuuaagagcggcacagccucuguggucugcuugcucaauaacuucuaccccagggaggcaaaagugcaguggaagguagauaaugcccugcaauccggcaacucacaggagagcguuaccgaacaggacaguaaggauucuacuuauucccugagcucgacacucaccuuaucuaaagcugacuacgagaagcacaaaguguacgcaugugaagucacgcaucaggggcuguccucaccugugacuaagaguuuuaaucggggagagugc

SEQ ID NO: 23447 - RNA, 1350 nt, Artificial Sequence
  derived and/or modified sequence opt3 from Lifastuzumab_HeavyChain
gaggugcagcuggucgaaagcggcgggggacucguucaacccgguggcucccuuagacugucuugcgccgcuucaggguucaguuuuagcgacuucgcaauguccugggugaggcaggccccuggaaagggcuuggaguggguagcgaccaucggucggguggcuuuucacacauacuauccagauucuaugaaagggcgcuucacuauuucgcgagacaacucaaagaauacguuauaccugcagaugaacagccuacgugccgaagauaccgcagucuauuacugugccagacauaggggauuugacgugggccacuucgauuuuuggggccaggggacacucguuacugugaguuccgcuucuaccaaaggaccgagcgucuucccccuggcaccuuccucaaagaguacaagcgguggcaccgccgcucuugggugccuggugaaagacuauuuuccagagcccguaacuguuucuuggaacuccggagccuugacaucaggcgugcauaccuucccugcgguccuccaaagcaguggucuguacucucuguccagcguggugacggucccaucgucuucccucgggacucagaccuauauauguaauguuaaucacaagcccucaaacacaaagguggauaaaaagguagaaccuaaaaguugcgacaagacucauaccuguccaccgugccccgcaccugaguuacugggaggcccaagcguguuucuuuuucccccuaaaccaaaggauacauugaugaucucccggacccccgaggucacgugugugguuguggacgucucucacgaagauccggaggugaaguucaauugguacguagacggcguugaagugcacaacgccaaaacuaagccucgcgaggagcaguacaauagcacauauagagucgugucaguccugaccgugcuacaucaggauuggcucaacgggaaagaauacaagugcaaaguuaguaauaaggcucugcccgccccaauugagaaaacuaucuccaaggcaaagggacaaccuagggaaccccagguguauacacuuccacccagccgggaggaaaugaccaaaaaccagguaucucugacguguuuggucaaggguuucuacccuucagacauugcuguggagugggagaguaauggccagccagaaaacaauuauaaaaccacaccgcccguucucgacagcgauggguccuucuuucuguacucuaaguuaacuguggacaaaucgcgcuggcaacagggaaacgucuucagcugcuccgugaugcacgaggcccugcauaaccacuauacccagaagucacucagucuuucuccuggcaag

SEQ ID NO: 23448 - RNA, 657 nt, Artificial Sequence
  derived and/or modified sequence opt3 from Lifastuzumab_LightChain
gacauccagaugacccaaagccccuccucucugucagccagugugggcgauagggucacaauuacuugcaggagcuccgagacgcucguucacucuucggggaacaccuaccuugaaugguaucagcagaagccuggaaaagcuccaaagcuguugauauaccgggugucaaaucgcuucagcgguguaccgagucgauuuuccggcucugggagcggaacagacuucacuuuaaccaucuccucacugcagcccgaggauuuugcaacauauuacuguuuccaaggcaguuuuaacccucuaaccuucggucaggggacuaaaguggaaauuaagcguacagucgccgcgccaagcguguuuaucuuucccccuucugacgagcagcucaaauccggaaccgcuucaguugugugccugcuuaauaacuucuauccaagagaagccaagguccaguggaagguggauaaugcacugcaaagcggcaacagucaggagucuguaacggagcaggacuccaaagauagcacuuacucguugucuuccacccucacacugucaaaggccgacuaugaaaaacauaagguuuacgcuugugaggugacucaccagggccugaguagccccgucaccaaauccuucaauagaggggaaugc

SEQ ID NO: 23449 - RNA, 1347 nt, Artificial Sequence
  derived and/or modified sequence opt3 from Lifastuzumab_vedotin_HeavyChain1
gugcagcuggucgagagcggcgggggacucguucaacccgguggcucccuuagacugucuugcgccgcuucaggguucaguuuuagcgacuucgcaauguccugggugaggcaggccccuggaaagggcuuggaauggguagcgaccaucggucggguggcuuuucacacauacuauccagauucuaugaaagggcgcuucacuauuucgcgagacaacucaaagaauacguuauaccugcagaugaacagccuacgugccgaggauaccgcagucuauuacugugccagacauaggggauuugacgugggccacuucgauuuuuggggccaggggacacucguuacugugaguuccgcuucuaccaaaggaccgagcgucuucccccuggcaccuuccucaaagaguacaagcgguggcaccgccgcucuugggugccuggugaaagacuauuuuccagaacccguaacuguuucuuggaacuccggagccuugacaucaggcgugcauaccuucccugcgguccuccaaagcaguggucuguacucucuguccagcguggugacggucccaucgucuucccucgggacucagaccuauauauguaauguuaaucacaagcccucaaacacaaagguggauaaaaagguagagccuaaaaguugcgacaagacucauaccuguccaccgugccccgcaccugaauuacugggaggcccaagcguguuucuuuuucccccuaaaccaaaggauacauugaugaucucccggacccccgaggucacgugugugguuguggacgucucucacgaggauccggaagugaaguucaauugguacguagacggcguugaggugcacaacgccaaaacuaagccucgcgaagaacaguacaauagcacauauagagucgugucaguccugaccgugcuacaucaggauuggcucaacgggaaagaguacaagugcaaaguuaguaauaaggcucugcccgccccaauugagaaaacuaucuccaaggcaaagggacaaccuagggagccccagguguauacacuuccacccagccgggaagagaugaccaaaaaccagguaucucugacguguuuggucaaggguuucuacccuucagacauugcuguggaaugggagaguaauggccagccagagaacaauuauaaaaccacaccgcccguucucgacagcgauggguccuucuuucuguacucuaaguuaacuguggacaaaucgcgcuggcaacagggaaacgucuucagcugcuccgugaugcacgaagcccugcauaaccacuauacccagaagucacucagucuuucuccuggcaag

SEQ ID NO: 23450 - RNA, 657 nt, Artificial Sequence; identical to SEQ ID NO: 23448
  derived and/or modified sequence opt3 from Lifastuzumab_vedotin_LightChain1

SEQ ID NO: 23451 - RNA, 1359 nt, Artificial Sequence
  derived and/or modified sequence opt3 from Ligelizumab_HeavyChain1
caggugcaacugguccagagcggcgccgagguuaugaagcccggguccucugugaaaguaucaugcaaggcuaguggauacaccuucagcugguauuggcucgaaugggugagacaggcaccuggucacggccuugaguggaugggggaaaucgacccaggaacauuuacuacgaacuacaaugagaaauucaaggccagggucaccuuuacagcggauacuuccaccucuacagcuuauauggaacugucgucauugcggagcgaggacaccgccguguacuauugugcacgcuucagucauuuuuccggcucuaacuacgauuauuucgacuacuggggucaggggacuuuaguuacagugagcuccgccucaaccaaaggaccgagugucuuuccccuggcuccuagcucuaaguccacgucaggcggcacugcagcccuagggugccucgugaaggauuacuucccagagcccguaaccguuagcuggaauaguggagcucugacaucuggugugcacacuuuuccugccguccuucaauccagcggccuguauucguugucuuccguggugaccgucccaucaaguagccucgggacacagaccuacauuuguaacguuaaucauaaacccuccaacacgaagguggacaaaaagguagaaccuaaaucuugcgauaagacucacacauguccaccgugccccgcgccugagcugcugggaggcccaagcguguuccucuuucccccuaagccaaaagacaccuuaaugauaucacgaacucccgaagucacaugugugguuguggaugucagucaugaggacccggaggugaaguucaauugguauguagaugguguugaagugcacaacgcaaaaaccaagccucgugaggaacaguacaauuccacguauagagucgugagcguccugaccgugcuucaccaggacugguugaacgggaaagaguacaagugcaaaguuucuaauaaggcccugcccgcuccaaucgaaaagacaauuucaaaagccaagggacaaccuagggagccccagguguauacucuaccacccagucgggaugagcucaccaaaaaccagguaagccugacaugucuugucaagggcuuuuacccuuccgacaucgcaguggaaugggagucuaauggccagccagaaaacaauuacaaaacuaccccgcccguucuggacucggaugggagcuucuucuuguauuccaagcucacaguggacaagucacgcuggcaacagggaaacgucuuuaguugcucugugaugcaugaggcucugcacaaccauuacacccagaaauccuuaagccugucaccugguaag

SEQ ID NO: 23452 - RNA, 642 nt, Artificial Sequence
  derived and/or modified sequence opt3 from Ligelizumab_LightChain1
gagaucgugaugacccagagccccgccacacuguccgucucuccuggcgaaagagcuacucucucaugcagggcaagucaaagcauugggacgaacauacacugguaccagcagaaaccaggacaggccccgcggcuucugaucuauuacgcguccgagucuauuucggguauccccgcucgcuucucaggcagcgggaguggaaccgaauuuacauugacuauuuccucuuuacaaagcgaggacuucgccguuuauuacugucagcaguccuggucauggccuaccacauuuggcggugggaccaaaguggaaaucaagcgaacuguagcagccccaaguguguucauauuucccccuagcgaugagcagcugaaaucuggaacagcuuccgucgugugccuacucaauaacuucuauccacgugaggcaaagguucaauggaaaguggacaaugcccugcagucaggcaacagccaggaaagugucaccgagcaggauucuaaggacuccacguacagccuuucgucuacucugaccuuguccaaggcugauuaugaaaaacauaagguguacgccugugagguaacacaccaaggccucucaagucccguuacuaagagcuuuaauagaggggagugc

SEQ ID NO: 23453 - RNA, 1329 nt, Artificial Sequence; identical to SEQ ID NO: 23001
  derived and/or modified sequence opt3 from Lilotomab_HeavyChain1

SEQ ID NO: 23454 - RNA, 642 nt, Artificial Sequence; identical to SEQ ID NO: 23002
  derived and/or modified sequence opt3 from Lilotomab_LightChain1

SEQ ID NO: 23455 - RNA, 1338 nt, Artificial Sequence
  derived and/or modified sequence opt3 from Lintuzumab_HeavyChain1
caggugcaacugguccagagcggcgccgagguuaagaaacccggguccucugugaagguaucaugcaaagcuaguggauacaccuucacagacuauaacaugcacugggugagacaggcaccuggucagggccucgaauggaucggguacauuuauccauacaauggaggcacugguuauaaccaaaaguuuaaaagcaaggccacgauaaccgcggaugaguccacaaauacugcuuacauggaacuuucuucgcugaggucagaggacaccgccgucuauuacugugcacgggggcgcccggccauggauuacuggggacagggcacauuggugaccguuagcagugcuuccacuaagggccccucuguguucccuuuagcaccaagcuccaaaucaacaagugggggaaccgccgcucuggguugccuagucaaggacuauuuucccgaaccugugacgguaagcuggaacucuggcgcccucacuuccgggguucauaccuucccagcggugcugcagucaagcggacuuuacagucugucuuccgucgugacagugcccagcucgucuuugggcacucagaccuauaucuguaaugucaaccacaaaccuuccaauacaaagguugauaaaaagguggagccaaagucaugcgacaaaacccauacguguccgcccugcccugcaccagagcuccugggugggcccaguguauuucuguucccuccaaagcccaaagauacucucaugauuagccgaacaccggaagugaccugugucgugguugacgugucccacgaggauccugaagucaaguuuaacugguacguggacggaguagagguucauaaugccaaaacuaagccccgugaggaacaauauaacucuacauacagaguggucagcguguuaaccguccugcaccaggauuggcuuaauggcaaagaguauaagugcaaggugucaaacaaagccuugccagcuccuaucgaaaagacgauuaguaaagcaaagggccagcccagggagccacagguuuacacccugcccccuucccgggacgaacuaacuaaaaaucaagugagccucacaugucugguaaagggguucuacccaucugauaucgcugucgagugggagucaaacggacagccggaaaauaacuauaagaccacacccccugugcuugacagugacgguagcuuuuuccuguacuccaaauugacuguugauaagucucgcuggcagcaaggcaacguguuuucgugcagcgucaugcacgaggcccuccauaaucacuauacccagaaaucccugucauuaaguccagggaag

SEQ ID NO: 23456 - RNA, 654 nt, Artificial Sequence
  derived and/or modified sequence opt3 from Lintuzumab_LightChain1
gacauccagaugacccaaagccccuccucucugucagccagugugggcgauagagucacaauuacuugcagggcuagcgaguccguugacaacuacgggauaucuuucaugaauugguuucagcagaagccuggaaaagcaccaaagcuccuuaucuaugccgcgucgaaccaggguucaggcgugccgagccgguucaguggguccggaucuggcacggauuuuacccugacaauuagcuccuugcaacccgacgauuucgcuacuuacuauugucagcagucaaaagaaguaccuuggaccuuuggucaggggacaaagguggagaucaaacgcaccgucgccgcaccaaguguguucauuuuucccccuagcgacgaacaauuaaagucuggaacugccuccguugugugccugcuaaauaacuucuacccacgagaggcuaagguccaguggaaaguggauaaugcacuccagucaggcaacagccaggaaaguguaacagagcaagacucuaaggauuccaccuauagccugucgucuacgcuuacucuguccaaagccgacuacgagaagcacaaaguuuaugcuugugaagugacccaucagggcuugucaagucccgucacaaagagcuuuaaucguggggagugc

SEQ ID NO: 23457 - RNA, 1350 nt, Artificial Sequence
  derived and/or modified sequence opt3 from Lirilumab_HeavyChain1
caggugcaacugguccagagcggcgccgagguuaagaaacccggguccucugugaagguaucaugcaaagcuaguggagguaccuucagcuuuuacgcaaucuccugggugagacaggccccuggccaggggcucgaauggaugggaggcuucauuccaauauuuggugcggcuaacuaugcccaaaaguuccaggggagggucacaaucacugcagacgagucuacgucgaccgccuacauggaacuuucaagccugcggagugaugacacagcuguguauuacugugcacgcauuccguccggaucuuauuacuaugauuacgacauggauguuuggggccagggcacuaccgugacagucagcuccgccucaaccaaagggcccaguguguuuccuuuggcuccaugcagccgaucuacuuccgagucaacagccgcguuaggaugucugguaaaggacuacuuccccgaaccuguuaccgugagcuggaauaguggugcacuaacgucuggcguccacacuuuuccagccgugcuccaguccagcgggcuguauucgcuuucuuccguggucaccguucccucaaguagccugggaacaaagacuuauaccugcaacguggaucauaaaccuuccaauacaaagguagacaaacguguggagucuaaguacggcccaccgugucccccuugcccagcucccgaguucuugggugggccuagcgucuuucucuucccacccaaaccgaaggauacccugaugaucucaagaacgccugaagugacuuguguuguggucgacgugagucaagaggaucccgaaguacaguuuaacugguacguugacggaguggagguccacaaugccaagacaaaaccaagggaggaacaguucaacuccaccuaucggguggucagcgugcugacuguucuccaucaggauugguuaaauggcaaggaguacaaaugcaaggugucuaacaaaggccugccuucaaguauugaaaagacaaucagcaaagcaaaggggcaaccccgcgagccacagguauauacccuucccccuucccaggaagagaugacgaagaaucaagucucuuugaccugucuggugaaaggauuuuacccaucggacauagcuguugagugggaaagcaacggucagccggagaauaacuacaagacaacucccccugugcuagacuccgauggcucauucuuccucuauaguagacugaccgucgacaaaucuagguggcaggaagggaauguguuuagcugcuccguaaugcacgaggcccuucauaaccacuacacacagaagucacugagcuugucucucggaaaa

SEQ ID NO: 23458 - RNA, 642 nt, Artificial Sequence
  derived and/or modified sequence opt3 from Lirilumab_LightChain1
gagaucgugcugacccagagccccgucacacucucccuuucuccuggcgaaagagccacucugucaugcagggcuagucaaagcguuuccucuuacuuggcaugguaucagcagaagccagggcaggccccgcgguuacugauuuacgacgcgucgaaccgcgcuacgggaauacccgcccgauucucagguagcggcagugggaccgauuuuacacuaacuaucuccucucucgagccugaagacuucgcaguguauuacugucaacagcguagcaauuggauguauaccuuuggacagggcacaaaacuggagauuaagagaaccguagccgcuccauccguguucaucuuucccccuucagaugaacagcuuaaaagugguacugcaagcgucgugugccuguugaacaauuucuacccaagggaggccaagguucaauggaaaguggacaacgcucuccagucuggaaauucccaggagucagucacagaacaggauagcaaggacaguaccuauucucuguccagcacgcugacucucucgaaggccgauuacgagaaacacaagguguacgcgugugaaguaacccaucaaggguuaucuucccccguuacaaaaucauuuaaccggggcgagugc

SEQ ID NO: 23459 - RNA, 1344 nt, Artificial Sequence
  derived and/or modified sequence opt3 from Lodelcizumab_HeavyChain1
caggugcaacugguccagagcggcgccgagguuaagaaacccggggcuuccgugaagguaucuugcaaagcaucaggauacaccuucaguacaauguauaugagcugggugagacaggccccuggucagggccucgaauggauggggaggaucgacccagcgaacgagcacacuaauuacgcucaaaaguuucagggacgggucacgaugacccgcgauacauccauuucuacugccuauauggaacuuucgcgacugaccucagacgauacagcaguguacuauugugcccguagcuacuauuacuacaacauggacuauuggggccaggguaccuugguuacugugaguuccgcuucuacaaaagggccgagcgucuuccccuuagcaccuuccucaaagaguaccagcggaggcacggccgcucugggcugccuagugaaggauuacuuuccagagcccguaacuguuucuuggaacuccggggcccucaccucaggagugcauacauucccugcgguccugcagagcaguggucuuuauucucuguccagcguggugacugucccaucgucuuccuugggcacccaaacauacauauguaauguuaaucacaaacccucaaacaccaagguggacaaaagaguagaaccuaagaguugcgauaaaacgcauacuuguccaccgugccccgcaccugaggccgcugggggaccaagcguguuucucuuucccccuaagccaaaggacacacugaugaucuccaggacccccgaggucacuugugugguuguggaugucucucacgaagacccggaggugaaauucaauugguauguagauggcguugaagugcauaacgccaagacaaaaccucgggaggagcaguacaauagcaccuaucgcgucgugucaguccugacggugcuccaccaggacugguuaaacgguaaggaauacaaaugcaagguuaguaauaaagcacugcccgcuccaauugagaagaccaucuccaaggccaaagggcagccuagagaaccccaaguguacacacuuccacccagcagggaggaaaugacuaagaaccagguaucuuugaccugucuggucaaaggauucuauccuucagauauugcgguggagugggagaguaauggccagccagaaaacaauuacaagacaacuccgcccguucuagacagcgacggcuccuuuuuccucuauucuaaacugaccguggauaagucgcgguggcaacaggggaacgucuuuagcugcuccgugaugcacgaggcccuucauaaccacuacacacagaagucacugaguuugucuccuggaaaa

SEQ ID NO: 23460 - RNA, 639 nt, Artificial Sequence
  derived and/or modified sequence opt3 from Lodelcizumab_LightChain1
cagaucgugcugacccaaagccccgccacacucuccgucucuccuggcgagagagcuacucuuucaugcagggcaagucagagcguuuccuacaugcacugguaucagcagaagccagggcaagccccgcggcuguugauuuacggaguguuccgccgagcgacggguauacccgaccguuuuucuggcucggggucaggaaccgauuucacauuaacuaucggcagacuggaaccugaggacuuugcuguauauuacugucuacaguggagcagugauccacccaccuucggucaggggacaaaacucgaaauuaagaggaccguggccgcaccuuccgucuuuaucuucccacccucugacgagcagcugaaaagcggaacugccuccgugguuugccuucugaacaauuuuuauccucgggaagcuaaggugcaauggaaagucgauaacgcauugcagucaggcaauagucaggagagcgugacagagcaggacucuaaggauuccaccuacucacucagcaguacgcugacucugucuaaggccgacuaugaaaaacauaagguauacgcuugugagguuacccaccaaggccucuccagcccagugacaaaaucguucaaccgcggggaaugc

SEQ ID NO: 23461 - RNA, 1356 nt, Artificial Sequence
  derived and/or modified sequence opt3 from Lokivetmab_HeavyChain1
gaggugcagcuggucgaaagcggcggggaccucguuaagcccggagguucccuuagacugucuugcguggccucaggcuucaccuuuaguaacuacgggaugagcuggguaaggcaagcuccuggaaaaggcuugcaguggguggcaacaaucuccuauggugggucuuacacuuauuacccagauaauauuaagggacgguucacgauaucgcgcgacaacgccaaaaauaccuuauaucugcagaugaacucacuacgagcggaggauacagcuauguacuauuguguccguggcuacggcuacgacacuauggauuauugggggcagggaacccucgugacaguuagcagugccuccaccacugcaccgucuguguuuccccuggccccuagcugcgguuccacaucaggcaguaccgucgcucuugcaugucuggugagcggguacuucccagaacccguaacgguuucuuggaacuccggaucauugacuagcggcgugcacaccuuuccuaguguccuccaaucuuccggucuguauagccugucgucuauggugacagugccauccucaagauggcccagugagacuuuuaccugcaaugucgcccauccugcuagcaagacaaaaguugacaagccagugccgaagagggaaaaugggcggguaccccgcccuccagauugucccaaaugcccugccccagagaugcucggaggccccuccguguucaucuucccgccuaagcccaaagacaccuuacugauugcgagaacgccagaggucacuugugugguuguggaucuugacccugaagaucccgagguccagaucucuugguuuguggacggcaagcagaugcagacagcaaaaacccaaccaagggaagaacaguucaacgggacuuaccggguaguuagcguguugcccauuggacaccaggauuggcugaaggguaagcaguuuacaugcaaagucaauaacaaggcccuaccuucaccaaucgagcgcaccauaaguaaagcucgaggccaagcccaucagccguccguguauguccugcccccuagcagagaggagcucucuaagaauacggugucacuuaccugucugaucaaagacuucuuuccacccgacauugauguugaauggcagaguaacgggcaacaggagccugaaagcaaguacaggacaacuccaccccaguuggacgaggauggauccuauuuccucuacucuaaacugucgguggacaagagccgguggcagcguggcgauaccuucaucugcgcaguaaugcacgaggcuuuacauaaucacuacacacaagaaucccugucacacaguccgggu

SEQ ID NO: 23462 - RNA, 651 nt, Artificial Sequence
  derived and/or modified sequence opt3 from Lokivetmab_LightChain1
gagaucgugaugacccagagccccgccucccugucucucucacaagaagagaaggucacaauuacuugcaaagcuagucagagcguuuccuucgcaggcacggggcuuaugcacugguaccagcagaagccuggacaagccccaaaacuguugauauauagagcgucuaacuuagaagcuggugugccgucgagguuuucaggcagcgggaguggaaccgacuucuccuuuacaaucucuagccuggagcccgaagauguagccguguacuauugucagcagucccgggaguacccuuggacuuucggccaggguaccaagcuagagauuaaacgcaaugacgcacaaccagccgucuaucucuuucagcccucaccugaucagcugcauacagggagugcuagcgugguuugccuucugaacucuuucuacccaaaggacaucaaugugaaguggaaagucgauggagugauucaggacaccggcauccaagaauccguaacugagcaggauaaggacucaacauauagcuugaguucuacccucacgauguccagcacugaauaccugucgcacgagcuguacucuugugagauaacccauaaaucccuccccucaacauuaaucaagaguuuucagcgaagcgaaugc

SEQ ID NO: 23463 - RNA, 1344 nt, Artificial Sequence
  derived and/or modified sequence opt3 from Lorvotuzumab_mertansine_HeavyChain1
caggugcaacuggucgagagcggcgggggaguugugcagcccgguagaucccucaggcuuucuugcgccgcuucaggcuucaccuuuaguagcuucgggaugcacuggguacggcaggcaccuggaaagggccuggaauggguggccuacaucuccucugguucguuuacaauuuauuacgcggacucagucaaagggcgcuucacuauaagccgagauaacaguaagaauacguuguauuuacagaugaacucccugcgugcugaggacaccgccguguacuauugugcaagaaugaggaaaggauacgccauggauuauuggggccaaggcacucuaguuacagugucuagcgcuuccaccaaggggccaucagucuuuccgcucgcacccaguagcaaaucuacauccggagguaccgccgcucugggcugccuugugaaggacuacuucccugaaccaguaacuguuucauggaauagcggggcccugacaaguggagugcauaccuuucccgcggucuugcagucuuccggccucuacagccugucgucuguggugacggucccuuccucaagucuggguacucagaccuauaucuguaacguuaaucacaagccaagcaacacaaaaguggauaagaaaguagagcccaaguccugcgacaaaacucauaccuguccuccaugcccggcacccgaacucuuagggggaccuucuguguuccuguuuccacccaagccuaaggauacacuuaugauuagccggaccccagaggucacgugugugguuguggacgucucacacgaggaucccgaagugaaauucaauugguacguagacggcguugaggugcauaacgccaagacuaaaccgcgcgaggaacaguauaauaguacauacagagucguguccgucuugaccgugcugcaccaagauuggcuaaacggcaaggaguauaaaugcaagguuagcaauaaagcucucccugcccccaucgaaaagacuauuucuaaggcaaaagggcagccaagggagccucagguguacacacugcccccaucacgggacgaacuuaccaagaaccagguaagucugacguguuuggucaaaggauuuuaucccagcgauaucgcuguggagugggaauccaauggucaaccugagaacaauuacaagaccacaccaccgguucucgacucugacggcucguucuuucuguacagcaaauuaacuguggauaagucccgcuggcagcaggggaacgucuucucaugcagugugaugcacgaggcccugcauaaccacuauacccaaaagucucucagccuuucccccggaaaa

SEQ ID NO: 23464 - RNA, 657 nt, Artificial Sequence
  derived and/or modified sequence opt3 from Lorvotuzumab_mertansine_LightChain1
gacguggucaugacccagagcccccugucccucccuguuacacuuggccaaccagccucuaucucaugcagaaguagccagauuauaauccacuccgaugggaacacuuaccuggagugguuccagcagaggccgggacaaucuccccggcgcuugauuuauaaggugucgaaucgauuuucagguguaccugaccguuucagcggcaguggguccggaacggauuuuaccuuaaaaaucucuagaguggaagcugaggacgucggcguguacuauuguuuccaggguagccauguuccacacacauuugggcagggaacuaagguggaaauuaaaaggaccgucgcagcccccuccguguucaucuuuccuccaucagaugagcagcugaagaguggcacagcgagcguaguuugccuacucaacaauuucuacccccgggaagcuaaagugcaauggaaggucgacaacgcccugcagucuggcaauucccaggagucagugaccgagcaggauagcaaggacaguacuuauucucuuuccagcacacugaccuugucgaaagcagauuacgaaaagcauaaaguguaugccugugaggucacgcaccaagggcucucuuccccuguuacuaagucauuuaaccgcggagaaugc

SEQ ID NO: 23465 - RNA, 336 nt, Artificial Sequence
  derived and/or modified sequence opt3 from Lpathomab_VL
gacguggucaugacccagacaccccugagccucccuguuucccuuggcgaucaagccucuaucucaugcacgagugggcagagccuggugcacauuaacggaaauacuuacuugcauugguauuuacagaagccaggucaguccccgaaacugcuaauauacaagguaucuaaccucuucucgggcgugcccgacagauuuucagggagcggaaguggcaccgauuucacacugaaaaucuccagggucgaggcugaagaccuugguguguauuuuuguucucaaagcacucacuucccuuuuaccuucgggacaggaaccaagcuggagauuaaa

SEQ ID NO: 23466 - RNA, 366 nt, Artificial Sequence
  derived and/or modified sequence opt3 from Lpathomab_gamma1-Chain_VDJ-Region
caggugcaacugcagcagagcggcgccgagcucgucagacccgggaccuccguuaaggugucuugcaaggcuucaggauacgguuucaucaacuaucuuauugaauggauaaaacagaggccuggccaagggcuggaguggaucggauugauuaauccaggcagugacuacacaaacuauaaugaaaacuuuaaagguaaggcaacuuuaacggccgauaaaagcuccucuaccgcguacaugcaccugucgucacuaacaagcgaggacagugcuguauauuucugugcccggcgcuuuggguacuauggauccggcaauuacuucgauuacuggggccaggggacuacccucacagugucuagc

SEQ ID NO: 23467 - RNA, 1350 nt, Artificial Sequence
  derived and/or modified sequence opt3 from Lucatumumab_HeavyChain1
caggugcaacuggucgagagcggcgggggaguugugcagcccgguagaucccucaggcuuucuugcgccgcuucaggcuucaccuuuaguagcuacgggaugcacuggguacggcaggcaccuggaaagggccuggaauggguggccgucaucuccuaugaggaaucuaaccgcuaccaugcggacucggugaaaggucgauucacaauuucacgugauaauagcaagauaacuuuguauuuacagaugaacagucugagaacggaggacaccgcuguuuacuauugugccagggaugggggaaucgcagccccaggcccggacuacuggggccaagggacucuagugacagucuccucugcuagcaccaaaggacccuccguguuuccucucgcaccagccucaaagaguacaagcgguggcaccgcugcccuggggugccuuguaaaagauuauuuccccgaaccuguuacugugucuuggaacuccggagcgcugacaucaggcguccacaccuuuccagcaguguugcagagcaguggucucuacucucuguccagcguggucacgguucccucgucuucccuggggacucagaccuacauuuguaaugugaaucauaagccuucaaacacaaagguagacaaacggguggagccaaagaguugcgauaaaacucacaccuguccgcccugcccugccccagagcucuuaggaggccccagcgucuuccuguuuccuccaaagcccaaagacacacuuaugaucucccgcaccccggaagugacguguguuguggucgaugugucucaugaggacccugaaguaaaguucaauugguauguugauggcguggagguccacaacgcuaagacuaaacccagagaggaacaguacaauagcacauauaggguggucucaguguugaccguucugcaccaagacuggcuaaacgggaaggaguacaaaugcaaggugaguaauaaagcccucccagcaccuauugaaaagacuaucuccaaagcuaagggacagccccgggagccacagguauauacacugcccccuagccgcgaagagaugaccaagaaccaggucucucuuacgugucuggugaaagguuuuuacccaucagauauagccguugagugggaaaguaauggccaaccggagaacaauuauaagaccacacccccuguguuggacagcgacggguccuucuuucucuacucuaaacugacugucgauaagucgcgauggcagcagggaaacguguucagcugcuccguaaugcaugaagcguuacacaaccauuacacccaaaaaucacugagucucucuccaggcaag

SEQ ID NO: 23468 - RNA, 657 nt, Artificial Sequence
  derived and/or modified sequence opt3 from Lucatumumab_LightChain1
gacaucgugaugacccagagcccccugucccucacagucacuccuggcgagccagccucuauuucaugcagaaguagccaaucccuucuguacucuaacggguauaauuacuuggauugguauuuacagaagccgggacagucgccccagguucugauaucacuagguagcaacagggcuaguggcgugccugaccgguucuccgggucuggaagcggcacggauuuuacccucaaaaucucccgcguagaagcagaggacgugggugucuacuauuguaugcaagcccgacagacaccauucacuuuugggcccggaaccaagguggauauucguagaacaguugcggcuccuucaguguucaucuuuccacccagugacgaacagcugaaaagcggcaccgccucugucgugugccuucugaauaacuucuacccuagggaggcaaagguacaguggaaaguugauaaugccuugcaauccggcaacucacaggaaagcgugacugagcaggacaguaaggauucuacauauucccucagcucgacccugacgcugucuaaggcugacuacgagaaacacaaggucuacgcaugugaagugacucaucaggggcucuccucaccagugaccaaaaguuuuaaucggggagagugc

SEQ ID NO: 23469 - RNA, 324 nt, Artificial Sequence
  derived and/or modified sequence opt3 from Lulizumab_pegol_LightChain1
gacauccagaugacccaaagccccuccucucugucagccagugugggcgauagagucacaauuacuugcagggcuagccggccuauauggccauuccucgagugguaccagcagaagccggggaaagcacccaaacuucugaucuauuuuacgucccgcuugcgacacggaguuccuucucguuucucggguucaggcagcgggaccuguuuuacauuaacuauuaguucccugcagccagaagacuucgccaccuacuauugccuacaaaacguggcgaaucccgcuacauuuucucagggaaccaagguagagaucaagaga

SEQ ID NO: 23470 - RNA, 324 nt, Artificial Sequence; identical to SEQ ID NO: 23469
  derived and/or modified sequence opt3 from Lulizumab_pegol_LightChain

SEQ ID NO: 23471 - RNA, 1194 nt, Artificial Sequence
  derived and/or modified sequence opt3 from Lumiliximab_HeavyChain1
gaggugcagcuggucgaaagcggcgggggacucgccaagcccgguggcucccuuagacugucuugcgcugcaucaggguucagguuuaccuucaacaauuacuauauggacuggguucggcaagccccuggacagggcuuggaguggguguuaacaacugguagugauagcugggggcagggaguacuggugacggucuccucugcgucgaccaaaggcccaucaguguuuccgcuagcucccagcaguaaguccacaucuggcgggacugccgcacucggaugucugguuaaagacuacuucccugaaccagugaccgucagcuggaacuccggugcccuuacaucaggcgugcacaccuuucccgcuguacugcagaguagcggguuguauucucucuccucaguugugacugucccuagcaguucucugggaacacaaaccuacaucugcaaugugaaccauaagccauccaauacgaaaguggauaagaaggucgagcccaaaagcugugacaagacucauaccugcccuccauguccggcacccgaacugcucggcgguccuucgguuuucuuauuuccacccaaaccuaaggauacacugaugauuucucgcacuccagaggugaccugcguaguggucgacgugucccacgaggaucccgaaguuaaauucaacugguauguggacggggucgaggugcacaaugccaagacaaagccgcgagaagaacaguacaacucaaccuaucguguaguuagugugcuuacggucuugcaucaggauuggcugaauggaaaagaguacaaguguaaagugagcaacaaggcucuaccugcccccauagagaaaacuaucuccaaggcgaaaggccagccaagagagccucaagucuacacacugcccccaucuagggacgaacucaccaagaaucaggugagccuuacuugccugguuaagggcuuuuaucccucagauauugcaguggagugggaaaguaacgggcagccugagaauaacuacaaaacaaccccaccgguauuggacuccgaugguagcuucuuucucuauucuaagcugacggucgacaaaucacgguggcagcaaggaaauguguucaguuguagcguuaugcacgaggccuuacacaaccauuacacccagaagucccugucucucucgcccggcaaa

SEQ ID NO: 23472 - RNA, 642 nt, Artificial Sequence
  derived and/or modified sequence opt3 from Lumiliximab_LightChain1
gacauccagaugacccaaagccccuccucucugucagccagugugggcgauagagucacaauuacuugcagggcuagccaggacauacgguacuaucucaacugguaccagcagaagccugggaaagcaccaaaacuucugaucuauguugccuccucuuugcaaucgggagugccgucacgcuucagcgguaguggcuccgggacggaguuuaccuuaacaguaucuagccugcagcccgaagauuucgcgacuuacuauugucuacagguguacuccaccccucgaacauuuggacagggcaccaaggucgagauuaagcguacuguggcugccccaucaguuuucaucuuucccccuagugacgaacaacucaaaagcgguacagcaucuguggucugccugcuuaauaacuucuauccaagagaggccaaggugcaguggaagguagauaaugcucugcaguccgggaacucacaggaaagcguuaccgagcaagacaguaaagauucuacguacuccuugagcucgacucucacccugucuaaggcagacuacgagaaacacaagguguaugccugugaagucacacaucagggacuguccucacccgugacuaaaaguuuuaauaggggcgagugc

SEQ ID NO: 23473 - RNA, 1347 nt, Artificial Sequence
  derived and/or modified sequence opt3 from Lumretuzumab_HeavyChain1
caggugcaacugguccagagcggcgccgagguuaagaaacccggggcuuccgugaagguaucuugcaaagcaucaggauacaccuucagaaguagcuauaucuccugggugaggcaggccccuggucagggccucgaauggaugggguggauuuacgcgggaacaggcucuccaucguauaaccaaaaacuucagggucgggucacuaugacgaccgacacaucaacuagcaccgcuuacauggagcugcgcaguuugcgauccgaugacacagccguguauuacugugcacgucacagagauuauuacucuaauagcuuaaccuacugggggcagggaacucugguuacaguguccucagccaguaccaagggcccgagcgucuuuccccuagcuccuucuuccaagucaacgagcggcgggacugcagcccucggaugccuggugaaggacuauuucccagaacccguaaccguuaguuggaacucuggugcucuuacauccggcgugcauacuuuuccugccguccugcagagcucgggguuguacucucucuccucaguggugaccgucccaaguagcucccugggaacacaaaccuauauauguaauguuaaccacaaacccucuaauacgaagguggauaaaaagguagagccuaaaagcugcgacaagacucauacauguccaccgugccccgcgccugaacugcucggcgguccaucaguguucuuauuucccccuaagccaaaagauacccugaugaucaguaggacucccgaggucacaugugugguuguggacgucucccacgaggauccggaagugaaguucaacugguacguagacgggguugaggugcauaaugcaaaaaccaagccucgggaggaacaguauaacagcacguaccgcgucgugucuguccuuaccguguugcaccaggauuggcugaauggaaaagaguauaagugcaaaguuucaaacaaggcccuacccgcuccaauugaaaagacaaucaguaaagccaagggccagccuagagagccccaaguguacacucucccacccagcagggacgaacugaccaaaaaucagguaucccuuacaugucuggucaagggcuuuuacccuucugauauugcaguggagugggaaucgaacgggcagccagagaauaacuauaaaacuaccccgcccguuuuggacagcgacggauccuucuuucucuacucaaagcugacaguggauaagagucgguggcaacaggguaaugucuucucuugcagcgugaugcacgaggcuuuacauaaccacuauacccagaaaucccugucacucagcccuggc

SEQ ID NO: 23474 - RNA, 660 nt, Artificial Sequence
  derived and/or modified sequence opt3 from Lumretuzumab_LightChain1
gacaucgugaugacccagagccccgauucccuggccgucucucucggcgagagagcuacaauuaacugcaagucaagucaaagcguucuuaauuccgggaaccagaaaaauuaccugacuugguaucagcagaagccuggacaaccaccgaaauuguuaauauacugggcaucuacgagggaaucgggugugcccgaccgguucucaggcagcgggaguggaaccgauuuuacacugacuaucuccucucuacaggccgaggacguagcgguguauuacugucagagcgauuauuccuacccuuauaccuucggccaggguacaaagcucgaaauuaaacgcaccgucgcugccccaucaguguuuaucuuucccccuagugacgagcaacuuaagagcgggacugcaucuguugugugccugcugaacaauuucuacccacgagaagccaagguccaguggaaaguggauaacgcuuugcaguccggaaauucacaggagagcguaacagagcaagacaguaaggauucuaccuacucccucagcucgacgcugacucugucuaaagcagacuaugaaaagcacaaaguuuacgccugugaggugacccaucagggccucuccucacccgucacaaagaguuucaaccguggcgaaugc

SEQ ID NO: 23475 - RNA, 1329 nt, Artificial Sequence; identical to SEQ ID NO: 23001
  derived and/or modified sequence opt3 from Lutetium_(177Lu)_lilotomab_satetraxetan_HeavyChain1

SEQ ID NO: 23476 - RNA, 642 nt, Artificial Sequence; identical to SEQ ID NO: 23002
  derived and/or modified sequence opt3 from Lutetium_(177Lu)_lilotomab_satetraxetan_LightChain1

SEQ ID NO: 23477 - RNA, 1350 nt, Artificial Sequence
  derived and/or modified sequence opt3 from Margetuximab_HeavyChain1
caggugcaacugcagcagagcggccccgagcucgucaagccuggggccucccuuaaacugucuugcaccgcuucaggauucaacaucaaggacacauacauucacuggguuaaacagagaccagaacaagguuuggaguggauaggcaggaucuauccgacuaauggguacacgcgguaugaucccaaguuucaggacaaagcaaccauuacagccgauacuucgagcaacaccgcguacuuacaggugucccgccugacaucugaagacaccgcuguauauuacuguucgcgauggggaggcgaugguuucuaugccauggacuacugggggcagggagcaucagugacugucagcagugccuccacaaagggcccuucuguguuuccacuagcucccagcuccaagucaaccaguggcgggacggcagcccucggaugccugguuaaagauuacuucccugagccagugacugucagcuggaacucuggugcucuuaccuccggcgugcauacauuucccgccguacugcaaucaagcggguuguauagucucucuuccguugugacugucccuagcucgucucugggaacccagacauacaucuguaaugugaaucacaagccauccaacaccaaaguggacaagcgugucgaaccgaaaucaugcgauaagacgcauacuugucccccuugcccagcgcccgagcugguuggcgguccuaguguguuccucuuaccacccaagccgaaagacacacugaugauuagcagaaccccugagguaacuuguguggucguggauguuucccacgaagaccccgaggugaaguuuaauugguaugucgaugggguggaaguacauaacgcaaaaacaaagccaccugaggagcaguacaauucuacccuuaggguugugagcgucuugacggugcugcaccaggacuggcuaaacggaaaagaauauaagugcaaagucucaaauaaggcccuccccgcuccaaucgagaagaccauaaguaaagccaagggccaaccccgggaaccucagguguacacacugccaccgucccgcgacgagcuuacuaaaaaccagguuagccugaccuguuuggugaagggcuucuaucccucugauaucgcaguagaaugggagucaaaugggcaaccugagaacaauuacaaaacaacuccacucguccuggacagugaugguagcuuuuucuuauacuccaagcugaccguggacaagucuagauggcagcagggaaacguuuuuaguugcagcgugaugcacgaagcucuccauaaccacuauacacagaaaucccuuucacugagucccggcaag

SEQ ID NO: 23478 - RNA, 642 nt, Artificial Sequence
  derived and/or modified sequence opt3 from Margetuximab_LightChain1
gacaucgugaugacccagagccacaaguucauguccacaucugucggcgauagaguuucaauuacuugcaaagccagucaagacgugaacacggcuguagcaugguaccagcagaagcccgggcauagcccuaaacugcucauauauuccgccucuuuuagguacaccggagugccagaucgguucacagguucgcgcucaggcacugacuuuaccuucacaaucagcaguguccaggcggaggaucuugcuguguauuacugucaacagcacuauaccacuccgcccacauuugggggaggcaccaagguugaaauuaaacgaacgguggccgcaccuuccgucuucaucuuuccacccucugacgagcagcugaaaagcgguacugccuccgugguaugcuuguuaaauaacuucuacccucgugaagcuaagguucaguggaagguggauaaugcacugcaaucagggaacagucaggagagcgucaccgaacaggacucuaaggauuccacauauucacuaagcaguacucucacccugucuaaagccgacuacgagaagcauaaaguguacgcuugugaggugacacaccagggacuuuccagcccagucaccaagucguuuaauagaggcgaaugc

SEQ ID NO: 23479 - RNA, 762 nt, Artificial Sequence
  derived and/or modified sequence opt3 from Marzeptacog_alfa_HeavyChain1
aucgugggcgggaaggucugccccaagggagaguguccuuggcagguucugcuccuugugaacggugcccaacugugcggcgggaccuugauuaauacaauauggguagugagcgcugcacacuguuucgacaagaucaaaaacuggagaaauuuaauugccguccugggagaacaugaucuauccgagcacgacggcgaugaacagucuaggcggguggcgcagguuaucauuccaucaacuuacgugccggguacgaccaaccaugacaucgcucuccugcgccuucaccagcccgucgugcugacagaucauguaguuccuuugugccucccagagcgaacuuuuagugaacguacccuggccuucgugagauuuagccuggucuccggguggggaaggcucuuagaccggggcgcaacagcccuggagcuucaaguguugaaugugccccgccugaugacccaggauugucuacagcagucuagaaaggucggcgacucgccuaacauaacugaguauauguucugcgcuggguacucagauggaagcaaagacaguuguaagggugauuccggcgggccacacgcaacacacuauaggggaaccugguaccucacgggcaucguuucuuggggucaagggugcgccacugugggacauuuuggcguauauacccgggugagccaguacauugaauggcugcagaaacuuaugcgcuccgagccccgaccuggcguccuguugagagcuccauucccg

SEQ ID NO: 23480 - RNA, 456 nt, Artificial Sequence
  derived and/or modified sequence opt3 from Marzeptacog_alfa_LightChain1
gccaacgcuuuccuggaggaacucagacccggcagccuugagagggaaugcaaggaggaacaguguuccuuugaggaggcacgggaaaucuucaaagacgccgagcgcaccaagcuguuuuggauuucuuacucagauggggaccaaugcgcgaguagcccuugucagaauggagguuccugcaaagaucaguugcagucuuauauauguuucugcuuaccagcuuuugaaggccgaaacugugagacacacaaggacgaucaacugaucugcgugaaugagaacgggggaugugaacaguacugcucggaccauacuggcacgaaacguucauguagaugccacgaggguuauagccuacucgccgauggggucaguugcaaugcaaccguugaauacccguguggaaagauucccauccuggagaagaggaacgccuccaaaccucagggccgg

SEQ ID NO: 23481 - RNA, 669 nt, Artificial Sequence
  derived and/or modified sequence opt3 from Matuzumab_HeavyChain1_variant_3c08_H
caggugcaacugguccagagcggcgccgagguuaagaaacccggggcuuccgugaagguaucuugcaaagcaucaggauacaccuucacaagucacuggaugcauugggugagacaggccccuggucagggccucgaauggaucggggaguuuaacccaagcaauggaaggacuaacuauaaugaaaaguucaaauccaaggcgacgaugaccgucgacacaucuacuaacaccgcuuacauggagcuuucgucacugcggagcgaagauacagccguguauuacugugcaagucgcgacuaugauuacgacggccgauauuuugauuacuggggucaagggaccuugguuacuguguccucugccagcacaaagggaccguccgucuuccccuuagcuccuucaaguaaaagcaccucuggcggcacggcagcccuggggugccuagugaaggacuacuuuccagagcccguaacuguuuccuggaacucaggagcucucaccagcggugugcacacauucccugccguccugcagaguucuggccuuuauucccugagcucgguggugacugucccaucuuccucauuggggacccagacauacauuuguaauguuaaucauaaacccaguaacaccaagguggauaaaaagguagagccuaagagc

SEQ ID NO: 23482 - RNA, 669 nt, Artificial Sequence
  derived and/or modified sequence opt3 from Matuzumab_HeavyChain1_variant_3c09_C
caggugcaacugguccagagcggcgccgagguuaagaaacccggggcuuccgugaagguaucuugcaaagcaucaggauacaccuucacaagucacuggaugcauugggugagacaggccccuggucagggccucgaauggaucggggaguuuaacccaagcaauggaaggacuaacuauaaugaaaaguucaaauccaaggcgacgaugaccgucgacacaucuacuaacaccgcuuacauggagcuuucgucacugcggagcgaagauacagccguguauuacugugcaagucgcgacuaugauuacgccggccgauauuuugacuacuggggucaagggaccuugguuacuguguccucugcuagcacaaagggaccguccgucuuccccuuagcaccuucaaguaaaagcaccucuggcggcacggccgcucuggggugccuagugaaggauuacuuuccagagcccguaacuguuuccuggaacucaggagcccucaccagcggugugcacacauucccugcgguccugcagaguucuggccuuuauucccugagcucgguggugacugucccaucuuccucauuggggacccagacauacauuuguaauguuaaucauaaacccaguaacaccaagguggacaaaaagguagagccuaagagc

SEQ ID NO: 23483 - RNA, 636 nt, Artificial Sequence
  derived and/or modified sequence opt3 from Matuzumab_LightChain1_variant_3c08_L
gacauccagaugacccaaagccccuccucucugucagccagugugggcgauagagucacaauuacuugcagcgcuuccucuucgguuacguacauguauugguaccagcagaagccugggaaagcaccaaagcuccuuauauaugacaccucaaaccuggccagcggagugccgaguagguucuccgguucuggcagcgggacagauuacacuuuuaccaucuccucauugcagcccgaggacauugcgacauauuacugucaacaguggaguagccacaucuucaccuuuggacagggcacuaaaguagaaauuaagcggacaguggcugccccuucugucuucaucuuuccacccuccgaugagcaguuaaaaucagguaccgcaagcgugguuugccugcuaaauaacuucuauccucgcgaagccaaggugcaauggaaggucgacaaugcucuccagagugggaacucucaggaguccgugacggaacaggauagcaaagacucgacuuacucucuguccucaacccuuacacugaguaaggcagauuacgagaaacauaagguauaugccugugagguuacucaccaaggauugagcuccccagugaccaaaucuuuuaaucgaggcgaa

SEQ ID NO: 23484 - RNA, 636 nt, Artificial Sequence; identical to SEQ ID NO: 23483
  derived and/or modified sequence opt3 from Matuzumab_LightChain1_variant_3c09_B

SEQ ID NO: 23485 - RNA, 1341 nt, Artificial Sequence
  derived and/or modified sequence opt3 from Mavrilimumab_HeavyChain1
caggugcaacugguccagagcggcgccgagguuaagaaacccggggcuuccgugaagguaucuugcaaagugucaggauacacccucacagaacuuaguauccacugggucagacaggcaccugguaagggccuggaguggaugggaggguucgacccagaagagaacgaaauuguguaugcccagagguuucaaggccggguuacuaugacggaggauaccagcacagacacugcguacauggaguuguccucuuuacgcucggaagauaccgcuguguauuacugugccauagucgguucauucagcccgcugacacuagggcucuggggacagggcaccauggugacuguaaguuccgcaucuacaaaaggccccagcguuuuuccucuggccccaugcucccgaucaaccagugagagcacggcugcacuugggugucuggugaaggacuauuuccccgaaccugucacugugucuuggaauagcggagccuugaccucaggugugcauacauuuccagcuguccuccagagcaguggccuguacucucuguccagcguugugacuguacccucgucuucccucgggaccaagacauauaccugcaacguggaucacaaaccuucaaauacgaaggucgacaaacguguggagaguaaguacggaccaccgugucccagcugcccugccccagaguucuuaggcggucccuccguuuuucuguucccuccaaaacccaaggauacucuuaugaucucuagaacaccggaagugaccugugucgugguagacguuagccaggaggauccugaagugcaauuuaacugguacgucgacgggguggagguccauaaugcgaagacuaaacccagggaggaacaguucaacucaacauaucgggugguuaguguguugaccguacugcaccaggauuggcuaaauggaaaggaguacaaaugcaaggucuccaacaaaggccucccaagcucuauugaaaagacgaucucaaaagcaaagggccagccucgcgagccccaaguguauacccugccacccagucaggaagagaugacaaagaaucagguuagccuuacuugucuggugaaaggguuuuacccuuccgacauugccgucgaaugggagucuaacggacaaccagagaauaacuauaagaccacaccgcccguguuggauucggacgguagcuucuuucucuacuccagacugacuguagacaaaucaagguggcaggaaggcaauguguucaguugcucuguuaugcaugaggcuuuacacaaccacuauacccagaagucccugucccucucacuugggaaa

SEQ ID NO: 23486 - RNA, 651 nt, Artificial Sequence
  derived and/or modified sequence opt3 from Mavrilimumab_LightChain1
cagagcgugcugacccaacccccuuccgucucuggcgccccagggcagagaguuacaaucucaugcacuggaagugguagcaacauuggcgcuccguacgacguguccugguaucagcagcuccccgggacggcaccuaaacuucugauauaccacaauaacaagaggccaucuggaguacccgaucgguucucgggcucaaagagcgguaccagugccuccuuggcgaucacaggguuacaagcugaggacgaagccgauuauuacugugcaacuguggaggccggacugucuggcagcgucuuuggcgggggaaccaaacuaacagugcucggucagccuaaggcugcaccauccguuacccuguuucccccuucaagugaggaacuucaggccaauaaagcuacucuggugugcuugauuagcgacuucuauccaggcgccgucacaguggcguggaaggcagauucuuccccgguaaaggccgggguugaaaccacgacucccucaaaacagagcaacaauaaguacgcugccaguucuuaucucucccugaccccugagcaauggaaaagccaucgcucguacucuugucaggugacacacgagggauccacugucgaaaagaccguggcaccaacagagugcuca

SEQ ID NO: 23487 - RNA, 1359 nt, Artificial Sequence
  derived and/or modified sequence opt3 from MDX-1303_HeavyChain1
caggugcaacuggucgagagcggcgggggaguugugcagcccgguagaucccucaggcuuucuugcgccgcuucaggcuucaccuuuaguuacuaugggaugcacuggguacggcaggcaccuggaaagggccuggaauggguggccgucaucuggcaugacgagagcauuguguacuaugcggauuccguuaaaggucgcuucacaauaucucgagacaacucgaagaauacuuuguacuuacagaugaacucacugcgugcugaagauacggccguguauuacuguaccagagacccaggggauccguauuacuacuauuacggacuagacgucuggggccaaggcacaacugugaccguaagcagugcauccacaaaagggcccucuguuuuuccucucgccccaagcuccaagucaaccaguggagguacugcugcacugggcugccuugugaaagauuauuuccccgagccugucacagugagcuggaacucuggggcccugaccuccggagugcacacguuuccagcugucuugcagucaagcggccucuacagucugucuuccguugugacuguacccagcucgucucuggguacccagacauauaucuguaaugugaaucauaagccuuccaacacuaaggucgacaaaaggguggaaccaaagucaugcgauaaaacccacacauguccgcccugcccugccccagagcucuuagggggacccaguguuuuccuguuuccuccaaagcccaaagacacccuuaugauuagccggacgccggaggugacuugugucgugguagauguuucccaugaagacccugaggugaaguucaauugguacgucgauggcguggaaguccacaacgcgaagacaaaaccccgcgaggagcaguauaauucuaccuacagagugguuagcguguugacuguacugcaccaagacuggcuaaacggcaaggaauacaaaugcaaggucucaaauaaagcacucccagccccuaucgagaagacaauuaguaaagcuaaggggcagcccagggaaccacagguguauacccugcccccuucccgggaggaaaugacgaagaaccagguuagccuuaccugucuggugaaaggauuuuacccaucugacaucgccgucgagugggagucaaauggucaaccggaaaacaauuauaagacaacucccccuguguuggauagugacggcagcuucuuucucuacuccaaacugaccguagauaagucucgcuggcagcaggggaacguguucucgugcagcguuaugcaugaggcauuacacaaccauuauacacaaaaaucccugucacucaguccaggaaag

SEQ ID NO: 23488 - RNA, 645 nt, Artificial Sequence
  derived and/or modified sequence opt3 from MDX-1303_LightChain1
gagaucgugcugacccagagccccggcacacucucccuuucuccuggggaaagagccacucugucaugcagggcuagucaaagcgucuccucuucguacuuggcaugguaucagcagaaaccaggacaggccccgcgguuacugauuuacggugcgucaagccgcgcuacgggcauacccgaccgauucaguggguccggaucuggcaccgauuuuacacuaacuaucagccgucucgagccugaagacuucgccguuuauuacugucaacaguaugguuccucaauguacaccuuugggcagggaacaaaacuggagauuaagagaaccguggcagccccaaguguauucaucuuucccccuagcgaugaacagcuuaaaucuggcacugcuuccguggucugccuguugaacaauuucuauccaagggaggcaaaggugcaauggaaaguugacaacgcccuccagucaggcaauagccaggagagugugacagaacaggauucuaaggacuccaccuacagccugucgucuacgcugacucucuccaaggcugauuacgagaaacacaaggucuaugccugugaagugacccaucaaggguuaucaagucccguaacaaagagcuuuaaccggggagagugc

SEQ ID NO: 23489 - RNA, 1347 nt, Artificial Sequence
  derived and/or modified sequence opt3 from Mepolizumab_HeavyChain1
caggugacccugagagagagcggccccgcccucgucaagccuacacaaacucuuacgcugaccugcacaguuuccggguucucuuugacuucauacagugugcacuggguaaggcagccaccgggaaaagguuuagaauggcugggcgugaucugggcuagcgggggaaccgacuauaacuccgcacuaaugucucggcucucgauuucaaaggauacaagccgcaaucaggucgugcugaccaugacuaacauggaccccguugauacagccaccuacuauugugcgcgagacccuccaaguucccuucugcguuuggauuacuggggcagagguacgcccgugacugucucuagcgcuuccaccaaagggccuucaguguuuccacucgcccccaguagcaagucuacauccggaggcacugcagcccugggcugccugguaaaagacuauuucccugagccaguuaccgugucauggaauagcggggcucucacaaguggaguccauaccuuuccggcaguguuacagucuuccggucuguacagccuuucgucuguggucacgguucccuccucaaguuugggcacucaaacauauauauguaacgugaaucacaagccuagcaacaccaagguagauaaaaggguggaaccaaaguccugcgacaaaacucauacaugucccccuugcccagcccccgagcugcuagggggaccgucugucuuccucuuuccucccaagccaaaagauacccugaugaucagccggacgccugaagugaccuguguuguggucgacgugucacacgaggaucccgagguaaaguucaauugguacguugacggcguggaaguccauaacgcuaagacaaaaccacgcgaggaacaguacaauaguacuuauagaguggucuccgugcuuaccguucugcaccaggauugguugaacgguaaggaguacaaaugcaaggugagcaauaaagcccuccccgcgccuauugagaagacaaucucuaaagcaaaggggcagccaagggaaccgcaaguauauacucugcccccuucacgggaggaaaugaccaagaaccaggucaguuuaacaugucuggugaaaggauuuuacccaagcgacauugccguugagugggaauccaauggccagcccgagaacaauuauaagaccacuccuccagugcucgacucugauggcucguucuuucuuuacagcaaacugacggucgacaagucccgcuggcagcaagggaacguguucucaugcaguguaaugcacgaggcuuugcauaaccacuauacacagaaaucucuaagccugucccccggaaag

SEQ ID NO: 23490 - RNA, 660 nt, Artificial Sequence
  derived and/or modified sequence opt3 from Mepolizumab_LightChain1
gacaucgugaugacccagagccccgauucccuggccgucucucucggcgagagagcuacaauuaacugcaagucaagucaaagccuucugaacuccgggaaucagaaaaauuacuuggcaugguaucagcagaagccuggacaaccaccgaaauuacugauauacggugccucuacuagggaaucgggcguucccgaccgguucucagggagcggaaguggcacggauuuuacccuaacaaucuccucucuccaggcggaggacguggcuguauauuacugucagaacgugcacagcuucccuuuuacuuucggugggggaaccaagcuggaaauuaaacgcacagucgccgcaccauccguguuuaucuuucccccuucagaugagcagcuuaagaguggcaccgccagcguugugugccuguugaauaacuucuauccacgagaagcuaagguccaauggaaaguggacaaugcacuccagucuggcaacucccaggagucaguaacugagcaggauagcaaggacaguacauacucucuguccagcacccugacgcucucgaaagccgauuaugaaaagcauaaaguuuacgcuugugaggugacucaccaaggguuaucuucccccgucaccaagucauucaaucguggagaaugc

SEQ ID NO: 23491 - RNA, 1350 nt, Artificial Sequence
  derived and/or modified sequence opt3 from Metelimumab_HeavyChain1
gaggugcagcuggucgaaagcggcgggggaguugugcaacccgguagaucccucaggcuuucuugcgccgcuucaggcuucaccuuuaguagcuacgggaugcacuggguacggcaggcaccuggaaaggagcuggaauggguggccgucaucuccuaugacggcucuauuaaauacuaugcggauucggugaagggucgcuucacaauaucacgagacaacagcaaaaauacuuuguacuuacagaugaacagucugcgugcugaggauacggccguuuauuacugugcaagaaccggggaauauuccggauacgacacagauccacaguacucuuggggccaaggcacuaccgugacagucagcuccgccucaaccaaggggccgaguguguuuccccuagcuccuugcagcaggucuacuuccgagucaacagcagcccucggaugucugguaaaagacuauuucccagagcccguuaccgugagcuggaauaguggugcucuuacgucuggcguccauacuuuuccugccgugcugcaguccagcggguuguacucgcucucuuccguggucaccguuccaucaaguagccugggaacaaagacuuauaccugcaacguggaucacaagcccuccaauacaaaaguagacaagcggguggaaucuaaauacggcccuccauguccgagcugccccgcgccugaguuccugggugggccaucagucuuucucuuucccccuaagccaaaacccaccuuaaugaucagucgcacgccggaagugacuuguguuguggucgaugugucccaggaggacccugagguacaguucaacugguauguugauggaguggaaguccauaaugcaaagacaaagcccagagaggaacaauucaacagcaccuacaggguggucucugugcugacuguucuucaccaggacugguugaauggcaaagaguauaagugcaaagugucaaacaagggccugccaaguagcauugagaaaacaaucuccaaggccaaagggcagccucgggaaccccagguauacacccuaccacccucucaagaggaaaugacgaagaaucaggucucgcucaccugucuggugaagggauuuuacccuagcgauauugcuguugagugggaauccaacggucagccagagaauaacuauaaaacaacuccgcccgugcuugacucagacggcaguuucuuucuguacucucgcuugaccgucgauaagagccgauggcaagaagggaauguguucuccugcucaguaaugcaugaggcccuccacaaccacuauacacagaaaagccugucuuuaucccugggaaag

SEQ ID NO: 23492 - RNA, 639 nt, Artificial Sequence
  derived and/or modified sequence opt3 from Metelimumab_LightChain1
gagaucgugcugacccagagccccuccucucucucagccagugucggcgacagaguuacaauuacuugcagggcuagccaagggauaggagaugaccuugguugguaccagcagaagccuggcaaagcaccaauccuguugauuuaugggacguccaccuuacagucuggagugccgucgcgguucucaggcagcgguagugggacagauuuuacucugaccaucaacucccuacaacccgaagacuucgccacauacuauugucuccaggauucuaauuacccucugaccuuuggaggcggcacucgccuugagauuaagcgaacaguagcggcuccaagcguguucaucuuucccccuuccgacgaacagcugaaaucagggaccgccagugucgugugcuugcucaacaauuucuauccacgugaggcaaagguucaguggaaaguggauaacgcccugcaaagcggaaauucucaggaauccgucacggagcaggacucaaaggauagcacuuacagucugucuuccacccucacauuaagcaaggcugacuaugagaaacacaagguguacgcaugugaaguaacucaucagggucugucgcccguuaccaaaucuuuuaacagaggcgagugc

SEQ ID NO: 23493 - RNA, 1350 nt, Artificial Sequence
  derived and/or modified sequence opt3 from Milatuzumab_HeavyChain1
caggugcaacugcagcagagcggcuccgagcucaagaaacccggggccucugucaagguuucaugcaaagcuaguggauacaccuucacaaacuauggugugaauuggaucaagcaggcaccuggccaagggcuucaguggaugggauggauuaacccaaauacuggcgaaccgacguuugacgaugacuucaaagguagauuugccuucagccuggauaccuccguaucuacagcguacuugcagauaucgucauuaaaggcugacgauacugccguguauuuuuguagcaggagucgggggaagaacgaggcaugguucgccuacuggggacagggcacccuggucacaguguccucugcuagcaccaaaggccccuccguuuuuccucuagcaccaucaaguaagagcacuucugggggaacagccgcucucgguugccuggugaaagacuauuuccccgaaccugucaccguguccuggaacucaggcgcccuuacgagcgggguacacacuuuuccagcgguucugcaaaguucuggauuguacucccucagcucgguggucaccgugcccucuuccucacugggcacacagacuuauaucuguaaugugaaucauaagccuaguaacaccaaagucgauaagcgcguugagccaaagagcugcgacaaaacacacaccuguccgcccugcccugcaccagaacugcucggugggcccuccguguucuuauuuccuccaaagcccaaagauacgcugaugauuucucgaacuccggagguaacauguguggucguggacguuagccaugaggauccugaagugaaguucaauugguacgucgacggaguggagguacacaacgccaaaaccaagccccgugaggaacaguacaauucaacuuauagaguugugaguguccuuacaguguugcaucaggauuggcugaacggcaaagaguacaagugcaaggucuccaauaaagcucuaccagccccuaucgaaaagaccauuagcaaagcaaagggccaacccagggagccacagguguauacgcugcccccuucucgggaagagaugaccaaaaaccagguuucacucacaugucuugugaagggguuuuacccaagugacaucgcuguagaaugggagagcaauggacaaccggagaacaacuauaagacuacacccccuguccuggacuccgaugguucuuucuucuuguacucgaaacucaccguggacaagagccgcuggcagcagggcaauguguuuuccugcucaguuaugcacgaagcccugcacaaccauuauacucagaaaaguuuaucucugagcccagggaag

SEQ ID NO: 23494 - RNA, 657 nt, Artificial Sequence
  derived and/or modified sequence opt3 from Milatuzumab_LightChain1
gacauccagcugacccaaagcccccucucccuuccugugacacugggccagccagccucuauuucaugcagaaguagccaguccuugguccacaggaacgggaauacuuacuuacauugguuccagcaacggccgggacagucuccccgccugcuaauauauacgguuucgaaccgauuuucaggugugccugaucguuucagcggcaguggguccggaaccgacuuuacacucaagaucucuagaguagaggcugaagaugugggcgucuacuucuguagccaguccucacacgugccacccacuuuuggugcagggaccaggcuggagauuaaacggacaguugccgcgccuaguguguucaucuuuccacccagcgacgaacagcuuaagucuggaaccgcuuccgucgugugccuguugaauaacuucuauccucgcgaggccaaaguacaauggaagguugauaaugcacuccagucaggcaacagccaggaaagugugacugagcaggacucuaaagauuccacauacagccugucgucuacccugacgcucuccaaggccgacuaugagaagcauaaagucuacgcuugugaagugacucaccaaggcuuaucaaguccagugaccaagagcuuuaauagaggggagugc

SEQ ID NO: 23495 - RNA, 1341 nt, Artificial Sequence
  derived and/or modified sequence opt3 from Mirvetuximab_HeavyChain1
caggugcaacugguccagagcggcgccgagguugugaagcccggggcuuccguaaaaaucucuugcaaggcaucaggauacaccuucacagguuauuuuaugaacugggugaaacagaguccuggccagagccucgaauggauugggagaauacacccauacgacggagauacuuucuauaaucaaaaguuucagggcaaagccacgcuuaccgucgacaaguccucuaacacagcgcauauggagcuguugucguuaacuucagaagauuucgcuguguacuauuguaccagguacgacgguagccgggccauggauuauugggggcagggaacaaccguuacugugaguuccgcaucuacaaagggcccgagcgucuuuccccuggccccuuccucaaaaaguaccagcggcgggacggcugcacuaggaugccucgugaaggacuacuucccagagcccguaacuguuucuuggaacuccggugcccugaccucaggcgugcacacauuuccugcuguccuucagagcagugggcuguacucuuuguccagcguggugacugucccaucgucuucccucggaacccaaacauauaucuguaauguuaaucauaaacccucaaacaccaagguggauaaaaagguagaaccuaagaguugcgacaaaacgcacacuuguccaccgugccccgccccugagcugcugggcgguccaagcguguuccucuuucccccuaagccaaaagauacauuaaugauuucccgcacccccgaggucacuugugugguuguggacgucucucaugaagauccggaggugaaguucaauugguacguagacgggguugaagugcacaacgcgaaaacaaagccucgagaggagcaguauaauagcaccuaccgugucgugucaguccugacggugcuucaccaggauugguugaacggaaaagaauauaagugcaagguuaguaauaaagcacugcccgccccaaucgagaagaccauuuccaaagcuaagggccagccuagagaaccccaaguguacacacuaccacccagcagggacgagcucacuaaaaaccagguaucucugaccugucuugucaagggcuuuuauccuucagacaucgccguggaaugggagaguaaugggcagccagagaacaauuacaagacaacuccgcccguucuggauagcgacggauccuucuuuuuguacucuaaacucaccguggauaagucgcgguggcaacaggguaacgucuucagcugcuccgugaugcaugaagcacugcacaaccauuauacacagaaaucauuaagucugucuccuggc

SEQ ID NO: 23496 - RNA, 654 nt, Artificial Sequence
  derived and/or modified sequence opt3 from Mirvetuximab_LightChain1
gacaucgugcugacccagagcccccucucccuugccgucucucugggccaaccugcuauuauaucaugcaaggcaagucagagcguuuccuucgccgggacaucuuugaugcacugguaccaucagaaaccaggacagcaaccgagauuacugaucuauagggcgucgaaccuagaggcuggugugcccgaucgguuuucaggcagcgggaguaagacugacuucacgcucaccauuuccccuguagaagccgaggaugcagccacauacuauugucagcagucucgcgaauacccauauacuuuuggaggcgguaccaaacuggagaucaagcgaacaguggcugcacccagcgucuucauuuuuccuccauccgacgaacagcuuaaaucagggaccgccagugugguuugccuguugaauaacuucuacccccgugaggcuaaggugcaauggaaggucgauaaugcccuccagagcggaaacucucaggaguccgugacugaacaggacucaaaagauagcacauauagucugucuuccacccugacgcucagcaaggcggacuacgagaaacacaagguauacgcaugugaaguuacucaucaaggcuuaucgucuccugugaccaaauccuuuaauagaggcgagugc

SEQ ID NO: 23497 - RNA, 1344 nt, Artificial Sequence
  derived and/or modified sequence opt3 from Modotuximab_HeavyChain1
caggugcaacugcagcagcccggcgccgagcucgucgaaccugggggaagcguuaaacuuuccugcaaggcuucugguuacaccuucacaucacacuggaugcauugggugaagcagagaccaggccaagggcuggaguggaucggagaaauuaacccgaguagcggcaggaauaacuauaaugagaaauuuaaguccaaagcaacuuugacgguagacaagucuucgucaaccgccuacaugcaguucagcaguuuaacauccgaagauucugcgguguauuacuguguccgguauuacgguuaugacgaggcuauggauuacugggggcagggaacuagcgugaccguuuccucagccaguacaaagggccccagcguguuuccucuggcaccaucuuccaaaucaaccagcggcgggacugccgcucuaggaugccucgucaaggacuacuuccccgagccugugacaguaaguuggaacucuggugcacugaccuccggcguucacacguuuccagccgugcuucagagcucggggcuguauucuuuguccucagucgugacugugcccaguagcucccucggaacccaaacauacauauguaaugucaaccauaaaccuucuaauacuaagguugauaaacgcguggaaccaaagagcugcgacaagacccacacauguccgcccugcccugcuccagagcugcugggcggucccucaguauuccucuuuccuccaaaacccaaggauaccuuaaugaucagucgaacgccggaagugacuugugucgugguugacgugucccaugaggauccugaggucaaauucaacugguauguggacgggguagaaguucacaaugccaagacaaaaccccgugaggaacaguacaacagcaccuauagaguggucucugugcugacuguccuucaccaggauugguugaauggaaaggaguacaaaugcaaggugucaaacaaggcgcugccagcaccuauugagaaaacaaucaguaaggccaaaggccagcccagggaaccacaaguuuauacccuacccccuagccgggaggaaaugacgaagaaucaggugucccucaccugucugguaaaaggcuuuuacccaucugacauugcugucgagugggaaucgaacgggcagccggagaauaacuacaagacaacucccccugugcuugauagcgacggauccuucuuucuguauucaaaguugaccguugacaaaagucgcuggcaacaggguaacguguucucuugcagcgucaugcaugaagcccuccacaaucauuacacacagaagucccugucauuaagcccaggc

SEQ ID NO: 23498 - RNA, 657 nt, Artificial Sequence
  derived and/or modified sequence opt3 from Modotuximab_LightChain1
gacaucgugaugacccaggccgcuuucagcaaccccgucacacugggcacuuccgcaucuauuucaugcagaaguagcaagucccuccuucacucuaaugggauaacguaccuguauugguacuugcaaaaaccuggacagucgccacaguuacugaucuaucagaugucaaaccuagccagcgguguuccggauagguuuaguuccucuggcagcgggaccgacuucacacuccggauuucccgcguggaggcggaagauguaggaguguacuauugugcucaaaaucuggagcuucccuacacuuuuggcggugggaccaagcuggaaaucaaacgaacagucgccgcaccuucaguguucauuuuuccacccagugacgagcagcucaagagcggaaccgccucuguugugugcuugcugaacaauuucuauccucgugaagcuaaaguccaguggaagguggauaacgcacugcaguccggcaauucacaagagagcguaacugagcaggacaguaaggauucuacauacucccucagcucgaccuuaacgcugucuaaagccgacuacgaaaagcauaaaguuuaugcuugugaggugacucaccagggccuuuccucaccagucaccaagaguuuuaacagaggggaaugc

SEQ ID NO: 23499 - RNA, 1347 nt, Artificial Sequence
  derived and/or modified sequence opt3 from Mogamulizumab_HeavyChain1
gaggugcagcuggucgaaagcggcggggaccucguucaacccggaagaucccuuaggcugucuugcgcugcuucagguuucaucuuuaguaacuacggcaugagcugggugcggcaggcaccugggaagggauuggaguggguagccaccauuuccucugcgucgacauauucauacuauccagauagcgugaaaggccgcuucacuauaagucgagacaaugcuaagaacuccuuauaccugcagaugaacucucuacgugucgaagauacggcccucuauuacugugguagacacagcgacgggaauuuugcauucggauauuggggccagggcacccuggugacaguuuccucagccaguacuaaagggccgagcguguuuccccuugcuccuucuuccaagucaaccagcggagguacagcagcccugggcugcuuggucaaagauuacuucccagagcccgugaccguaaguuggaacucuggggcucucacuuccggaguucauacauuuccugccgugcugcaaagcucgggccuguacucucucuccucagucgugaccgugccaaguagcuccuuagguacgcagacuuauaucuguaaugucaaucacaagcccucuaacaccaagguugacaaaaagguggaaccuaaaagcugcgauaagacacauacuuguccaccgugccccgcgccugagcugcuugggggaccaucaguauucuuguuucccccuaaaccaaaggacacccugaugauuaguaggacacccgaggugaccugugucgugguugaugugucccacgaagacccggaggucaaguucaauugguacguggauggcguagaaguucauaacgcaaaaacgaagccucgggaggagcaguauaauagcacuuaccgcguggucucugugcuaacaguccuccaccaggacuggcugaacggcaaagaauauaagugcaaagugucaaauaaggcccuucccgcuccaaucgagaaaaccauuaguaaggccaaggggcaaccuagagaaccccagguuuacacucugccacccagcagggaugaguugaccaaaaaccaggugucccucacaugucugguaaagggauuuuauccuucugacaucgcagucgaaugggagucgaauggucagccagagaacaacuacaaaacgaccccgcccguguuagacagcgauggcuccuucuuucuguacucaaagcucacaguugacaaaagucgguggcaacaggggaauguguucucuugcagcgucaugcacgaagcccuucauaaccacuauacucagaagucccugucauugagcccuggaaag

SEQ ID NO: 23500 - RNA, 657 nt, Artificial Sequence
  derived and/or modified sequence opt3 from Mogamulizumab_LightChain1
gacgugcugaugacccagagcccccucucccuuccugucacaccaggcgagccggccucuaucucaugcagaaguagcaggaacauuguucacauaaauggggauacuuaccuggaaugguauuugcaaaagcccggacaguccccucaguuacugaucuacaaagugucuaaccgguucucggguguaccagaccgcuuuucaggcagcgggaguggaacggauuucacccuaaagauuucccgaguggaggcugaagacgucggcguguauuacuguuuucaggguucucuccugcccuggacauucgggcaaggaacuaaaguugagaucaagcguaccguggcagccccuagcgucuuuauuuucccacccuccgaugaacagcuuaaaucaggcacagcgagugugguaugccuguugaauaacuuuuauccuagagaggcuaagguucaguggaagguggacaaugcccuccagagcggcaacucucaagaguccgucaccgaacaggauucaaaagacagcacuuacagucugucuuccacacugacccucagcaaggcagauuaugagaaacauaagguguacgccugugaagugacgcaccagggguuaucgucuccagucacuaaauccuucaauaggggagagugc

SEQ ID NO: 23501 - RNA, 1356 nt, Artificial Sequence
  derived and/or modified sequence opt3 from Monalizumab_HeavyChain1
caggugcaacugguccagagcggcgccgagguuaagaaacccggggcuuccgugaagguaucuugcaaagcaucaggauacaccuucacaaguuauuggaugaacugggugagacaggccccuggucagggccucgaauggauggggaggaucgacccauacgauagcgagacucacuaugcgcaaaaacuucagggacgggucacgaugaccacagacacuuccaccucuacagcuuacauggaacugcgcucguugcgaucagaugacaccgccguguauuacugugcacguggcgguuaugauuuugacguugggacuuuauacugguucuuugauguguggggacagggcacaaccgucacggugagcagugccuccacuaagggcccgucuguauucccccuggcuccuugcagcagauccaccucagagaguacagcagcccuagggugucucguuaaggacuacuuuccagaacccgugacugucagcuggaacucuggagcucugaccuccggugugcauacauucccugccgugcuucagucaagcggccuguauaguuugucuuccgucguuaccgugccaagcucgucucucgggacgaagacuuacacaugcaauguagaucacaaacccuccaauaccaagguggacaaaagggucgagucaaaguauggaccuccauguccgcccugcccugcgccagaguuucugggcggucccaguguguuccuguuuccuccaaaacccaaggauacucucaugauuagccggacaccggaaguuaccuguguggucguggacguaucccaagaggauccugaaguucaguucaacugguacguggacggggucgaggugcauaaugcaaagacgaaaccccgcgaggaacaguuuaacucuaccuauagagucgugagcguuuuaacagugcugcaccaggacuggcuuaauggaaaggaguacaaaugcaagguaucaaacaaaggcuugccaaguuccauagaaaagacuaucagcaaagccaagggccaaccuagggagccccaggucuauacccugccacccucucaggaagagaugacaaagaaucaagugucacuaacuugucucguuaaaggguucuacccuagugauauugcuguggagugggaaagcaacggacagccagagaauaacuacaagaccacaccgcccguccuggacuccgaugguucguuuuuccuuuauucucggcugaccguggacaaaagccgcuggcaggaaggcaauguauucuccugcucagugaugcaugaggccuugcacaaccacuacacucagaagagucucucucugagcuuagggaaa

SEQ ID NO: 23502 - RNA, 642 nt, Artificial Sequence
  derived and/or modified sequence opt3 from Monalizumab_LightChain1
gacauccagaugacccaaagccccuccucucugucagccagugugggcgauagagucacaauuacuugcagggcuagcgagaacauauacuccuaucucgcaugguaccagcagaagccugggaaagccccaaaacuucugaucuauaaugcgaagacguuggcugaaggaguuccgucucgguucucggguucaggcagcgggaccgacuuuacauuaacuauuaguucccugcagcccgaggauuucgccaccuacuauugucaacaccauuacggaacaccucgcaccuuuggcggugggacuaagguggaaaucaaacgaacaguagcagccccaucuguguucauuuuucccccuagcgacgagcagcuaaaguccggaaccgcuucagucgugugccuccugaacaauuucuauccacgugaagcaaagguucaguggaaaguggauaacgcccuucagaguggcaauagccaagagucugucacggagcaggacuccaaggauucaacuuacagccugaguucuaccuugacacucuccaaagcugacuacgaaaagcacaaaguguaugccugugagguaacucaucagggccugagcucgcccguuaccaagucuuuuaacagaggggaaugc

SEQ ID NO: 23503 - RNA, 1350 nt, Artificial Sequence
  derived and/or modified sequence opt3 from Motavizumab_HeavyChain
caggugacccugagagagagcggccccgcccucgucaagccuacacaaacucuuacgcugaccugcacauucuccggguuuucuuugucaacugcuggaaugaguguugguuggaucaggcagccaccgggcaaagcauuagaauggcuggccgacauuuggugggaugacaagaaacacuacaaccccagccuaaaggaucggcucaccauauccaaagacacaucuaagaaucaggugguacugaaggugaccaacauggauccugcggacacugcuacauauuacugugcccgcgauaugaucuucaauuuuuauuucgacgucugggggcagggaaccacggugacuguuucgucagcaagcaccaaaggcccaaguguguuuccccuugccccuuccucuaagagcacauccggugggacugcugcacugggaugcuuggucaaagauuacuucccagagcccgugaccguaucauggaacaguggcgcccucacaagcggcguucauaccuuuccugcugugcugcaaucuuccgggcuguauucacucagcagugucgugacggugccaucuuccagcuuaggaacucagacauacauuuguaaugucaaccacaagccgucgaauaccaaaguugacaagcgaguggaacccaagucuugcgauaaaacucauacauguccuccaugccccgccccugagcugcuugguggcccauccguauucuuguuucccccgaagccuaaagacacccugaugaucucacguacgcccgaagugaccugugucgugguugaugugagucacgaggacccagaggucaaguucaacugguauguggacgggguagaaguucauaaugcgaaaacaaagccuagagaggaacaguacaacagcacuuacaggguggucuccgugcuaaccguccuccaccaggauuggcugaauggaaaagaguauaagugcaaggugucuaacaaagcacuucccgccccaauugagaagacaaucagcaaagcuaagggccaaccccgggaaccucagguuuacacucugccaccgucacgcgaggaaaugaccaaaaaucaggugaguuugacaugucucguaaaggguuuuuaucccuccgacauagccgucgagugggaaagcaacgggcagccugagaauaacuacaagaccacuccacccgugcuggauucugacggaucauucuuuuuauauaguaaacugacgguugauaagagcagauggcaacagggcaacguguucuccugcucugucaugcacgaggcacuccauaaucacuacacacagaaaucgcuuagccuguccccuggcaag

SEQ ID NO: 23504 - RNA, 1350 nt, Artificial Sequence; identical to SEQ ID NO: 23503
  derived and/or modified sequence opt3 from Motavizumab_HeavyChain_variant

SEQ ID NO: 23505 - RNA, 639 nt, Artificial Sequence
  derived and/or modified sequence opt3 from Motavizumab_LightChain
gacauccagaugacccaaagccccuccacacugucugccucagugggcgauagagucacuauuacgugcagugcuagcuccaggguuggguacaugcacugguaucagcagaagccuggaaaagcaccaaagcuccuuauauacgacaccucuaaacuggccucgggugugccgucacgguucagcggcaguggguccggaacagaguuuacuuugaccaucucuagcuuacagcccgaugacuucgcgacauauuacuguuuucaaggcuccgguuauccuuucaccuuugggggaggcacuaagguagaaauuaaacgcacaguggcugccccaucagucuucaucuuucccccuagugaugagcagcugaagucaggcaccgcaucugugguuugccuacucaacaauuucuacccacgagaagccaaggugcaguggaaagucgacaacgcucugcaguccgggaauagccaagagagcgugacggaacaggauaguaaggacucuacuuauucccuuagcucgacccugacauugucuaaagcagauuacgagaagcauaaaguauacgccugugagguuacucaccagggacucuccucacccgugaccaagaguuuuaaccguggugaaugc

SEQ ID NO: 23506 - RNA, 639 nt, Artificial Sequence; identical to SEQ ID NO: 23505
  derived and/or modified sequence opt3 from Motavizumab_LightChain_variant

SEQ ID NO: 23507 - RNA, 1428 nt, Artificial Sequence
  derived and/or modified sequence opt3 from Moxetumomab_pasudotox_HeavyChain1
auggaggugcagcuggucgaaagcggcgggggacucguuaagcccgguggcucccuuaaacugucuugcgccgcuucaggguucgcauuuaguaucuacgacaugagcugggugagacaaaccccugagaaguguuuggaauggguagccuauauuuccucuggaggcgguacaacuuacuauccagauacggugaaagggagguucaccauaucgcgggacaacgcgaagaauacauuauaccugcagaugucaagccuaaaaagugaggauacugcuauguauuacugcgcccgccacuccggauauggcacccauuggggcguccucuuugcauacugggggcagggaacacuggugaccguuucugccaaggcuagcgguggcccggaagggggaucccuugcagcccugacugcucaccaggccugucauuugccccucgagacauucacccgacaccgucaaccuagaggcugggagcagcuggaacagugcgguuacccagugcagaggcuggucgcgcucuauuuagcagcccggcugucauggaaccaaguggaccagguaauccgcaaugcucuugccagucccgggagcggaggcgauuugggcgaggcaauuagagaacagccugagcaggcuaggcuggcccuaacgcucgcggccgcagagucugaacgguuuguucgccaagggacuggaaacgacgaggcuggugccgcuaauggcccagccgauuccggggacgcacugcuugaacgaaacuaccccaccggagccgaguuccugggcgaugguggggacgugucauuuagcacaagaggcacucagaauuggaccgucgaaagguugcuccaggcucaucggcaacuggaggagcguggauauguguucgugggcuaccacgggacauuuuuagaagcggcacagaguaucgucuucggagguguucgcgccagaucucaggaucuggacgcuauuuggaggggcuuuuauaucgccggggauccugcacucgccuacggauaugcucaggaccaagagccagacgcccggggccgaauacgcaacggugcacuucugagaguguacguaccgagguccagcuugcccggguucuaccggaccucgcuaacgcuggcggcuccugaagccgcaggcgagguggaacgccucaucggacacccacugccccuuagacuggaugccauuacuggcccugaggaggaagggggaagguuggagacaauccucgguuggccacuggcugaacguaccgucgugauucccucugccaucccgacugacccucggaauguuggcggggauuuagaccccuccucaauaccagauaaggagcaggcaauuagugcucugccugacuaugccagccagcccggaaaaccaccccgagaagaucuaaag

SEQ ID NO: 23508 - RNA, 324 nt, Artificial Sequence
  derived and/or modified sequence opt3 from Moxetumomab_pasudotox_LightChain1
auggacauccagaugacccaaacaacuagcucccugucugccucacucggcgauagagugacgauuaguugcagggcuagccaggacauauccaacuaccuuaauugguaucagcagaagcccgaugggaccgucaaacuguugaucuacuauacaucuauuuuacacucgggaguuccuucacgguucagcgguaguggcuccgggacugacuacucucugaccaucagcaaccuagagcaagaagauuuugcaacauauuucugucagcagggaaauacccucccauggacuuuuggcugcgguacaaagcuggagauuaaa

SEQ ID NO: 23509 - RNA, 1350 nt, Artificial Sequence
  derived and/or modified sequence opt3 from Muromonab-CD3_HeavyChain
caggugcaacugcagcagagcggcgccgagcucgcuagacccggggcauccgucaagaugucuugcaaagccucaggauacaccuucacaagguauacuaugcacuggguuaagcagcggccuggucaaggccuugaauggaucggguacauuaacccaagucgcggauauacgaauuacaaccagaaauuuaaggacaaagcgacccugacaacugauaagagcuccucuaccgcuuauaugcaguugucgucauuaacaagcgaggacagugccguguacuauugugcacgauacuacgaugaccauuauugccuggauuacuggggccaggguaccacucuaacaguauccucugccaagaccacggcuccgagcguguauccccucgcaccugucugugggggaacuaccggcuccucagugacacugggcugccuuguuaaaggguacuucccagaacccgugacucugaccuggaauagugguagcuugucuuccggaguccacacauuuccugccgugcuccaaucagaccuguauacccugagcaguucuguaacgguuacuuccagcacauggccaucgcagucuauaaccuguaacguggcucaucccgccuccucaacuaaggucgauaaaaagaucgagccucguccaaaaaguugcgacaagacacacaccuguccgcccugcccugcgccagaacucuuaggcgggcccagcguguuccuguuuccuccaaagcccaaagauacgcuuaugauuuccagaaccccggaggugacaugugucguuguggacguaucucaugaggauccugaagugaaguucaauugguacgucgacggaguggagguucacaacgcaaaaacuaagcccagggaggaacaguauaauagcaccuaccggguggucucaguguugacaguacugcaccaggauuggcuaaacggcaaagaguacaagugcaaaguuaguaauaaggcccucccagcuccuaucgaaaagacuauuuccaaagccaagggucaaccccgcgagccacagguguauacccugcccccuagcagagacgaacuuaccaaaaaccaggucucucugacauguuuggugaagggguuuuacccaucagacaucgcagucgagugggaaaguaauggacaaccggagaacaauuauaaaacuacgcccccugugcucgauagcgacggcuccuucuuucuguacucuaaguuaacaguugauaagucgagguggcagcagggcaacguguucagcugcuccguaaugcaugaggcucugcacaaucauuauacccagaaaucacucagucuuucuccagggaag

SEQ ID NO: 23510 - RNA, 639 nt, Artificial Sequence
  derived and/or modified sequence opt3 from Muromonab-CD3_LightChain
cagaucgugcugacccaaagccccgccauuauguccgcuucuccuggcgagaaggugacaaugacuugcucagcaaguagcuccguuucuuacaugaacugguaucagcagaaaucggggacgucaccaaagagauggauauacgacaccagcaaacucgccaguggagugccggcgcacuucagggguuccggcucugggacaagcuauucccuuacuaucucaggaauggaagcugaggaugccgcaaccuacuauugucagcaauggaguagcaaucccuuuacauucggcucugguaccaagcuggaaauuaaccgggccgacacugcuccuacaguauccaucuuuccacccucaagcgagcaguugaccagugggggagcaucuguggucugcuucuuaaauaacuuuuacccuaaagauauuaaugugaaguggaagaucgacggcuccgaacgccagaacggcguucugaauagcuggacggaucaggacucgaaagauucuacuuauuccaugucaaguacccuaacacucacuaaggacgaguacgagcgacauaacagcuacaccugugaagccacacacaaaaccuccacgucuccaauagucaagagcuucaaucguaacgagugc

SEQ ID NO: 23511 - RNA, 1347 nt, Artificial Sequence
  derived and/or modified sequence opt3 from Namilumab_HeavyChain1
caggugcaacugguccagagcggcgccgagguuaagaaacccggggcuuccgugaagguaucuugcaaagcauucggauacccuuuuaccgacuaucuccuucacugggugagacaggccccaggucagggccuggaaugggucgggugguugaacccguacucaggagauacaaauuaugcgcaaaaguuccagggcagggugacuaugacgcgggacaccaguaucagcacagcuuacauggaguuaucccgccugcgaucugaugacacugccguuuauuacuguacccguacaacccuaauuucgguguauuuugauuacuggggucaggggacuauggucacagugucaagcgcaaguaccaaaggacccuccguauucccucucgccccaucuagcaaguccacgucaggcggcacugcugcacuggggugccuuguuaaggacuacuuucccgaaccugugaccgucaguuggaacagcggagcccugacaucuggugugcauacuuucccagcuguguugcaguccucaggccucuauagccugaguucugucguuaccgugcccuccagcucgcuggggacacaaaccuacauauguaauguaaaccacaaaccuucuaauacgaagguggauaaaaaggucgagccaaaauccugcgacaagacucauacauguccgcccugcccugccccagaacucuuaggaggccccucaguguuucuguucccuccaaagcccaaagauacccuuaugaucaguagaacuccggagguuacauguguggucguggacguaagccacgaggauccugaaguuaaguuuaacugguauguggacggugucgaggugcauaaugcgaaaaccaagcccagggaggaacaguacaacuccacguaucgggucgugucuguuuugaccgugcugcaccaggauuggcuaaaugggaaagaguacaagugcaaaguaagcaacaaggcacucccagccccuauugaaaagacaaucucaaaagcuaagggacagccccgcgagccacaagucuauacucugcccccuaguagagacgaacuuaccaaaaaucaggugucccugacauguuugguuaagggcuucuacccaagcgacauugccguggagugggaaucuaacggccagccggagaauaacuacaaaacuacacccccuguccucgauucagacgggagcuuuuuccuguauaguaaguuaaccguggauaaguccagguggcaacagggaaauguauuuucuugcucggugaugcacgaggcacugcauaaccacuacacccagaaaagccucucccuuucaccagguaag

SEQ ID NO: 23512 - RNA, 642 nt, Artificial Sequence
  derived and/or modified sequence opt3 from Namilumab_LightChain1
gacauccagaugacccaaagccccuccucugugucagccagugucggcgauagaguuacaauugcuugcagggcaagccagaacauacggaauauccugaacugguaccagcagcgcccugggaaggccccacaacuccuuauuuaugcggcuuccaaucugcagucuggagugccgucgcgauucucagguagcggcagugggacugacuuuacguugaccaucaacuccuuacagcccgaggauuucgccacauacuauugucagcaaucuuacagcaugccucguacuuuuggaggcgguaccaaacuggaaauuaagagaacaguagcagccccauccguguucaucuuucccccuucagacgagcagcuaaaaagugggaccgcuagcgucgugugccuccugaauaacuucuauccaagggaagcaaagguucaguggaaaguggauaaugcccuucagucuggaaacucccaagagucagucacugaacaggacagcaaggauaguacauacucucuguccagcaccuugacgcucucgaaggcugacuaugagaaacacaagguguacgccugugagguaacucaucagggccugucuucccccguuaccaaaucauuuaaucggggcgaaugc

SEQ ID NO: 23513 - RNA, 1374 nt, Artificial Sequence
  derived and/or modified sequence opt3 from Naptumomab_estafenatox_HeavyChain
gaggugcagcugcaacagagcggccccgaccucgucaagccuggggccuccguuaaaaucucuugcaaggcuucaggauacaguuucaccgguuauuacaugcacugggugaaacagagcccaggcaaggggcuugaauggauuggaagaauaaacccgaauaacggcguaacacuguauaaucagaaauuuaaggauaaggcaacuuugacgguggacaaauccucuaccacagccuacauggaguuaaggucgcugacuucagaagauagcgcggucuauuacugugcucggaguaccaugaucacaaacuaugugauggacuacuggggucaagggaccuccguuacugugucuagcgccaagacaacgcccccuuccgucuacccacuagcacccggaucagccgcucagaccaauaguauggugacucucggcugccugguaaaaggcuauuucccugagccaguuaccgugacauggaacagcgggucucuuuccucaggaguccauacuuuucccgcagugcugcagagcgauuuguacacccucaguucuuccgugacagucccuagcucgaccuggccaucugaaacgguuacuuguaauguggcccacccggcuuccucaacaaagguagacaaaaagauugugccccgcgauagugguggcccuagcgagaaguccgaggaaaucaacgagaaagaccugcgaaagaaaucugaacugcaggggaccgcccucggaaauuuaaagcaaauuuauuacuauaacagcaaagcgaucacuucaagugagaaguccgcagaucaguuccugacaaauacccuuuuguuuaaaggcuucuuuacgggucauccaugguacaacgaccugcuagucgaucucgggagcaccgccgcuacaucugaguaugaaggaucaaguguggaccuguacggcgccuacuauggcuaccagugcgcagggggaacucccaauaagaccgcuuguauguaugguggcguuacacuucacgauaacaaucgucugacugaggaaaagaaagugccuauaaacuuguggaucgacgggaagcagaccacagucccaauugacaaagugaagaccagcaaaaaggagguaacuguucaagaacucgaucugcaggccagacauuacuuacacggaaaguucggccuguauaacuccgacucuuuuggugggaaagugcagaggggccucaucgucuuccacucgagcgagggauccacggugucauacgaucuuuuugacgcgcaaggccaguaucccgauacacuguugcggauuuaccgcgacaauaccacuaucaguucuaccagccuauccauaucacuguaccucuauacaacc

SEQ ID NO: 23514 - RNA, 642 nt, Artificial Sequence
  derived and/or modified sequence opt3 from Naptumomab_estafenatox_LightChain
agcaucgugaugacccagacacccacuucccugcucgucucugccggcgacagaguuacgauuaccugcaaggcuucacaaagugugagcaacgauguagcaugguaccagcagaaaccugggcaguccccaaaacuucugauaucuuauacaucgucaagguacgccggagugccggaccgguucagcgguaguggcuaugggacugauuuuaccuugacaaucuccucuguccaagcggaggacgcugccguguacuucugucagcaggauuauaauagcccucccaccuuuggaggcgguacuaaguuagaaauuaagcgcgcagacgccgcuccaacaguuuccaucuuucccccuucaagugagcagcugaccagcgggggagcaucuguggucugcuuccuaaacaauuucuacccaaaagauauuaacgugaaguggaagaucgacggcuccgaacgacaaaauggcguacucaacucauggacggaucaggacagcaaagauaguacuuauucuauguccagcacccugacacuuacuaaggacgaguacgaacgucacaauucguacaccugugaggccacacauaaaaccucuacgucccccauaguuaagucauuuaacagaaaugagagu

SEQ ID NO: 23515 - RNA, 1356 nt, Artificial Sequence
  derived and/or modified sequence opt3 from Narnatumab_HeavyChain1
gaggugcagcuggucgaaagcggcgggggacucguucaacccgguggcucccuuagacugucuugcgccgcuucaggguucaccuuuaguagcuacuugaugacaugggugaggcaggcaccuggaaagggcuuagaguggguagccaacaucaaacaggacgguuccgaaaaguauuacguggauucugucaaagggcgguucacuauuucgcgcgacaaugcgaagaacucacugaaucuacagaugaacagccuccgagcugaggauacggccguguauuacuguacccgugacggauauaguuccggcagacacuacggcauggauguuugggggcaaggaacaacugugauagucucuagcgcauccaccaaagguccaucaguguuuccgcuggcccccaguagcaagucuacauccggcgggaccgcugcacuuggaugccugguaaaggacuauuucccugaaccaguuacugugucauggaauagcggcgccuugacaagugguguccauaccuuucccgcugugcuccagucuuccgggcuguacagccugucgucuguggucacgguuccuuccucaagucucggaacucagaccuacaucuguaacgugaaucacaaaccaagcaacacaaagguagauaaaaggguggagcccaaguccugcgacaaaacucauaccuguccuccaugcccggcccccgaguuacugggcggcccuucugucuuccuuuuuccacccaagccuaaggauacauugaugauuagccggaccccagaagugacguguguuguggucgacgugucacacgaggaucccgaaguaaaauucaauugguauguugacgggguggagguccauaacgcgaagacuaaaccgcgcgaggaacaguacaauaguacauauagaguggucuccgugcugaccguucuacaccaagauuggcucaacggaaaggaguacaaaugcaaggugagcaauaaagcacugccugcccccaucgaaaagacuauuucuaaggcuaaaggucagccaagggagccucagguauauacacuucccccaucacgggaagagaugaccaagaaccaggucagucugacguguuuggugaaaggcuuuuaccccagcgacaucgccguugagugggaauccaaugggcaaccugagaacaacuauaagaccacaccaccggugcucgacucugauggaucguucuuucuguacagcaaauuaacugucgacaagucccgcuggcagcagggcaauguguucucaugcaguguaaugcacgaagcacugcauaaccacuacacccaaaagucucucagccuuucccccgguaaa

SEQ ID NO: 23516 - RNA, 642 nt, Artificial Sequence
  derived and/or modified sequence opt3 from Narnatumab_LightChain1
gagaucgugcugacccagagccccgccacacucucccuuucuccuggcgaaagagcuacucugucaugcagggcaagucaaagcgucucccgguacuuggccugguaucagcagaagccagggcaggcgccgcgcuuacugauuuacgacgcuucuaaccgagccacgggaauacccgcacguuucucggguucaggcagcgggaccgauuuuacacuaacuaucaguucccucgagccugaagacuucgccguuuauuacugucaacagagaucuaauuggccaaggaccuuuggacagggcacaaaaguggagauuaagcggaccguagcugcacccagcguguucaucuuuccuccauccgaugaacagcugaaaucagguacugccagugucgugugccuucugaacaauuucuauccccgcgaggcuaagguucaauggaaaguggacaacgccuugcagagcggaaauucucaggaguccgucacagaacaggauucaaaggacagcaccuacagucucucuuccacgcugacucugagcaaggcggauuaugagaaacacaagguguacgcaugugaaguaacccaucaagggcucucgucuccuguuacaaaauccuuuaacagaggcgagugc

SEQ ID NO: 23517 - RNA, 1350 nt, Artificial Sequence
  derived and/or modified sequence opt3 from Natalizumab_HeavyChain1
caggugcaacugguccagagcggcgccgagguuaagaaacccggggcuuccgugaagguaucuugcaaagcaucaggauucaacaucaaggacaccuacauucacugggugagacaggccccuggucagaggcucgaauggaugggccggauagauccagcgaauggguauacaaaauacgacccgaaguuucaaggacgcgucacuaucacggcugauaccagugccagcacagcauauauggagcuuuccucucugcgaucggaagacacugccguguacuauugugcucgugagggcuacuaugguaacuacgggguuuacgcaauggauuauuggggacagggcaccuuggugacagucucaagcgccaguaccaagggccccuccguguucccuuuagcuccaugcucuagaagcacuuccgaaucaacagccgcgcuggggugucuaguaaaagacuacuuucccgagccuguuaccgugaguuggaauagcggagcacucacgucugguguccauacuuucccagccgugcugcaguccucaggccuuuauagccugaguucuguggucaccguucccuccagcucguuggggacaaagacuuauaccugcaacguggaucacaaaccuucuaauacaaagguagacaaaaggguggaguccaaguacggaccaccgugucccucaugcccugcuccagaauuucucggcggucccagugucuuccuguuuccuccaaagcccaaagauacccugaugauuagccggacgccggaggugacuuguguuguggucgacgugucccaggaagauccugagguacaauucaacugguacguugacgggguggagguccauaaugccaagacaaaaccccgcgaggaacaguuuaacucuaccuauagaguggucagcgugcucacuguuuuacaccaggauuggcugaauggaaaggaauacaaaugcaaggugucaaacaaaggccuuccaaguuccaucgagaagacaauuagcaaggcaaaaggccagccuagggaaccccaaguauacaccuugccacccucucaggaggagaugacgaagaaucaggucucacugaccugucuagugaaaggguucuauccuagugacaucgcuguugaaugggagagcaacggacaaccagaaaauaacuacaagacaacuccgcccgugcucgacuccgaugguucguuuuuccuguauucucggcuuaccgucgacaaaagccgcuggcaggagggcaauguguuuuccugcucaguaaugcaugaagcccugcacaaccacuacacacagaagaguuugucucucagccuggggaag

SEQ ID NO: 23518 - RNA, 639 nt, Artificial Sequence
  derived and/or modified sequence opt3 from Natalizumab_LightChain1
gacauccagaugacccaaagccccuccucucugucagccagugugggcgauagagucacaauuacuugcaagacgagccaggacauaaacaaauacauggcuugguaucagcagaccccugggaaggcaccaaggcuccuuauccacuacacauccgcccugcaaccggguauucccucucgguucucgggaucaggcagcgggcgcgauuauacuuuuaccaucaguuccuugcagccugaggacauugcgacauacuauuguuuacaguacgauaaucuguggaccuucggacagggcacuaaaguugaaaucaagcgaacaguggcugccccaucuguauuuauauuucccccuagcgacgagcaacuaaaauccgguaccgcaucaguggucugccuccugaacaauuucuauccacgugaagccaaggugcaguggaagguugauaacgcacuucagagugggaauagccaggagucugugacggaacaagacuccaaagauucaacuuacagccugaguucuaccuugacacucuccaaggcugacuacgagaaacauaaggucuaugccugugaggugacucaccagggacugagcucgcccguaaccaaaucuuucaacagaggcgaaugc

SEQ ID NO: 23519 - RNA, 1335 nt, Artificial Sequence
  derived and/or modified sequence opt3 from Navicixizumab_HeavyChain1
caggugcaacugguccagagcggcgccgagguuaagaaacccggggcuuccgugaagaucucuugcaaagcaucaggauacaguuucaccgccuauuacauucacuggguaaagcaggcgccuggucagggccucgaauggauaggguauaucagcaacuacaauagagcuacaaacuauaaucaaaaauuuaagggaagggugacuuucacgaccgacacauccacuucuaccgccuacauggagcuucggucgcugcgcucagaugacacagcagucuauuacugugcccgagauuacgacuaugaugugggcauggacuacuggggucaggggaccuugguuacugugagcagugcuuccacaaagggaccaucugucuuuccguuagcacccugcagccguuccaccucagaaaguacggccgcucugggcugucuagugaaagauuauuucccugagccaguaacuguuagcuggaacucuggcgcccucaccuccggggugcauacauuucccgcgguccugcagucaagcggacuuuacagucugucuuccguggugacugucccuagcucgaauuucgguacccagacauauaccugcaacguugaccacaagccaucuaauacgaaaguggauaagacuguagaaagaaaauguugcguggagugucccccuugcccagcaccgcccgucgccggcccuuccguguuuuuguucccacccaagccuaaggacacacucaugauuucaaggaccccagagguuacuuguguggucguggauguaagucaugaagaccccgagguucaauuuaacugguacguggauggggucgaagugcacaaugcuaaaacaaagccgcgggaggagcaguucaacagcaccuuucgcgucguguccguucugacggugguacaucaggacuggcugaauggaaaagaauauaagugcaaagucucuaacaagggccucccugcccccaucgagaaaaccauuagcaagacaaagggucagccaagagaaccucaaguguacacuuuacccccaucaagggaggaaaugaccaaaaaucagguuagucugacaugucuuguggagggguucuaccccuccgacaucgcagucgagugggaaagcaacggacagccugagaauaacuauaagacuaccccaccgauguuggauucugacggcucauuuuuccuguacagugaacuaacaguggauaaaagccgguggcaacagggcaacguauucuccugcucugugaugcacgaggcucuccacaaucauuauacccagaagucgcugagccuuucccccgggaaa

SEQ ID NO: 23520 - RNA, 1341 nt, Artificial Sequence
  derived and/or modified sequence opt3 from Navicixizumab_HeavyChain2
caggugcaacugguccagagcggcgcugagguuaagaaacccggggcuuccgugaagguaucuugcaaagcaucaggauacaccuucacaaacuauuggaugcacugggugagacaggccccuggucagggccucgaauggaugggggacaucaauccaaguaacggaaggacuagcuacaaggagaaauuuaagcggcgcgucacgcuuuccguggauaagucuucgucaaccgcguauauggaacugagcaguuugcgauccgaggacacagcuguuuacuucuguacuauucauuaugaugacaaauacuauccguuaauggauuacuggggccaagguacccuggugacagucucuagcgccuccaccaaggggcccucaguguuuccucuagcaccaugcagucguagcacuucugaauccacagccgcucucggaugucugguaaaagacuacuuccccgagccuguuaccgugucauggaauagcggcgcacuuacgaguggcguccacacuuuuccagccgugcugcagucuuccggguuguauagccucucgucuguggucaccguucccuccucaaacuucggaacacagacuuauaccugcaauguggaucauaagccuaguaacacaaaaguagacaagaccguggagagaaaguguugcgucgaauguccaccgugccccgcuccuccaguggccggucccagcguuuuucuguucccuccaaaacccaaggauacgcugaugauauccaggacuccggaggugacaugugucgugguagacguuucucacgaagauccugaggugcaguuuaauugguacgucgacggcguggagguccauaacgcgaaaaccaagccccgggaggaacaauucaauagcacuuuucgcgugguuucagugcucacaguaguccaccaggauugguuaaacgggaaagaauacaagugcaaagugaguaauaagggacugccagcaccuaucgagaagaccauuuccaaaacgaagggccagcccagagaaccacagguuuauacccuucccccuagcagggagaaaaugacaaagaaccaagugucuuugacuugucuggucaaagguuucuacccaucagacaucgccguggagugggaaaguaaugggcagccggagaacaauuauaagaccacacccccuaugcuaaagagcgacggauccuuuuuccucuacucuaaacugacuguagauaagucgcgguggcagcaaggcaacguguucagcugcuccguuaugcacgaagcccuucauaaccacuacacccagaaaucacugaguuugucuccaggcaag

SEQ ID NO: 23521 - RNA, 654 nt, Artificial Sequence; identical to SEQ ID NO: 23125
  derived and/or modified sequence opt3 from Navicixizumab_LightChain1

SEQ ID NO: 23522 - RNA, 1368 nt, Artificial Sequence
  derived and/or modified sequence opt3 from Navivumab_HeavyChain1
caggugcaacugguccagagcggcgccgagguuaagaaacccggggcuuccgugaagguaucuugcaaaaccucaggauacaguuucagcacauaugguguguccugggucagacaggcaccuggccaggggccagaaugggugggauggaucucugccuacacuggcauuacggacuaugcgcaaaaguuucaggguaggguuacccucacaacugaugcuaccacagccaccgcauuccuugaccugcggucguugcgcccggaugacacugccacauacuuuugugcucgagauaaagugcaggggcgugucgaggugggaucaggcggcagacacgacuauugggggcagggaaccuuaguaauaguuagcagugcauccacgaagggucccucuguguucccucuggccccaagcuccaagucaacuucgggcgggaccgcugcccuaggaugccucgucaaagauuacuuucccgaaccugugacagugagcuggaacucuggcgcgcugacuuccgguguccauaccuucccagcaguucuucaaucaagcgggcuguauaguuugucuuccgugguaacagugcccagcucgucucucggaacccagacguacaucuguaaugucaaccacaagccuuccaauacuaaaguggacaagaaaguugagccaaagucaugcgauaagacacauaccuguccgcccugcccugccccagaacugcugggcggccccaguguguuucucuucccuccaaaacccaaggacacuuuaaugauuagcaggacaccggaggucaccugugugguaguugaugugucccacgaggacccugaagucaaauuuaacugguacguggauggggucgaggugcauaaugcuaagacgaaaccccgggaagaacaguauaacucuaccuaccgcguugugagcguacugacaguccuucaccaggacugguugaauggaaaggaguauaaaugcaaggugucaaacaaggcccugccagcaccuaucgagaaaacuauuaguaaggcuaaaggucaacccagagagccacagguuuacacccuacccccuuccagggacgaacucacaaagaaucaggugagccugacuugucuugucaaaggcuucuauccaucugauaucgccguggagugggaaucaaacgggcaaccggagaauaacuacaagaccacacccccuguacuggacagugauggcagcuuuuucuuguauuccaagcucaccguggacaaaucucgguggcagcagggaaauguuuuuaguugcagcgucaugcacgagggucugcauaaccacuacacucagaaguccuuaucacugaguccagggaaa

SEQ ID NO: 23523 - RNA, 645 nt, Artificial Sequence
  derived and/or modified sequence opt3 from Navivumab_LightChain1
gaggugguccugacccagagccccggcacacucgcccuuccuccaggggaacgggcuacucuguccugcagggcaucucaccggguuggaucaacguacaucgccugguaucaacagaagaguggucaggcgccgcgccgauugauuuacggcgcuagcaaccgugccaccgacauacccgauagauucuccgggucuggaucgggcacagacuuuacuuuaaccaucaggcggcuggagccugaagauucagcaguguauuacugucagcaauucagcguaaguccauggacauuuggucaggggacccgcguggagauuaaaagaacugucgccgcucccuccguguucaucuuuccuccaucugacgaacagcuaaagagcggaacagcauccguugugugccuccugaauaacuucuaucccagggaggccaaaguccaguggaagguggauaaugcccuucaaucaggcaacagucaggagagcguaaccgaacaggacucuaaagauuccacguacucacugagcaguacuuugacccucucuaaggcugacuaugagaagcauaaaguuuacgcgugugaagugacacaccagggccuguccagcccugucacuaagucguuuaauagaggggagugc

SEQ ID NO: 23524 - RNA, 2172 nt, Artificial Sequence
  derived and/or modified sequence opt3 from Ndimab-varB_HeavyChain
caggugcaacuggucgagagcggcgggggaguugugcagcccgguagaucccucaggcuuucuugcgccgcuucaggcuucaucuuuaguagcuacgcaaugcacuggguacggcaggccccugggaacggacuggaauggguggcguucauguccuaugacggcucuaauaagaaauacgcugauucggucaagggucgcuuuaccauuucacgagacaacagcaaaaauacauuguauuuacagaugaacagucugcgugccgaggauacugcaguguacuauugugccagagacagggggauauccgcuggaggcaauuacuauuacuacggcauggauguuugggggcaaggaacgaccgugacagucucuagcgcauccacuaaggguccaucaguguucccgcuagcccccaguagcaaaucuaccuccggcgggacagcugcccucggaugccugguaaaggacuauuuuccugaaccaguuaccgugucauggaacagcggcgcgcuuacaagugguguccauacauuccccgcagugcugcagucuuccggguuguacagccucucgucuguggucaccguuccuuccucaagucugggaacgcagacuuauaucuguaaugugaaccacaagccaagcaauaccaaaguagauaagcggguggagcccaaauccugcgacaagacacauacuuguccuccaugcccggcccccgaacugcucggcggcccuucugucuuuuuauucccacccaaaccuaaggauacccugaugauuagccgcacaccagaggugaccuguguuguggucgacgugucacacgaggaucccgaaguaaaguuuaacugguacguugacgggguggagguccauaaugcuaaaacgaagccgagagaggaacaguauaacaguacuuacaggguggucuccgugcuuacaguuuugcaccaagauuggcugaauggaaaagaguauaagugcaaagugagcaacaaggcccuaccugcacccaucgaaaagaccauuucuaaggcuaagggucagccacgggagccucagguauacacucuucccccaucacgcgaagagaugacuaaaaaucaggucagucugaccugucuugugaagggcuucuaccccagcgacaucgccguugaaugggaguccaacgggcaaccugagaacaauuauaaaacgaccccaccggugcuggacucugauggaucguuuuucuuguacagcaagcucacagucgacaaaucccgauggcagcagggcaacguguuuucaugcaguguaaugcacgaagcgcugcauaaucacuauacucaaaagucuuuaagccugucccccgguaaagggggcggaggcucagggggagguggcagccaggugcagcucguucagucuggggccgaggucaaaaagccuggauccagugugaaagugagcuguaaggcaucuggcgguaccuucuccacauacgggauaucaugggucagacaagcuccaggccagugccuugaauggaugggaggcaucauucccaucuucgauacugggaacagugcccagagcuuucagggaaggguuaccauuacagcugacgagucgaccuccacugccuauauggaacugucuagcuugcggucagaggauacggcaguguacuauugcgcccguaguucccgcaucuacgaccuaaauccuucucugacagcuuacuaugauauggacguguggggucaaggcaccaugguaacugucagcuccgggggaggcgguucagggggcggaggcagcgggggaggcgguagugggggaggcgguucucaguccgugcucacccagccacccagcguuucggcggcaccgggccagaaagugacaauaucauguucugggaguuccagcaacauuggaaauaacuacgucucuugguaucaacagcugccuggcaccgccccaaagcuccugaucuacgauaauaacaagagacccagcgggauuccugacagguucuccggaucaaaaaguggcacuagcgcuacauuggguaucacggggcuccagaccggagaugaggccgacuauuacugcggcacuugggacucuucccugucagcauggguguuugguuguggcacaaaguuaaccguucug

SEQ ID NO: 23525 - RNA, 645 nt, Artificial Sequence
  derived and/or modified sequence opt3 from Ndimab-varB_LightChain
gagaucgugcugacccagagccccgccacacucucccuuucuccuggcgaaagagcuacucugucaugcagggcaagucaaagcgucuacuccuauuuggccugguaccagcagaagccagggcaggcgccgcgguuacugauuuaugacgcuucuaaccgcgccauaggaauccccgcacgauucucggguucaggcagcgggacggauuuuacccuaacaauuaguucccucgagccugaagacuucgccguuuacuauugucaacagcguucuaauuggccacccuuuacuuucggaccuggcaccaaaguggauaucaagagaacaguagcugcaccaagcguguuuauuuuucccccuuccgacgagcagcugaaaucagguaccgccagugucgugugccuucugaacaauuucuacccaagggaagcuaagguucaguggaaaguggauaacgccuugcaaagcggaaauucucaggaguccgucacugagcaggacucaaaggauagcacauauagucucucuuccacccugacgcugagcaaggcggacuacgaaaaacacaagguguacgcaugugagguaacucaucaggggcucucgucuccgguuaccaaauccuucaaccggggcgaaugc

SEQ ID NO: 23526 - RNA, 1353 nt, Artificial Sequence
  derived and/or modified sequence opt3 from Necitumumab_HeavyChain1
caggugcaacugcaggagagcggccccgggcucgucaagccuucccagacccuuucucugacaugcacuguuucaggagguaguaucagcuccggcgacuacuauuggucuuggauuagacagccaccggggaaaggauuggaauggauaggcuacaucuauuacucggguucaacggauuauaaccccagcuuaaagaguagggugaccauguccguagacacaucuaaaaaucaauucagccugaaggugaacuccgucacugccgcugauaccgcaguguacuauugugcccggguuucaauuuuuggggugggaacauucgacuacuggggccagggcacccuagucacugugaguagcgcgucuacaaaagggccuuccguacucccacuggcucccucaagcaagaguaccucuggagguacggccgcacuuggcugccugguuaaggauuacuuuccugagccagugacugucuccuggaauagcggggccuugaccucgggagugcacacauuccccgcugugcuccagucuuccggccuguauucacugaguagcgucguuacugugccuuccucuagccucgguacccagacauacaucuguaacguaaaucauaaaccaucaaacaccaagguggacaaacgcgucgaaccgaagaguugcgauaaaacgcacacuugucccccuugcccagcacccgaguuacuugggggaccuuccguguuucuguucccacccaagccgaaggacacauugaugauuagccgaaccccugaaguuacuuguguggucguggauguaucucaugaggaccccgagguuaaauuuaauugguauguggauggcgucgaagugcacaacgccaagacaaaaccacgugaggaacaauacaauucaaccuauagagucgugaguguucugacggugcuacaucaggacuggcucaacggcaaggaguacaaaugcaagguaagcaauaaagcucugccugcccccaucgagaagaccauauccaaggcgaaagggcagccaagggaaccccaggucuauacacuuccuccaucucgggaggaaaugacuaagaaccaagugucgcugaccuguuugguuaaaggauucuacccgagcgauaucgcaguggagugggaauccaauggucagcccgagaacaauuacaagacaacuccuccaguccucgacucagacggcagcuuuuuccuguauucuaaauuaaccguggauaagagccgcuggcagcaagggaacguauuuuccugcucagugaugcacgaggcccugcacaaccauuacacacagaagagucucucucuuucccccggaaaa

SEQ ID NO: 23527 - RNA, 642 nt, Artificial Sequence
  derived and/or modified sequence opt3 from Necitumumab_LightChain1
gagaucgugaugacccagagccccgccacacugucccucucuccuggcgaaagggcuacucuuucaugcagggcaagucaaagcgucuccucuuaccuggccugguaucagcagaagccagggcaggcgccgcgguuguuaauuuacgacgcuucgaaccgcgccacgggaauacccgcacgauucucagguagcggcagugggaccgauuuuacacugacuaucuccucucuagagccugaagacuucgccguuuauuacugucaccaauauggaagcaccccacucacauuuggcggugggaccaaagcugagauuaagcguacuguggcagcccccuccguauucaucuuuccuccaucagaugaacagcugaaaaguggaacagcuagcguggucugccuucugaauaacuucuaccccagagaggccaaggugcaguggaaaguugacaaugcguugcagucuggcaacucccaagagucagugaccgaacaggauagcaaggacaguacguauucucucuccagcacucugacccugucgaaggcagauuacgagaaacauaaggucuacgccugugaagugacacaccagggccucucuuccccuguaacuaaaucauuuaauagaggggagugc

SEQ ID NO: 23528 - RNA, 396 nt, Artificial Sequence
  derived and/or modified sequence opt3 from Neliximab_HeavyChain_VH-Region
gaggugcagcugcaacagagcggccccgaacucgucaagccuggggccuccguuaaaaugucuugcaaggcuucaggauacaccuucaccacuuaugugaugcacuggguaaaacagaagccaggucagggccuugaguggaucggguacauuaacccguauaaugacggaacgaacuacaaugaaaaauuuaagggcaaggcaacccugacaagugauaaaagcuccucuacugccuauauggaguugucgaccuuaacaucagaagacagcgcgguguacuauugugcugaguucauaaccaagacugucggugggaguaacugguaccuggauguguggggagccggcacaaccguuacgguguccucugcaaaaacuacacccccuaagcua

SEQ ID NO: 23529 - RNA, 372 nt, Artificial Sequence
  derived and/or modified sequence opt3 from Neliximab_HeavyChain_VH-Region_variant1
caggugcaacugaagcagagcggccccgaacucgucaaaccuggggccuccguuaagaugucuugcaaggcuucaggauacaccuucacaacuuaugugaugcacuggguaaaacagaaaccaggucagggccuugaauggaucggguacauuaacccguauaaugacggaacgaacuacaaugagaaguuuaagggcaaagcaacccugacaagugauaagagcuccucuacugccuauauggaauugucgaccuuaacaucagaggacagcgcgguguacuauugugcugaguucauaaccaaaacugucggugggaguaacugguaccuggauguguggggagccggcacaaccguuacgguguccucu

SEQ ID NO: 23530 - RNA, 318 nt, Artificial Sequence
  derived and/or modified sequence opt3 from Neliximab_LightChain_VL-Region
gacaucgugcugacccagagccccgccauuauguccgcuucuccuggcgagaaggucacaaugacuugcucagcaaguagcuccauaucuuacauccacugguuccaacagaaaccagggacgucgccgaagagauggauuuaugauaccucaaaacuccccagcggaguuccugccagguuuagugguuccggcucugggacaagcuacucccuuacuaucucaaguauggaagcggaggacgcugccaccuauuacugucaucagcggagcucuuauacauggaccuucggaggcgguacuaagcuggaaauuaaa

SEQ ID NO: 23531 - RNA, 354 nt, Artificial Sequence
  derived and/or modified sequence opt3 from Neliximab_LightChain_VL-Region_variant1
cagaucgugcugacccaaagccccgccauuauguccgcuucuccuggcgagaaggucacaaugacuugcucagcaaguagcuccauaucuuacauccacugguuccagcagaaaccagggacgucgccgaagagauggauuuaugacaccucaaaacuccccagcggaguuccugccagguuuagugguuccggcucugggacaagcuacucccuuacuaucucaaguauggaagcggaggaugcugccaccuauuacugucaucagcggagcucuuauacauggaccuucggaggcgguacuaagcuggaaauuaaacgcgcagacgccgcuccaacaguguccgcagccgcu

SEQ ID NO: 23532 - RNA, 1335 nt, Artificial Sequence
  derived and/or modified sequence opt3 from Nemolizumab_HeavyChain1
caggugcaacugguccagagcggcgccgagguuaagaaacccggggcuuccgugaagguaucuugcaaagcaucaggauacaccuucacagguuauaucaugaacugggugagacaggccccuggccaggggcucgaauggaugggacuuauuaauccauacaacggcgguacugacuauaauccgcaauuucaggauagggucacgauaaccgcggacaagaguacaagcacugcuuacauggagcuguccucuuugcggucggaagauaccgccguguauuacugugcacgcgacggguaugaugacggacccuacacauuagagaccuggggccagggcacucugguuacagugucaagcgccaguaccaaagggccuuccgucuucccacuagcucccucuagcaaguccacgucaggagguacugcagcccucggcugccuggugaaggauuacuuuccugaaccaguaaccguuaguuggaacagcggggcucuuacaucuggagugcacacuuuccccgccguccugcaguccucaggcuuguauagccucaguucuguggugaccgucccuuccagcaauuuugguacacaaaccuacacguguaacguugaccauaaaccaucgaauacuaagguggauaaaacaguagagcgaaagucuugcguggaguguccgcccugcccugcgccacccgucgcagggccuuccguguuccuguuuccacccaaaccgaaggacacccugaugaucucacguacuccugaaguuacauguguggucguggauguaagucaggaggaccccgaaguucaguucaacugguauguggauggagucgaggugcacaaugccaagaccaaaccaagagaggaacaguuuaacagcacguucagggucguguccguucucaccgugguacaucaagacugguuaaauggcaaggaguacaaaugcaaggucucuaacaaaggccugccugcucccauugaaaagacaaucagcaaaacuaaggggcagccacgggagccccagguguauacccuuccuccaucacaagaagagaugacaaagaaucagguuaguuugacuugucuggugaaaggauuuuacccguccgacauugccgucgagugggaaagcaacggucagcccgagaauaacuauaagaccacaccuccaaugcuagauucugacggcucauucuuucucuacaguaaacugaccguggauaagagccgcuggcaggaagggaacguauucuccugcucugugaugcacgaggcacuucauaaucacuacacucaaaaaucgcugagcuuguccccc

SEQ ID NO: 23533 - RNA, 642 nt, Artificial Sequence
  derived and/or modified sequence opt3 from Nemolizumab_LightChain1
gacauccagaugacccaaagccccuccucucugucagccagugugggcgauagagucacaauuacuugccaggcuagcgaggacauauacuccuucguugcaugguaucagcagaagccugggaaagccccaaagcuccuuaucuacaacgcgcaaacggaagcucagggagugccgucuagguuuucggguucaggcagcgggaccgauuucacacugacuauuaguuccuugcagcccgaggacuuugccaccuauuacugucagcaccauuaugauucuccuuuaacauucggaggcgguaccaaaguagaaaucaagcggacuguggcagccccaagcgucuuuauuuuucccccuuccgacgagcaacugaaaucagggacagcuagugugguuugccuacucaauaacuucuacccacgcgaagcaaaggugcaguggaaggucgauaaugcccugcagagcggaaacucucaggaguccgugaccgagcaagacucaaaagauagcacguauagucuuucuuccacucugaccuugagcaaggcugacuacgaaaaacacaagguauacgccugugagguuacacaucagggccucucgucucccgugacuaaauccuucaaucgaggcgaaugc

SEQ ID NO: 23534 - RNA, 1356 nt, Artificial Sequence
  derived and/or modified sequence opt3 from Nesvacumab_HeavyChain1
gaggugcagcuggucgaaagcggcgggggacucguucaacccgguggcucccuuagacugucuugcgccgcuucaggguucaccuuuaguagcuacgacauccacugggugaggcaggcaacaggaaagggcuuggaguggguauccgccauugguccugcgggggauacuuauuacccaggaucugugaaaggccgguucacgauaucgcgcgaaaacgcuaaaaauucauuauaucugcagaugaacagccuacgagccggcgacaccgcagucuacuauugugcccgugggcucaucacauuuggaggucugauugcuccguucgauuacuggggccaggggacucuugugaccguuaguuccgcaucuacaaagggacccagcguguuuccucuggccccauccucaaagaguaccagcggcgguacugcugccuuggggugccucgucaaagacuauuuccccgagccugugacaguaucuuggaacuccggagcgcugaccucaggcguucauacguuuccagcagugcugcaaagcaguggccucuacucuuuauccagcgucgugacugugcccucgucuucccuggggacccagacauacaucuguaaugucaaucacaagccuucaaacacuaagguugauaaaaagguggaaccaaaaaguugcgacaagacccauacauguccgcccugcccugccccagagcuuuugggaggucccagcguauuccuguuuccuccaaaacccaaggauacccuaaugauuuccagaacgccggaggugacuugugucgugguugacgugucucacgaagauccugaggucaaguucaauugguauguggacggcguagaaguucauaacgcuaaaacaaagcccagggaggagcaguacaauagcaccuaucggguggucucagugcucacuguccugcaccaggauuggcuuaacgggaaagaauacaagugcaaagugaguaauaaggcccugccagcaccuaucgagaaaacaauauccaaggcuaagggacaaccccgcgaaccacagguuuauaccuugcccccuagcagagacgagcucacgaaaaaccaggugucucugaccuguuuaguaaagggcuuuuacccaucagauaucgccgucgaaugggagaguaauggucagccggagaacaauuauaaaacaacucccccugugcuggacagcgacggguccuucuuucucuacucuaaacuuaccguugauaagucgagguggcaacagggcaacguguucagcugcuccgucaugcacgaagcgcugcauaaccacuacacacagaagucauugagucuaucuccaggaaag

SEQ ID NO: 23535 - RNA, 642 nt, Artificial Sequence
  derived and/or modified sequence opt3 from Nesvacumab_LightChain1
gagaucgugcugacccagagccccggcacacucucccuuucuccuggggaacgggccacucugucaugcagggcuagucaaagcgucuccucuacguacuuggcaugguaucagcagaagccaggacaggccccgcgguuacugauuuacggugcgucgucacgcgcuaccggcauacccgaccgauucagcgggaguggauccggcacagauuuuacucuaaccaucucucgucucgagccugaagacuucgccguuuauuacugucaacacuaugauaacagccagacauuuggucaggggaccaaaguggagauuaagagaacuguagcagccccauccguguucaucuuucccccuucagacgaacagcugaaaaguggaacagcuagcgucgugugccuucugaauaacuucuacccaagggaggcaaagguucaauggaaaguggauaaugccuugcagucuggcaacucccaggagucagucaccgaacaggacagcaaggauaguacguauucucucuccagcacucugacccugucgaaggcugacuacgagaaacauaagguguacgccugugaaguaacacaccaaggccucucuucccccguuacuaaaucauuuaauagaggggagugc

SEQ ID NO: 23536 - RNA, 1362 nt, Artificial Sequence
  derived and/or modified sequence opt3 from Neuradiab_HeavyChain1
gaggugcagcugcaacagagcggccccgaacucgucaagccuggggccuccguuaaaaugucuugcaaggcuucaggauacaccuucacaaguuaugugguacacugggugaaacagaacccaggucagggccuugaguggaucggguacauuaauccguuuaacgacggaacuaaguauaaugaaaacuucaaauguaaggcaacgcugaccagcgauagauccucuucgacagccuacauggaguugaguagcuuaacuucagaagaguccgcggucuauuuuugcgcuagggacaugggccgggaggguuucgccuacugggggcaaggaacccuggugacaguuucugcagccaagaccacucccccuagcguguauccacuagcucccggcuguggcgauacaaccggguccucagucacgcucggaugccuggugaaagguuacuuuccugaaaguguaacuguuaccuggaauagcggcucucuuuccucaagcgugcauacauucccagcacuguugcagagugggcucuacacuaugucuuccagcgucaccgugcccucgucuacauggccuucccagauagugaucuguucagucgcccacccagcuaguagcaccacgguugacaagaaacuggagccguccggacccauuucuacuaucaacccuugcccacccuguaaggaaugccauaaauguccugccccaaaucuggagggcggucccagcguguuuauuuucccgccuaacaucaaggauguacucaugauaucauuaacacccaaggugaccugcgucgugguugacgugagugaggaugacccagauguccagaucuccugguuugugaauaacguagaaguucacacugcgcaaacacagacccaucgcgaggacuauaauagcacgauucgaguggucucuacccugccuauccagcaccaggauuggaugucagggaaagaguucaaguguaaagugaacaauaaggaccuucccaguccaauugaacguacaaucagcaaaauaaagggauuggucagagcaccccaaguguacauucugccuccaccggccgaacagcuauccaggaaagauguuucucucacuugccuggugguaggcuuuaaccccggcgacaucucggucgaguggaccagcaaugggcacacagaggaaaacuauaaggacacugcuccugugcuugauuccgacggaucauacuucauuuauaguaagcugaacaugaaaaccucuaagugggagaaaacagauagcuuuuccugcaauguucggcaugaagguuugaagaacuacuaucucaaaaagaccaucucacgcagcccaggcaag

SEQ ID NO: 23537 - RNA, 657 nt, Artificial Sequence
  derived and/or modified sequence opt3 from Neuradiab_LightChain1
gacaucgugaugacccaggccgcuuucagcaaccccgucacacugggcacuuccgcaucuauuucaugcagaaguagcaagucccuccuucacucuaaugggauaacguaccuguauugguacuugcaaaaaccuggacagucgccacaguuacugaucuaucagaugucaaaccuagccagcgguguuccggauagguuuaguuccucuggcagcgggaccgacuucacacuccggauuucccgcguggaggcggaagauguaggaguguacuauugugcucaaaaucuggagcuuccccgaacuuuuggcggugggaccaagcuggaaaucaaacgugccgacgcagccccuacagucucaauuuucccacccaguagcgagcaguugaccucuggaggcgcuuccgugguuugcuuucucaacaauuucuacccuaaggauaucaacgugaaauggaagauagacggcucagaaagacagaaugggguccugaacagcuggacugaucaggacaguaaggauucuacauauuccaugagcucgacccugacgcucacuaaagacgaguacgagaggcauaauucuuacaccugugaagcaacacacaagacuuccaccucaccaaucgugaaaaguuuuaaccggaaugagugc

SEQ ID NO: 23538 - RNA, 369 nt, Artificial Sequence
  derived and/or modified sequence opt3 from Nimotuzumab_HeavyChain1
caggugcaacugcagcagagcggcgccgaggucaagaaacccggguccucuguuaaggugucaugcaaagcuaguggauacaccuucacaaacuauuacaucuauuggguaagacaggcaccuggucaaggccucgaauggauugggggaauaaauccaacuagcggcgguuccaacuuuaaugagaaguucaaaacgagggugaccaucacagucgacgaaucuacuaacaccgccuacauggagcuuucgucacugcggagcgaagauacagcguuuuauuucugugcucgccagggguugugguuugacagugauggacgaggcuucgacuuuuggggccagggguccaccgugacuguuucuagc

SEQ ID NO: 23539 - RNA, 342 nt, Artificial Sequence
  derived and/or modified sequence opt3 from Nimotuzumab_LightChain1
gacauccagaugacccaaagccccuccucucugucagccagugugggcgauagagucacaauuacuugcaggagcucccagaacauaguucacucuaaugggaacacguaccucgacugguaucagcagaccccuggaaaggcuccaaaacuucugaucuacaaggugucgaaucgguucucagguguaccgagccgcuuuaguggcuccgggucuggaacagauuucacuuuuaccauuagcuccuugcaacccgaggacaucgcaacauauuacuguuuccaguauucacaugugccuuggaccuuuggccaggguacuaaauuacagauuacacgagaa

SEQ ID NO: 23540 - RNA, 1320 nt, Artificial Sequence
  derived and/or modified sequence opt3 from Nivolumab_HeavyChain1
caggugcaacuggucgagagcggcgggggaguugugcagcccgguagaucccucaggcuugacugcaaggccucuggcaucaccuucucaaacagugggaugcacuggguacggcaggcuccuggaaaaggccuggaauggguggcagucauuugguacgaugguagcaagcgcuauuacgccgacuccgugaaagggcgauuuacaauaucucgugauaauucgaagaacacuuuguucuuacagaugaacucacugagagcggaggacacggcuguuuauuacugugccaccaaugaugacuauuggggacaaggcacacucgugacugucagcagugcauccaccaaaggcccaucuguguuuccgcucgcccccugcagcagguccacaucagaaaguaccgcugcacuggggugucuuguaaaggauuacuucccugagccaguuacugugagcuggaacucuggagcccugacauccgguguccauaccuuucccgcuguguugcagucaagcggccucuauagucugucuuccguggucacgguuccuagcucgucucuggggacuaagaccuacacaugcaauguggaccacaaaccauccaauacuaagguagauaaacggguggaaucaaaguacggacccccuuguccaccgugccccgccccugaguuccucggcgguccaagugucuuuuuauuucccccuaaaccaaaggacacccugaugaucagccgcacacccgaggugaccuguguuguggucgaugugucccaggaagacccggagguacaguucaacugguauguugaugggguggaaguccauaaugcgaagacgaaaccuagagaggagcaauucaacucuacuuacaggguggucagcgugcuuacaguuuugcaccaggacuggcugaauggaaaggaauauaaaugcaaggugucaaacaaaggccuacccaguuccauugagaagaccaucagcaaagcaaagggccagccacgggaaccucagguauacacucuacccccaucucaagaggaaaugacaaagaaucaggucucacugaccugucuugugaaaggguuuuaucccagugacauugccguugagugggagagcaacggacagccugaaaauaacuacaagacgaccccaccggugcuggauuccgacgguucuuucuuuuuguauucgcgccucacagucgauaaaagccgauggcaagagggcaacguguucuccugcucaguaaugcaugaagcucugcacaaucacuacacucagaagaguuuaucucugagccucgggaaa

SEQ ID NO: 23541 - RNA, 642 nt, Artificial Sequence
  derived and/or modified sequence opt3 from Nivolumab_LightChain1
gagaucgugcugacccagagccccgccacacucucccuuucuccuggcgaaagagcuacucugucaugcagggcaagucaaagcgucuccucuuacuuggccugguaucagcagaagccagggcaggcgccgcgguuacugauuuacgacgcuucgaaccgcgccacgggaauacccgcacgauucucagguagcggcagugggaccgauuuuacacuaacuaucuccucucucgagccugaagacuucgccguuuauuacugucaacagagcuccaauuggccacguaccuuuggacagggcacaaaaguggagauuaagagaaccguagcugcacccucaguguucaucuuuccuccaagugaugaacagcugaaaagcgguacugccucugucgugugccuucugaacaauuucuaucccagggaggcuaagguucaauggaaaguggacaacgccuugcaguccggaaauucacaggagagcgucacagaacaggauaguaaggacucuaccuacucccucagcucgacgcugacucugucuaaggcggauuaugagaaacacaagguguacgcaugugaaguaacccaucaagggcucuccucaccuguuacaaaaaguuuuaaccggggcgagugc

SEQ ID NO: 23542 - RNA, 1347 nt, Artificial Sequence
  derived and/or modified sequence opt3 from Obiltoxaximab_HeavyChain1
caggugcagcugcagcagagcggccccgagcucaagaaaccuggggccuccgucaagguuucuugcaaagacucaggauacgcuuucaguagcuccuggaugaacugggugagacaggcaccaggucaaggccuugaauggaucgggaggauuuauccgggagauggcgacaccaauuacaacgguaaguuucaggggcggguaacaauaacugccgauaaaucuucgucaacggcguauauggagcugagcaguuugcgcuccgaagacaccgcuguguacuucugugcccgaucuggauuacugcguuaugcaauggauuacuggggccagggcacucuagucacagugagcuccgccucaaccaaggggcccaguguuuuuccucucgcuccaagcucuaaguccacaucaggagguaccgcagcccugggcugccuugugaaagacuauuuccccgagccugucacugugagcuggaauaguggggcucugacaucuggaguacacaccuuuccagccguuuugcaguccagcggccucuacucgcugucuuccguggucacggugcccucaaguagccuggguacucaaaccuacaucuguaacgugaaucauaagccuuccaacacaaaagucgauaagaaaguugaaccaaagucuugcgacaagacucacaccuguccgcccugcccugcgccagagcucuuagggggacccagcguguuccuguuuccuccaaaacccaaggauacacuuaugauuucaagaaccccggagguaacguguguggucguggacguuagucaugaagauccugaggugaaauucaauugguaugucgacggcguggaaguacacaacgcaaagacuaaacccagggaggagcaguacaauuccacauaucggguugugagcgucuugaccgugcugcaucaggauuggcuaaacggcaaggaauacaaaugcaaggucucuaauaaggcccucccagcuccuaucgagaaaacuauuucaaaggccaaagggcagccccgcgaaccacaaguguauacacugcccccuaguagagacgagcuuaccaagaaccagguuagccugacguguuuggugaaaggauuuuacccauccgacaucgcaguagaaugggagucuaauggucagccggagaacaauuauaagaccacacccccuguccucgauucggacggcagcuucuuucuguacuccaaguuaacuguggauaaaucaagguggcaacaggggaacguuuucaguugcucugugaugcacgaagcucugcacaaccauuacacccaaaagagccucucccuuucaccaggaaaa

SEQ ID NO: 23543 - RNA, 642 nt, Artificial Sequence
  derived and/or modified sequence opt3 from Obiltoxaximab_LightChain1
gacauccagaugacccaaagccccuccucucugucagccagugugggcgaucgggucacaauuacuugcagggcuagccaggacauacggaacuaccucaauugguaucagcagaagccugggaaagcaguuaaacuucugaucuacuauacgucccgcuuguuaccaggagugccgucucgauucucggguucaggcagcgggaccgauuacagucugacaauuuccucucaagagcaggaagacaucggaacuuauuuuugucagcagggcaacacccuacccuggacauucggucaagggaccaagguagagauucguagaacuguggccgcgccuagcgucuuuaucuucccacccuccgaugaacagcucaagucaggaacagcuagugugguuugccugcuuaauaacuuuuacccuagggaggccaaagugcaguggaaggucgacaaugcacugcagagcggcaacucucaagaauccgugaccgagcaggauucaaaggacagcacguauaguuugucuuccacucucacccugagcaaagccgauuacgagaagcacaaaguauacgcuugugaaguuacacaucagggccugucgucuccagugacuaaguccuucaauagaggggagugc

SEQ ID NO: 23544 - RNA, 1347 nt, Artificial Sequence; identical to SEQ ID NO: 22948
  derived and/or modified sequence opt3 from Obinutuzumab_HeavyChain1

SEQ ID NO: 23545 - RNA, 657 nt, Artificial Sequence; identical to SEQ ID NO: 22949
  derived and/or modified sequence opt3 from Obinutuzumab_LightChain1

SEQ ID NO: 23546 - RNA, 1350 nt, Artificial Sequence
  derived and/or modified sequence opt3 from Ocaratuzumab_HeavyChain1
gaggugcagcugguccagagcggcgccgaaguuaagaaacccggggagucccucaagaucucuugcaaaggaucagguagaaccuucacaaguuacaacaugcacugggugaggcagaugccuggcaaggggcuugaauggaugggagcuauuuauccacugacuggcgacacgagcuacaaucagaaauccaaguugcagguaaccauaucugcagauaagucgaucucaacagccuauuuacaauggagcagucugaaagcguccgacacugcuauguacuauugugcccggucuaccuacguggguggggauuggcaguuugacgucuggggaaagggcacaaccgugacuguuagcuccgcaucaacaaaaggcccgaguguguucccccuagccccuagcucuaaguccaccucagggggaacggcugcacucgguugccuggucaaagauuauuuuccagagcccgugacuguaagcuggaacaguggcgcccuuaccucugggguucauacauucccugcugugcugcaguccagcggauuguacucgcucucuuccgucgugacugugccaucaaguagccugggcacccagacauacauuuguaaugucaaccacaagcccuccaauaccaagguugacaaaaagguggaaccuaaaucuugcgauaagacgcauacuuguccaccgugccccgccccugagcugcucggugggccaagcguauuuuuauuucccccuaaaaucaaggacacacugaugauuucacgcaccccagaggugacuugugucgugguugaugugagucacgaagaccccgaggucaaauucaacugguauguggauggaguagaaguucauaaugcgaagacaaagccgcgagaggagcaauacaacuccaccuaucguguggucagcgugcuuacggucuugcaccaggacuggcugaauggcaaagaauacaagugcaaagugucuaacaaggcacuaccugcccccaucgagaaaaccauaucaaagcagaagggccagccaagagaaccucaaguuuauacacugcccccaaguagggaugagcucacuaaaaaucaggugagccuuaccugucugguaaagggguucuaccccuccgacaucgcugucgaaugggagucuaacggacagccugagaauaacuauaaaacaacuccaccgguguuggacucggaugguagcuuuuuccucuacuccaagcugaccguugacaaaucacgguggcaacagggcaauguguuuaguugcucugucaugcacgaagccuuacauaaccacuacacacaaaagagccugucccucucacccggg

SEQ ID NO: 23547 - RNA, 639 nt, Artificial Sequence
  derived and/or modified sequence opt3 from Ocaratuzumab_LightChain1
gagaucgugcugacccagagccccggcacacucucccuuucuccuggggaaagagccacucugucaugcagggcuaguagcuccgucccauacauucacugguaucaacagaagccgggacaggcaccccgguuguuaauauacgccacgucugcgcuggcuucggguaucccugaccgcuucucaggcagcgggaguggaaccgauuuuacacuaacuauuucccgacucgagccagaagacuucgccguuuauuacugucagcaauggcugucuaaucccccuaccuuuggccaggguacaaaacuugagaucaagcguaccguggcagccccaagcguauucauuuuucccccuuccgaugaacagcugaaaucagggacugcuaguguggucugcuugcucaacaacuucuauccaagagaggcaaaggugcaguggaaaguugacaaugcccugcaaagcggaaacucucaggaguccgugacagaacaggauucaaaggacagcaccuacagucugucuuccacgcucacuuuaagcaaggcugauuaugagaaacauaaggucuacgccugugaagugacccaccagggccugucgucuccgguaacaaaauccuuuaauaggggcgagugc

SEQ ID NO: 23548 - RNA, 1356 nt, Artificial Sequence
  derived and/or modified sequence opt3 from Ocrelizumab_HeavyChain1
gaggugcagcuggucgaaagcggcgggggacucguucaacccgguggcucccuuagacugucuugcgccgcuucaggguacaccuucacaaguuauaacaugcacugggugaggcaggcaccuggaaagggcuuggaguggguaggugccaucuacccagggaauggagacacuagcuauaaccagaaauuuaagggccgguucacgauuuccguggauaaaucuaagaauaccuuauaccugcagaugaacucgcuacgcgcggaagacacagcugucuauuacugugcccgagugguuuauuacucaaauagcuacugguauuuugauguguggggccaagggacucucgucaccgugaguuccgcaucuacaaaaggaccgagcguauucccccuggccccuuccucaaagaguaccagcgguggcacugcugcacuugggugccugguuaaggacuacuuuccagagcccgugacagucucuuggaacuccggagccuugaccucaggcgugcauacguucccugcugugcuccagagcaguggucuguauucucuguccagcgucguuacugugccaucgucuucccucgggacccagacauacauauguaauguaaaccacaaacccucaaauacuaagguggauaaaaaggucgaaccuaaaaguugcgacaagacccauacauguccaccgugccccgccccugaguuacugggaggcccaagcguguuucuuuuucccccuaagccaaaagauaccuugaugaucucccguacgcccgagguuacuuguguggucguggacguaucucacgaagauccggagguuaaguucaacugguauguggacggcgucgaagugcauaaugcgaaaacaaagccuagagaggagcaguacaacagcaccuauagggucgugucaguucugacugugcuacaccaagauuggcucaaugggaaagaauacaagugcaaaguaaguaacaaggcacugcccgccccaauugagaagacaaucuccaaagcuaagggacagccucgggaaccccaggucuacacccuuccacccagccgcgaggaaaugacgaaaaaucaggugucucugaccuguuugguuaaggguuucuauccuucagacauugccguggagugggagaguaacggccaaccagaaaacaauuacaaaacaacuccgcccguccucgauagcgacggguccuuuuuccuguauucuaaguuaaccguggacaagucgagauggcagcagggaaacguauuuagcugcuccgugaugcacgaggcacugcauaaucacuacacacaaaaaucacucagucuuucuccuggcaag

SEQ ID NO: 23549 - RNA, 639 nt, Artificial Sequence
  derived and/or modified sequence opt3 from Ocrelizumab_LightChain1
gacauccagaugacccaaagccccuccucucugucagccagugugggcgauagagucacaauuacuugcagggcuagcuccucuguuucguacaugcacugguaucagcagaagccugggaaagcaccaaagccgcucauauacgcccccucaaaccuugcgagcggagugccuagucgguucuccgguucuggcagcgggacggacuuuacccugacaaucuccucauugcagccagaggauuucgcuacuuauuacugucaacaguggaguuuuaaucccccuaccuucggacagggcacaaaaguagaaauuaagcgcaccguggccgcaccaagcgucuuuaucuuucccccuucugacgagcaguuaaaauccgguacugccucagugguuugccugcuaaacaauuucuauccacgagaagcuaaggugcaauggaaggucgauaacgcacuccagagcgggaauagucaggagucugugacagaacaggacuccaaagauagcaccuacucgcugucuuccacgcuuacucugucaaaggccgacuaugagaaacauaagguauacgcuugugagguuacccaccaaggauugaguagcccggugacaaaauccuucaaccguggcgaaugc

SEQ ID NO: 23550 - RNA, 1356 nt, Artificial Sequence
  derived and/or modified sequence opt3 from Ofatumumab_HeavyChain1
gaggugcagcuggucgaaagcggcgggggacucguucaacccgguagaucccuuaggcugucuugcgccgcuucaggcuucaccuuuaacgacuacgcaaugcacugggugcggcaggccccugggaagggauuggaguggguaaguacaaucagcuggaauagcggcucuauugguuaugcggauucggugaaagggcgcuucacuauaucacgagacaacgcuaagaaauccuuauaccugcagaugaauagucuacgugccgaagauacggcacucuauuacugugccaaggacauccaguauggaaacuacuauuacggcauggaugucuggggccaagggaccacagugacuguuuccucugcuagcaccaaaggaccauccguguuuccgcuggcacccucaaguaagagcacaucugguggcaccgccgcucuugggugccuggucaaggacuacuucccugagccagugacuguauccuggaacucaggagccuugacaagcggcguucauaccuuucccgcggugcuccagaguucuggucuguauucccugagcucggucgugacggugccuucuuccucacucgggacucagaccuacauuuguaaugucaaucacaaaccaaguaacacaaagguugauaaaagaguggaacccaagagcugcgacaaaacucauaccuguccuccaugcccggcacccgaguuacugggaggcccuuccguauuccuuuuuccacccaagccuaaggauacauugaugaucucuaggaccccagaggugacgugugucgugguugacgugagccacgaagaucccgaggucaaauucaauugguauguggacggcguagaaguucauaacgccaagacuaaaccgcgggaggagcaguacaauucaacauaucgcguggucagugugcugaccguccuacaccaagauuggcucaacgggaaggaauacaaaugcaagguguccaauaaagcucugccugcccccauugagaagacuaucagcaaggcaaaaggacagccaagagaaccucagguuuauacacuucccccaucuagggaggaaaugaccaagaaccaggugucacugacguguuugguaaaagguuuuuaccccagugacauagcugucgagugggagagcaauggccaaccugaaaacaacuacaagaccacaccaccggugcucgacuccgaugggucuuucuuucuguauucgaaauuaacuguugacaagagccgguggcagcagggaaauguguucuccugcucagucaugcacgaggcccugcauaaccacuacacccaaaagagucucucucuuagccccggcaaa

SEQ ID NO: 23551 - RNA, 642 nt, Artificial Sequence
  derived and/or modified sequence opt3 from Ofatumumab_LightChain1
gagaucgugcugacccagagccccgccacacucucccuuucuccuggcgaaagagcuacucugucaugcagggcaagucaaagcgucuccucuuacuuggccugguaucagcagaagccagggcaggcgccgcgguuacugauuuacgacgcuucgaaccgcgccacgggaauacccgcacgauucucagguagcggcagugggaccgauuuuacacuaacuaucuccucucucgagccugaagacuucgccguuuauuacugucaacagcguagcaauuggccaauuaccuuuggacagggcacaagacuggagaucaaaaggaccguggcugcacccuccguauucauuuuuccuccaucagaugaacagcuuaagagugguacugccagcguggucugccuguugaacaauuucuauccccgggaggcuaaagugcaauggaagguugacaacgcccuccagucuggaaauucccaggagucagugacagaacaggauagcaaagacaguaccuacucucuguccagcacgcugacucucucgaaggcggauuaugagaagcacaaagucuacgcaugugaagugacccaucaaggguuaucuuccccuguaacaaagucauuuaaccgcggcgagugc

SEQ ID NO: 23552 - RNA, 1371 nt, Artificial Sequence
  derived and/or modified sequence opt3 from Olaratumab_HeavyChain1
cagcugcaacuccaggagagcggccccgggcuugugaagccuuccgaaacccugucuuugacaugcacugucucaggagguaguaucaacagcuccucuuacuauuggggcugguuaagacagucgccagggaaaggacuggaguggauuggcucauucuuuuacacggguagcaccuauuacaauccgagucuaaggucccggcucacaauaucuguugacacuagcaagaaccaguucucccugaugcuuucaagugugaccgccgcugauacagcaguauauuacugugcccgccaaagcaccuauuacuacgggucuggaaauuauuacggcugguuugaccgaugggaucagggcacucuggugacagucuccucagcgagcaccaaagggcccaguguguucccuuuggcuccaucuuccaagagcacgucgggagguacugccgcacucggcugccugguuaaagacuauuuucccgaaccugugaccgucucuuggaacuccggggcccugacaucaggagugcacacuuucccagcuguacuccagaguagcggcuuauacucccugucuagcguugugaccguccccucaaguucccuugguacacagaccuauaucuguaaugugaaccauaagccuagcaauacgaagguggauaaacgugucgagccaaagucuugcgacaaaacucacacauguccgcccugcccugcaccagaauugcucgggggacccucaguuuuucuauucccuccaaagcccaaagauacccucaugauuaguagaacuccggaggugacauguguaguggucgacgugagccaugaggauccugaaguuaaguuuaacugguacguggacggcgucgaggugcacaaugccaagaccaaacccagggaggaacaauauaacuccacguaccggguaguuucugugcugaccguccuucaucaggauuggcugaauggcaaggaguacaaaugcaaggugucgaacaaagccuugccagcuccuaucgaaaagacaauuagcaaagcgaaggggcagccccgcgagccacaggucuauacucugcccccuuccagagaagagaugaccaagaaucaagugucacugacauguuuaguuaaaggauucuacccaagugacaucgcaguggaaugggagucuaacggucagccggagaauaacuauaagacuacacccccuguacuggauagcgacggcuccuuuuuccucuacucaaaacuuaccgucgacaagucuagguggcagcaagggaacguguuuagcugcuccguuaugcacgaagcccugcacaaucauuauacccagaaaaguuugagccuaucuccaggaaag

SEQ ID NO: 23553 - RNA, 642 nt, Artificial Sequence
  derived and/or modified sequence opt3 from Olaratumab_LightChain1
gagaucgugcugacccagagccccgccacacucucccuuucuccuggcgaaagagcuacucugucaugcagggcaagucaaagcgucuccucuuacuuggccugguaucagcagaagccagggcaggcgccgcgguuacugauuuacgacgcuucgaaccgcgccacgggaauacccgcacgauucucagguagcggcagugggaccgauuuuacacuaacuaucuccucucucgagccugaagacuucgccguuuauuacugucaacagcguagcaauuggccacccgcuuuuggacagggcaccaaaguggagauuaagagaacaguagcagccccuuccguguucaucuuuccacccucagaugaacagcugaaaagugguaccgcuagcgucgugugccuucugaacaauuucuauccuagggaggccaagguucaauggaaaguggacaacgcguugcagucuggaaauucccaggagucagucacugaacaggauagcaaggacaguacauacucucucuccagcacccugacgcugucgaaggcagauuaugagaaacacaagguguacgccugugaaguaacucaucaagggcucucuuccccaguuaccaaaucauuuaaccggggcgagugc

SEQ ID NO: 23554 - RNA, 1341 nt, Artificial Sequence
  derived and/or modified sequence opt3 from Olizuab_HeavyChain1
gaggugcagcuggucgaaagcggcgggggacucguucagcccgguggcucccuuagacugucuugcgccgugucaggguacaguaucaccagcggauauuccuggaacuggauuaggcaggcuccuggcaaggguuuggaguggguagcaucuauaacauacgacgggucgacuaauuauaacccaucagugaaaggacggaucacgauuagccgcgaugacaguaagaauaccuucuacuuacagaacucccugcgagccgaagauacagcggucuauuacugugcucguggcucucacuauuuuggccauuggcacuucgccgugugggggcagggaacucuaguuaccgugagcuccgcaucaacaaaagguccgagugucuuuccccucgccccuagcucuaaguccaccucaggcgggacugcugcacugggaugccuugugaaagacuacuucccagagcccguaacaguuagcuggaauaguggcgcccugaccucuggugugcauacguuuccugcugucuugcaauccagcgggcucuacucgcugucuuccguggugacugucccaucaaguagccugggaacccagacauauaucuguaacguuaaucacaagcccuccaacacuaagguggauaaaaagguagaaccuaaaucuugcgacaagacccauacauguccaccgugccccgccccugagcucuuaggcggcccaagcguguuccuguuucccccuaaaccaaaggauacccuuauuucaagaacgcccgaggucacuugugugguuguggacgucagucacgaagauccggaggugaaguucaauugguacguagacgggguugaagugcacaacgcgaaaacaaagccuagggaggagcaguauaauuccaccuaccgggucgugagcgucuugacugugcugcaucaggauuggcuaaacggaaaagaauauaagugcaaaguuucuaauaaggcacuccccgccccaaucgagaaaacaauaucaaaggcuaagggucaaccucgcgaaccccagguguacacccugccacccaguagagaggaaacgaaaaaccagguaagccuuaccugucuggucaagggcuuuuauccuuccgacaucgccguggagugggagucuaaugggcagccagaaaacaacuacaaaacaacuccgcccguuuuggauucggacggcagcuucuuucucuacuccaagcugaccguggacaaaucaagguggcaacagggaaaugucuucaguugcucugugcacgaggcauuacauaaccacuauacacaaaagagccugucccucucaccugguaag

SEQ ID NO: 23555 - RNA, 651 nt, Artificial Sequence
  derived and/or modified sequence opt3 from Olizuab_LightChain1
gacauccagcugacccaaagccccuccucucucucagccagugugggcgauagagucacaauuacuugcagggcuagccaguccguugacuacgauggggacucuuauaacugguaccagcagaagccuggaaaagcaccaaaacuucugauauaugccgcgucguacuuggagucaggugugccgagccgguucaguggcuccgggucuggaacggauuuuaccuuaacaaucagcucccugcaacccgaagacuucgcuacuuauuacugucagcagucacacgaggauccuuauaccuuuggccaggguacaaaaguagaaauuaagcgcaccguggccgcaccaagugucuucaucuuucccccuagcgacgagcaacuaaaaucugggacugccuccgugguuugccuccugaauaacuucuacccacgagaagcuaaggugcaguggaaggucgauaaugcacuucagucaggaaacagccaggagagugugacagagcaagacucuaaagauuccaccuacagccugucgucuacguugacucucuccaaggccgacuaugaaaaacauaagguauacgcuugugagguuacccaccagggccugucaagucccgugacaaagagcuuuaaucguggcgaaugc

SEQ ID NO: 23556 - RNA, 1341 nt, Artificial Sequence
  derived and/or modified sequence opt3 from Olokizumab_HeavyChain1
gaggugcagcuggucgaaagcggcgggggacucguucaacccgguggcucccuuagacugucuugcgccgcuucaggguucaacuuuaaugacuacuucaugaacugggugaggcaggcaccuggaaagggcuuggaguggguagcccagaugcggaauaaaaacuaucaguacgguaccuauuacgcggaaaguuuagaggggcgcuuuacaaucagccgagaugacuccaaaaauucucuguaucuacaaaugaacucgcucaagacugaagauacggcuguguacuauugugcccgugagucauacuacggauucaccagcuauuggggccagggcacacuggucacugugaguuccgcaucuaccaaggggccaagcguuuuuccgcuugcccccugcuccagaucaacaagugagagcaccgcugcacugggauguuuggugaaagacuacuucccugaaccagucacugugucuuggaacuccggugcccucacaucaggcguacacaccuuucccgcuguucugcagagcagugggcuguauucucucuccagcguggucacggugccuucgucuuccuuaggaacuaagaccuacacaugcaauguggaucauaagccaucaaauacuaaagucgacaagaggguugagaguaaauauggucccccuuguccaccgugccccgccccugaguuccugggcgggccaagcguguuucuuuuucccccuaagccaaaagauaccuugaugauuucccggacacccgagguaaccuguguggucguggacguuucucaggaggauccggaagugcaauuuaacugguacgucgacggaguggagguacacaaugcgaagacgaagccucgcgaagaacaguucaacagcacuuauagaguugugucaguccugacagugcuacaucaggauuggcucaauggcaaagaauacaagugcaaagucaguaacaagggccugcccuccagcauagagaaaaccaucucuaaggcaaaagggcagccaagggagccucaaguguacacucuucccccaucacaggaagagaugacaaagaaucagguuagucugaccuguuuggugaagggauuuuaucccagcgacauugccguagaaugggaguccaacggucaaccugaaaacaauuacaaaacgaccccaccgguccucgauucugacggcucguucuuccuguauagccgguuaacaguggacaagucccgcuggcaggaggggaacguuuucucaugcagugugaugcacgaggcucugcauaaucacuacacucagaaaucucucagccuuucccugggaaag

SEQ ID NO: 23557 - RNA, 642 nt, Artificial Sequence
  derived and/or modified sequence opt3 from Olokizumab_LightChain1
gacauccagaugacccaaagccccuccucucugucagccagugugggcgauagagucacaauuacuugccaggcuagccaggacauagggaucucccucucuugguaccagcaaaagccuggaaaagcaccaaaacuucugauuuauaacgccaauaacuuggcggaugguguuccgucgagguucucaggcagcgggaguggaacggacuuuaccuuaacaaucuccucucugcagcccgaggauuucgcuacuuacuauugucuacagcacaauagcgccccuuacaccuuuggccaggguacaaagcucgaaauuaagcggaccguggcagccccauccguauucaucuuucccccuucagacgagcaacugaaaagugggacugcuagcguggucugccuucugaacaauuucuauccacgcgaagcaaaggugcaguggaagguugauaacgccuugcagucuggaaauucccaggagucagugacagaacaagacagcaaagauaguaccuacucucucuccagcacgcugacucugucgaaggcugacuaugagaaacauaaggucuacgccugugaggugacccaccagggccucucuucccccguaacaaaaucauuuaaccgaggcgaaugc

SEQ ID NO: 23558 - RNA, 1341 nt, Artificial Sequence
  derived and/or modified sequence opt3 from Omalizumab_HeavyChain
gaggugcagcuggucgaaagcggcgggggacucguucaacccgguggcucccuuagacugucuugcgccgugucaggguacaguaucaccagcggauauuccuggaacuggauuaggcaggcuccuggcaaggguuuggaguggguagcaucuauaacauacgacgggucgacuaauuaugccgauucagugaaaggacgguucacgaucagccgcgacgauaguaagaacaccuuuuacuuacagaugaacucccugcgagcggaagacacagcugucuauuacugugcccguggcucucacuauuucggccauuggcacuuugcagugugggggcagggaacucuaguuaccgugagcuccgguccaucagucuucccgcucgcccccaguagcaaaucuacauccggcgggaccgcugcacugggaugccuugugaaggauuacuuuccugagccaguaacuguuucauggaauagcggcgcccugacaaguggugugcauaccuuccccgcugucuugcaaucuuccgggcucuacagccugucgucuguggugacggucccuuccucaagucugggaacucagaccuauauuuguaauguuaaccacaaaccaagcaauacaaagguggacaagaaagccgaacccaaguccugcgauaaaacucauaccuguccuccaugcccggcgcccgagcucuuaggcggcccuucuguauuucuguucccacccaagccuaaagacacacuuaugaucagcagaaccccagaggugacgugugucgugguugaugugucacacgaagaccccgaggucaaguuuaacugguacguggaugggguagaaguucacaaugcaaagacuaaaccgagggaggagcaguauaacaguacauaccggguggucuccguguugaccguccugcaucaggacuggcuaaauggaaaggaauauaaaugcaaggugagcaacaaagcccucccugcucccauugagaagacuaucucuaaagccaagggucaaccacgcgaaccucagguuuacacacugcccccaucaagagaugagcuuaccaagaaucaggugagucugacguguuugguaaaaggcuucuaucccagcgacauagcagucgaaugggaguccaacgggcagccugagaauaacuacaagaccacaccaccggugcucgacucugauggaucguuuuuccuguacagcaaauuaacuguugacaaguccagguggcaacagggcaacguguuuucaugcagugucaugcacgaagcucugcauaaucacuauacccagaaaucucucagccuuucccccgguaag

SEQ ID NO: 23559 - RNA, 645 nt, Artificial Sequence
  derived and/or modified sequence opt3 from Omalizumab_LightChain
gacauccagcugacccaaagccccuccucucucucagccagugugggcgauagagucacaauuacuugcagggcuagccaguccguugacuacgauggggacucuuauaugaacugguaccagcagaagccuggaaaagcaccaaaacuucugauauaugccgcgucguacuuggagucaggugugccgagccgguucaguggcuccgggucuggaacggauuuuaccuuaacaaucagcucccugcaacccgaagacuucgcuacuuauuacugucagcagucacacgaggauccuuauaccuuuggccaggguacaaaaguagaaauuaagcgcaccguggccgcaccaagugucuucaucuuucccccuagcgacgagcaacuaaaaucugggacugccuccgugguuugccuccugaauaacuucuacccacgagaagcuaaggugcaguggaaggucgauaaugcacuucagucaggaaacagccaggagagugugacagagcaagacucuaaagauuccaccuacagccugucgucuacguugacucucuccaaggccgacuaugaaaaacauaagguauacgcuugugagguuacccaccagggccugucaagucccgugacaaagagcuuuaaucgu

SEQ ID NO: 23560 - RNA, 1347 nt, Artificial Sequence
  derived and/or modified sequence opt3 from Onartuzumab_HeavyChain1
gaggugcagcuggucgaaagcggcgggggacucguucaacccgguggcucccuuagacugucuugcgccgcuucaggguacaccuucacaaguuauugguugcacugggugaggcaggcaccuggaaagggcuuagaguggguagguaugaucgacccaagcaacuccgauacucgguuuaauccgaacuucaaagaccgcuuuacgauuucugccgauaccucgaagaauacagcguaccugcagaugaacucacuacgagcugaagacacugccguguauuacugugcaaccuaucguagcuacgucacaccccucgauuauugggggcagggaacccuggugacuguuaguuccgccucuacaaaaggcccuagcguguucccacuugcucccuccucaaagaguaccagcggcgggacggcagcccugggaugcuuggucaaagacuacuuuccugagccagugacuguaucuuggaauagcggugcucucaccucaggcguucauacauuccccgccgugcugcaaagcagugggcuguacucucucuccagcgucgugacugugccuucgucuuccuuaggaacccagacauauauauguaacgucaaucacaagccaucaaacaccaagguugauaaaaagguggaaccgaaaaguugcgacaagacgcauacuugucccccuugcccagcgcccgagcugcuuggcgguccuagcguauuuuuguucccacccaaaccgaaggauacacugaugaucuccagaaccccugaggugacuugugucgugguugacgugucucacgaagaucccgaggucaaguuuaauugguacguggacgggguagaaguucauaacgcaaaaacaaagccaagggaggagcaguauaauagcaccuaccggguggucucagugcuaacgguccuccaccaggauuggcugaacggaaaagaauauaagugcaaagugaguaauaaggcccuuccugcucccauugagaaaaccaucuccaaggccaagggccaaccacgcgaaccccagguuuacacacugccuccaagcagagaggaaaugacuaaaaaccaggugucuuugucaugugcaguaaagggcuucuauccgagugacauugcugucgagugggagagcaaugggcagcccgaaaacaacuacaaaaccacaccuccagugcucgacuccgauggaucguuuuuccugguuucuaaguuaacuguggacaaauccagguggcaacaggguaaugucuuuuccugcucagugaugcacgaggcccugcauaaccacuacacccagaagagucucucucuuagccccggcaag

SEQ ID NO: 23561 - RNA, 681 nt, Artificial Sequence
  derived and/or modified sequence opt3 from Onartuzumab_HeavyChain2
gacaagacccacacaugucccccuugcccagccccggagcugcucggcgggcccagcguguuccuuuuuccuccaaaacccaaggauacucugaugaucuccagaacgccugaaguuaccugcgucgugguagacgugucucaugaggauccagaagucaaauucaacugguacguggacggaguugaggugcacaaugcuaagacaaaacccagggaagaacaguauaacucaacuuaccgggucgugaguguauugaccguuuuacaucaagauuggcugaaugguaaggaguauaaguguaaagugagcaacaaggcacuaccugccccaauugagaaaacaauauccaaggcgaaaggccagccgcgcgagccccaggucuacacccucccuccaucucgagaagagaugacuaagaaucaggugucgcuguggugccuugugaagggguuuuaucccucagacaucgcugucgagugggaaagcaacggacaaccugagaauaacuacaaaacaaccccacccguucuggauagugacggcuccuucuuuuuguauucuaagcucacgguggauaaaagccguuggcagcaggguaauguauucuccuguucagugaugcacgaagcccugcauaaccacuacacucagaagagucugagccucucuccggggaaa

SEQ ID NO: 23562 - RNA, 660 nt, Artificial Sequence
  derived and/or modified sequence opt3 from Onartuzumab_LightChain1
gacauccagaugacccaaagccccuccucucugucagccagugugggcgauagagucacaauuacuugcaagagcucccagucucuccuuuacacgucgucacagaaaaacuaucuggcuugguaccagcaaaagccugggaaagcaccaaaguuguuaauauauugggccagcaccagggagaguggaguuccgucccgguucucugguagcggcuccgggacagacuuuacucugaccaucucaagucuacagcccgaagauuucgcgacauacuauugucagcaguacuaugcuuacccuuggaccuuuggacaaggcacuaaaguggagauuaagcgcacaguagccgcaccaagcguguucaucuuucccccuucugacgaacagcucaaguccgguaccgccucagucgugugccugcuuaauaacuucuacccacgagaggcuaaaguucaguggaagguggauaaugcacugcagagcgggaacagucaagaaucugucacggagcaggacuccaaagauagcacuuauucguugucuuccacccucacacugucaaaggccgacuacgagaaacacaagguguaugcuugugaaguaacucaucagggacugaguagccccguuaccaaguccuuuaaucguggcgagugc

SEQ ID NO: 23563 - RNA, 1362 nt, Artificial Sequence
  derived and/or modified sequence opt3 from Ontuxizumab_HeavyChain1
caggugcaacugcaggagagcggccccgggcucgucagaccuucccagacccuuucucugacaugcacugccucaggauacacguucaccgacuauguuauccacugggugaagcagccaccggguaggggcuuggaauggauuggguacauaaaccccuaugaugacgauacaacuuacaaucaaaaauuuaagggacggguaaccauguuaguggacacaaguagcaacaccgcuuaucugcgccuauccucugucacugcagaggauacagccguguacuauugugcgcgacguggcaauucguacgacgguuacuucgauuauucaauggacuacugggggagcggaaccccuguuacggugaguuccgcuucuacuaaaggcccaagcgucuuuccccucgccccuuccucaaagaguaccagcggcgggacagcagcccugggaugccuugugaaagauuauuucccagaacccguaacuguuucuuggaacuccggugcucugaccucaggcgugcauacauuuccugcagucuugcagagcagugggcucuacucucuguccagcguggugaccgucccaucgucuucccugggaacgcagacuuauaucuguaauguuaaccacaagccgucaaauacaaagguggacaaaaagguagagcccaaaaguugcgauaagacccauacuuguccuccaugccccgccccugaacucuuaggcgguccaagcguguuccuguuucccccgaaaccuaaggacacacuuaugauuuccagaacccccgaggucacgugugugguuguggaugucucucacgaggacccagaagugaaguucaacugguacguagacgggguugaggugcauaaugcuaaaaccaagccuagggaagaacaguauaacagcacauaccgggucgugucagucuugacugugcugcaccaagauuggcuaaauggaaaagaguacaagugcaaaguuaguaacaaggcccuccccgcgccaaucgagaaaaccauuuccaaggcaaagggccagccccgcgagccucagguguauacacugccaccgagcagagacgaacuuacuaaaaaucagguaucucugaccuguuuggucaagggcuuuuaccccucagauaucgccguggagugggaaaguaacgggcaaccugagaauaacuauaaaacaaccccacccguucucgacagcgauggauucuuuuuccuguacuccaaguuaacuguggacaaaucuagguggcagcaggguaacgucuuuucgugcagcgugaugcacgaggcucugcauaaucacuauacgcaaaagucccucucacuuaguccuggcaag

SEQ ID NO: 23564 - RNA, 645 nt, Artificial Sequence
  derived and/or modified sequence opt3 from Ontuxizumab_LightChain1
gacauccagaugacccaaagccccuccucucugucagccagugugggcgauagagucacaauuacuugcagggcuagccagaacguugggacggcaguggccuggcuccagcagaccccuggaaaggcgccaaaacuucugauauacuccgcuucuaaucgguauacagguguaccgucgcgcuucucaggcagcgggaguggaacugacuacaccuuuacaaucuccucuuugcaacccgaggauauugccaccuauuacugucagcaguauacuaacuacccuauguauacauucggccaggguaccaaggugcaaaucaaacgaacggucgcagccccaagcguguuuauuuuucccccuuccgacgaacaguuaaagucagggacugcuaguguugugugccugcuaaauaacuucuacccacgugaggcaaaaguccaguggaagguggauaaugcccuccagagcggaaacucucaagaauccguaaccgagcaggacucaaaggauagcacauacagucugucuuccacucuuacccugagcaaagcugacuaugaaaagcacaaaguuuacgccugugaggugacacaucagggcuugucgucucccgucaccaaguccuucaauagaggcgagugc

SEQ ID NO: 23565 - RNA, 1341 nt, Artificial Sequence
  derived and/or modified sequence opt3 from Opicinumab_HeavyChain1
gaggugcagcugcucgaaagcggcgggggacuuguccaacccgguggcucccugagauugucuugcgccgcuucaggguucaccuuuagugcauacgagaugaaguggguuaggcaggccccuggaaaaggcuuagaaugggugagcguaaucgguccauccgggggauucacauuuuaugcggacucugugaagggccgguucacuauuucgcgcgauaacagcaaaaauacgcuguaccuacagaugaacucacuccgagcugaggacaccgccgucuauuacugugcaacagaaggcgauaaugacgccuuugauauaugggggcagggaacuaccgugacaguuaguuccgcuucuaccaaggguccgagcguguucccccuggcaccuuccucaaaaaguacuagcggcgggacagccgcucuuggaugccuggucaaggacuauuuuccagagcccgugaccguaucuuggaacuccggcgccuugacgucagguguucacacuuucccugcggugcuccaaagcagugggcuguacucucuguccagcgucgugaccgugccaucgucuucccucggaacacagacuuauaucuguaaugucaaccauaagcccucaaauaccaaaguugauaagaaaguggagccuaagaguugcgacaaaacacacaccuguccaccgugccccgcaccugaauuacugggcggcccaagcguauuucuuuuucccccuaagccaaaggauacguugaugauuucccguacucccgaggugacaugugucgugguugacgugucucaugaagauccggaggucaaauucaacugguacguggacgggguagagguucacaaugccaagaccaaaccuagagaggaacaguacaacagcgcuuauaggguggucucagugcugacuguccuacaucaggauuggcucaauggaaaggaauacaaaugcaaggugaguaacaaagcccugcccgcaccaaucgagaagacaauuuccaaggcuaaaggucaaccucgggaaccccagguuuauacccuuccacccagccgcgacgagcugacgaagaaucaggugucuuugaccugucucguaaaaggcuucuacccuucagacaucgccgucgagugggaaaguaacgggcagccagagaauaacuauaagacaacuccgcccgugcuggauagcgacggauccuuuuucuuauacucuaaacugaccguugauaagucgagauggcaacagggcaacguguucagcugcuccgucaugcacgaagcgcuccacaaucauuauacacagaagucacuuagucugucuccuggu

SEQ ID NO: 23566 - RNA, 645 nt, Artificial Sequence
  derived and/or modified sequence opt3 from Opicinumab_LightChain1
gacauccagaugacccaaagccccgccacacugucccucucuccuggcgagagagcuacucuuucaugcagggcaagucagagcguguccucuuaccuggccugguaucagcagaagccagggcaagcgccgcgguuguuaauuuacgaugcuucgaaccgcgccacgggaauacccgcacgauucucagguagcggcagugggaccgacuuuacacugacuaucuccucucuagaaccugaggauuucgccgucuauuacugucagcagcguagcaauuggccaauguauaccuuuggacagggcacaaaacucgaaauuaagagaaccguugcugcacccuccguguucaucuuuccuccaucagacgagcaacugaaaagugguacugccagcguagugugccuucugaacaauuucuaccccagggaagcuaagguccaguggaaaguggauaacgccuugcagucuggaaauucccaggagucaguuacagagcaagacagcaaggauaguaccuauucucucuccagcacgcugacucugucgaaggcggacuacgaaaaacacaagguguacgcaugugaggucacccaucaggggcucucuuccccugugacaaaaucauuuaaccggggcgaaugc

SEQ ID NO: 23567 - RNA, 1941 nt, Artificial Sequence
  derived and/or modified sequence opt3 from Oportuzumab_monatox_HeavyChain1
caccaucaccaucaccaugacauccagaugacccaaagccccuccucucugucagccagugugggcgauagagucacaauuacuugcaggagcacgaagucccuccuucacucuaacgggauaaccuaccuguauugguaccagcagaaaccuggaaaggcuccaaaauuguuaaucuaucagaugucgaaucuggcaucagguguuccgagccgguucaguuccucuggcagcgggacagacuuuacucuaaccauuuccucacuccaacccgaggauuucgccacauacuauugugcgcagaaccuggaaaucccucgcaccuuuggacagggcacuaagguggagcuuaaacgagcuacaccaagucacaauagccaucagguacccucugccggugggccuaccgcaaacuccggaacgucaggcagcgaagugcaacugguccagaguggcccaggguuggugcagcccggagguucuguucguauuuccugcgccgcuagcggcuacacuuucaccaauuaugggaugaacugggugaagcaggcaccuggaaagggccucgaguggauggguuggaucaauacauacacuggggaaucgaccuacgccgacucuuuuaaaggaagauucacauuuucccuggauaccucagcuagugccgcguaucugcaaauaaacagccucagggcagaggacacggccgucuacuauugugcucgguucgccaucaagggcgauuacuggggccaggggacuuuacugacaguguccucugaguuuggaggugcaccagaguucccgaaacccagcaccccuccaggcucaagugggcuugaaggaggcuccuuggcugcccugacugcgcaccaggccugccaucuaccccucgaaacauuuacccgccacagacaaccuagggguugggagcagcuggagcaguguggguauccaguacagcggcuuguugcacuguacuuggcugcccgccucagcuggaaucaaguggaccaggucauucgaaacgcucuggccucucccggcucaggaggcgauuuaggggaagcaaucagagagcagccggaacaggccaggcuggcucucacgcuugcggcagccgagagugaacgguucgugcgucaaggaaccgguaaugacgaggcuggcgccgcaagcgccgauguggucucccugacaugcccuguugcugccggggagugugcaggacccgcggacucuggcgaugcuuugcuagaacgcaacuauccaacuggugccgaguuucugggggacggcggagacgugucguucagcaccagaggcacacagaauuggacuguagaaaggcuccugcaggcacaccggcagcuugaggaacgaggguacguguucgucggauaccaugguaccuuucuggaggccgcucaauccauuguguucggcgggguucgcgccagaucacaggauuuggacgcaaucuggaggggauuuuauauagcuggcgauccugcccucgcguacgguuaugcccaggaccaggagcccgaugcucgggggcgcauuagaaacggcgcacuguuaaggguguacgucccacguaguucucugcccggauucuaucggacaggccuaacccucgccgcuccugaagccgcaggggagguggaacgacugaucggacacccacuuccguugagacuggacgcgauuacuggccccgaggaagagggugggaggcucgagacgauccugggauggccucuugccgaacgcacaguaguuaucccaagcgcuauucccaccgauccucggaaugugggcggugaccuggauccauccucaauacccgacaaggagcaagccaucagcgcauugccggauuacgcuucucagccuggcaaaccaccccaucaccaucaccaccauaaggacgaacuc

SEQ ID NO: 23568 - RNA, 1941 nt, Artificial Sequence; identical to SEQ ID NO: 23567
  derived and/or modified sequence opt3 from Oportuzumab_monatox_SingleChain_variable_fragment

SEQ ID NO: 23569 - RNA, 762 nt, Artificial Sequence
  derived and/or modified sequence opt3 from Oreptacog_alfa_HeavyChain1
aucgugggcgggaaggucugccccaagggagaguguccuuggcagguucugcuccuugugaacggugcccaacugugcggcgggaccuugauuaauacaauauggguagugagcgcugcacacuguuucgacaagaucaaaaacuggagaaauuuaauugccguccugggagaacaugaucuauccgagcacgacggcgaugaacagucuaggcggguggcgcagguuaucauuccaucaacuuacgugccggguacgaccaaccaugacaucgcucuccugcgccuucaccagcccgucaaucugacagaucaugugguaccuuugugccucccagagcgaacuuuuagugaacguacccuggccuucguuagauuuagccugguguccggguggggacaacucuuagacaggggcgcaacagcccuggagcuuauggucuugaacgugccccggcugaugacccaggauugucuacagcagucucgcaaggugggcgacucgccuaauauaacugaguauauguucugcgcuggguacucagauggaagcaaagacaguuguaagggugauuccggcgggccacacgcaacacacuauagaggaaccugguaccucacgggcaucgucucuuggggucaagggugcgccacuguuggacauuuuggcguguauaccaggguaagccaguacauugaauggcugcagaaacuuaugcgguccgagccccgcccuggcgugcuguugcgagcuccauucccg

SEQ ID NO: 23570 - RNA, 456 nt, Artificial Sequence
  derived and/or modified sequence opt3 from Oreptacog_alfa_LightChain1
gccaacgcuuuccuggaggaacucagacagggcagccuugagagggaaugcaaggaggaacaauguuccuuugaggaggcacgggaaaucuucgaggacgaagaggagaccaaacuguuuuggauuucuuacucagauggggaccagugcgccaguagccccugucagaauggagguuccugcaaggaucaguugcaaucuuauauauguuucugcuuaccugcguuugaaggccgcaacugugagacacacaaagacgaucagcugaucugcgugaaugaaaacgggggaugugagcaguacugcucggaccauaauggcacuaagcgaucaugucguugccacgaagguuauagccuacucgcugauggggucaguugcacgccaaccguugaguacccguguggaaaaauucccauccuggagaagagaaacgccuccaagccucagggcagg

SEQ ID NO: 23571 - RNA, 1353 nt, Artificial Sequence
  derived and/or modified sequence opt3 from Orticumab_HeavyChain1
gaggugcagcugcucgaaagcggcgggggacuuguccaacccgguggcucccugagauugucuugcgccgcuucaggguucaccuuuaguaacgcauggaugagcuggguuaggcaggccccuggaaagggcuuagaguggguguccucuaucucgguaggugggcaccggacauacuaugcggacucagugaaaggacgcagcacuauuagucgagauaauuccaagaacacgcuguaccuacagaugaauagccuccgugcugaagacaccgccgucuauuacugugcaagaauaagggugggcccaucuggcggggccuucgauuauuggggacaggguacacugguuacuguguccucagcuaguaccaaaggcccgagcgucuuuccccuugcaccuucuuccaagucaacaagcgggggaaccgccgcucugggcugcuuggugaaagacuacuucccagagcccguaacuguuaguuggaacucuggugcccucacauccggggugcauaccuuuccugcgguccugcaaagcucgggacuguauucucucuccucaguggugacggucccaaguagcuccuuaggcacucagaccuacaucuguaauguuaaccacaagcccucuaauacaaagguggauaaaaagguagaaccuaaaagcugcgacaagacucauaccuguccaccgugccccgcaccugagcugcuuggcgggccaucaguguucuuguuucccccuaaaccaaaggauacacugaugauuagucggacccccgaggucacgugugugguuguggacgucucccacgaagauccggaggugaaguucaacugguacguagacggaguugaagugcauaaugccaaaacuaagccucgcgaggagcaguauaacagcacauacagagucgugucuguccuaaccgugcuccaccaggauuggcugaaugguaaagaauauaagugcaaaguuucaaacaaggcccuucccgcuccaaucgagaaaacuauuaguaaggcaaagggccaaccuagggaaccccagguguacacacugccacccagccgggacgaguugaccaaaaaucagguaucccucacgugucuggucaagggguuuuauccuucugauaucgcuguggaaugggagucgaacggacagccagagaauaacuacaaaaccacaccgcccguuuuagacagcgacggcuccuucuuucuguauucaaagcucacuguggauaaaagucgcuggcaacaggguaacgucuucucuugcagcgugaugcacgaagcccuucauaaucacuacacccagaagucccugucauugagcccugggaag

SEQ ID NO: 23572 - RNA, 648 nt, Artificial Sequence
  derived and/or modified sequence opt3 from Orticumab_LightChain1
cagagcgugcugacccaacccccuuccgccucuggcacaccagggcagagagucacuaucucaugcaguggaagcaacacgaauauugguaagaacuacguuuccugguaucagcagcucccgggcaccgcucccaaacuucugauauacgcaaauucuaacaggccuucgggggugccagaccgguucucaggaagcaagaguggcacauccgccucuuuggcgaucagcgguuuacgcuccgaggaugaagcugacuauuacugugccucaugggaugcaagucugaauggguggguauuuggaggcggcacuaaacuaaccgugcucgggcaacccaaggccgcuccuagcgucacacuguucccacccucuuccgaggaacuucaggcaaacaaagccacccuggugugcuugauuucagacuuuuauccuggagcuguuacuguggccuggaaggcggauagcaguccagucaaggccgguguggagacaaccacgccgucuaaacaguccaauaacaaguacgcagcuagcucguaucucucucugacucccgaacaguggaaaucccaccgaucauacaguugucaaguaacccaugagggcagcacaguugagaagacuguggccccuaccgaaugcucc

SEQ ID NO: 23573 - RNA, 1347 nt, Artificial Sequence
  derived and/or modified sequence opt3 from Otelixizumab_HeavyChain1
gaggugcagcugcucgaaagcggcgggggacuuguccaacccgguggcucccugagauugucuugcgcugcuucaggguucaccuuuaguagcuucccuauggcauggguuaggcaggccccaggaaagggcuuagaguggguguccacaaucucuacuucgggugggcggacguacuaucgcgacucaguaaaaggacgauuuaccauuagccgugauaacaguaagaauacacuguaccuacagaugaacucccucagagcggaagacacugcuguguauuacugugccaaauucaggcaguauucuggcggcuuugauuacugggggcaaggaacccuggucacagugagcuccgcaucaaccaaggguccgaguguuuucccccuugccccuagcucuaaauccacuucaggcgggacagcugcacugggaugcuuggugaaggacuauuuuccagagcccgucaccgugagcuggaauaguggcgcccucacgucugguguacacacuuucccugcuguucugcaguccagcgggcuguacucgcucucuuccguggucaccgugccaucaaguagcuuaggaacacagacuuacauauguaacgugaaucauaagcccuccaacaccaaagucgauaagaaaguugaaccuaagucuugcgacaaaacacacaccuguccaccgugccccgccccugagcugcuuggcggcccaagcguguuuuuguuucccccuaagccaaaggauacgcugaugaucucacggacucccgagguaacauguguggucguggacguuagucaugaagauccggaggugaaauucaauugguaugucgacgggguggaaguacacaacgcgaagaccaaaccucgcgaggagcaguacgcauccacuuauagaguugugagcguccuaacagugcuccaucaagauuggcugaauggaaaggaauacaaaugcaaggucucuaacaaagcccuucccgcuccaauugagaagaccaucucaaaggccaaaggucagccuagggaaccccagguguauacgcugccacccagucgggacgaguugaccaagaaucagguuagccucacaugucuggugaaaggcuucuacccuuccgauauugcaguagaaugggagucuaacgggcaaccagagaauaacuauaagacuaccccgcccgucuuagacucggacggcagcuuuuuccuguacuccaaacucacaguggauaagucacgcuggcagcagggaaauguuuucaguugcucugugaugcacgaagcccuucacaaccauuacacucaaaagagccuguccuugucaccugguaaa

SEQ ID NO: 23574 - RNA, 648 nt, Artificial Sequence
  derived and/or modified sequence opt3 from Otelixizumab_LightChain1
gacauccagcugacccaacccaacagcguguccacaucucucggcucaacugucaaacuuaguugcacgcugagcuccgggaauauugagaacaauuacguucacugguaucaguuguacgaaggaagaucuccuaccacaaugauauaugaugacgauaagaggccagacggugugccggaucgguucucgggcucaaucgaccgcagcaguaacuccgccuuuuuaacuauucauaauguagcuaucgaggaugaagcaauuuacuucugucacucuuaugugagcuccuuuaacgucuucgggggaggcaccaagcugacagugcuacgacagcccaaagccgcgccuucaguuacccucuuuccacccaguagcgaggaacugcaggcuaauaaggccacucuugugugccugaucucugacuucuacccuggugcagucacaguggccuggaaagcugauuccucaccaguaaaggcagggguugagaccacgacucccagcaagcaaaguaacaauaaauaugccgcuucuuccuacuugagccucaccccugagcaguggaagucgcaucguucuuacuccugucaggugacacacgaaggaucaacugucgagaaaaccguggccccaacagaaugcagu

SEQ ID NO: 23575 - RNA, 1449 nt, Artificial Sequence
  derived and/or modified sequence opt3 from Otlertuzumab_HeavyChain1
gaggugcagcugguccagagcggcgccgaaguuaagaaacccggggagucccucaagaucucuugcaaaggaucagguuacaguuucaccggcuauaacaugaauugggugagacagaugccugggaagggacuugaauggaugggcaacauugacccauacuauggugggacaacuuacaauaggaaauuuaagggacagguaacgauaagcgcugauaaguccaucucuaccgcauaucugcaguggucgucauugaaagccagcgacacagcgauguacuauugugcucggagugugggcccguucgauuccuggggccaagggacuuuagucaccgugucuagcggagguggcggguccggaggcggugggucaggaggcggcgggaguggagguggcgggagcggaggcggugggucugagauuguucugacacagucccccgccacccuaucacucagcccuggcgaacgcgcaacucugaguugccgagccucugagaacguguacuccuaccuugcuugguaucagcagaagccaggacaagcaccccgucuguugaucuacuuugccaaaacacucgcugagggcauuccugccagauucagcgggucgggaucugguaccgacuuuacgcugacuaucuccucacuggaaccagaggauuucgcggucuauuacugucagcaccauagugacaaucccuggaccuuuggccaggggacaaagguggaaauaaaaggagaucaggagccuaagagcuccgacaagacucacaccucuccaccgugccccgcaccugagcucuuaggcgguccaagcguauuccuguuucccccuaaaccaaaggauacacuuaugaucucaaggacccccgaaguuacguguguggucguggacgugagucaugaggauccggaagucaaauucaacugguauguugacgggguggagguacacaaugccaagacuaaaccucgggaagaacaauacaacuccacauaucgcguggucagcguguugaccguucugcaucaggauuggcuaaauggcaaggaguacaaaugcaaggugucuaacaaggcucuccccgccccaauugagaaaacuaucucaaaggcaaaaggacagccuagagagccccaagucuacacacugccacccaguagggacgaacuuaccaagaaucaggugagccugacguguuugguaaaaggcuuuuauccuuccgacauugcuguugagugggaaucuaacgggcagccagagaauaacuacaagaccacaccgcccgugcucgauucggacgguagcuucuuucuguauuccaaguuaacugucgauaaaucacgguggcagcaaggaaauguguucaguugcucugucaugcacgaggcccugcacaaccauuacacccaaaagagccucucccuuucaccuggcaaa

SEQ ID NO: 23576 - RNA, 1347 nt, Artificial Sequence
  derived and/or modified sequence opt3 from Oxelumab_HeavyChain1
gaggugcagcugcucgaaagcggcgggggacuuguccaacccgguggcucccugagauugucuugcgccgcuucaggguucaccuuuaacaguuacgcaaugagcuggguuaggcaggccccuggaaagggcuuagaguggguguccaucauuucugguucagggggauucacauauuacgcggacucgguaaaaggccgguuuacuauaagccgcgauaauagucgaacgacccuguaucuacagaugaacucccuccgugcugaagacacagccguguacuauugugcaaaggauagacuggucgccccaggcacuuucgacuacugggggcagggagcucuugugaccguuucuagcgcauccacaaaagguccgucaguguuuccccuggccccuaguagcaagucuaccuccggcgggacugcugccuugggaugccucgucaaagauuauuucccagagcccgugacaguaucauggaauagcggcgcgcugaccagugguguucacacguuuccugcagugcugcaaucuuccgggcucuacagcuuaucgucugucgugacugugccauccucaagucugggaacccagacauacaucuguaacgucaaucauaagcccagcaacacuaagguugacaaaaagguggaaccuaaauccugcgauaagacccacacauguccaccgugccccgccccugagcuuuugggcggcccaucuguauuccuguuucccccuaaaccaaaggacacccuaaugauuagcaggacgcccgaggugacuugugucgugguugaugugucacaugaagacccggaggucaaguucaauugguauguggaugggguagaaguucacaacgcuaaaacaaagccucgggaggagcaguacaauaguaccuaucgcguggucuccgugcucacuguccugcaucaggacuggcuuaacggaaaagaauacaagugcaaagugagcaauaaggcccugcccgcaccaaucgagaaaacaauuucuaaggcuaagggucaaccuagagaaccccagguuuauaccuugccacccucaagggaugagcucacgaaaaaccaggugagucugaccuguuuaguaaagggcuuuuacccuagcgacaucgccgucgaaugggaguccaaugggcagccagagaacaauuauaaaacaacuccgcccgugcuggacucugauggaucguucuuucucuacagcaaacuuaccguugacaagucccgguggcaacagggcaacguguucucaugcagugucaugcacgaagcgcugcacaaccauuacacacagaagucuuugagccuauccccuggu

SEQ ID NO: 23577 - RNA, 642 nt, Artificial Sequence
  derived and/or modified sequence opt3 from Oxelumab_LightChain1
gacauccagaugacccaaagccccuccucucugucagccagugugggcgauagagucacaauuacuugcagggcuagccaggggauauccucuuggcucgcaugguaccagcagaagccugagaaagccccaaagucgcuuaucuaugcggcuucaagccugcaaaguggaguuccgucccgguucucugguagcggcuccgggacggacuuuaccuugacaauuucaaguuuacagcccgaagauuucgccacuuacuauugucagcaguacaacagcuauccuuacaccuuuggacaaggcacaaaacuggagaucaagcgcaccguggcagccccaucuguauucauuuuucccccuuccgacgaacagcuaaaaucagguacugcuagcguggucugccuccugaauaacuucuauccacgagaggcaaaggugcaguggaagguugauaaugcccuucagagugggaacucucaagaauccgugacagagcaggacagcaaagauucgaccuacucucuguccucaacguugacucucaguaaggcugacuacgagaaacacaaggucuaugccugugaagugacccaucagggacugagcucccccguaacaaaaucuuuuaaucguggcgagugc

SEQ ID NO: 23578 - RNA, 1329 nt, Artificial Sequence
  derived and/or modified sequence opt3 from Ozanezumab_HeavyChain1
caggugcaacugguccagagcggcgccgagguuaagaaacccggggcuuccgugaagguaucuugcaaagcaucaggauacaccuucacaaguuauuggaugcacugggugagacaggccccuggucagggccucgaauggaucgggaacauuaauccaagcaacggaggcacuaauuacaacgagaaguuuaaauccaaggcgacgaugaccagggacacaucuacuucgaccgcuuauauggaacuuucaagccugcggagugaggauacagccgucuacuauugugaauugaugcaagguuacugggggcagggaaccuuagugacuguuuccucugcaagcacaaagggcccguccguguucccccuggccccuucaaguaaaagcaccucuggcgggacggcugcacuaggaugccucgucaaggacuauuuuccagagcccgugacuguauccuggaacucaggugcccugaccagcggcguucauacauucccugcugugcuucagaguucugggcuguacuccuugagcucggucgugacugugccaucuuccucacucggaacccagacauacauauguaaugucaaucacaaacccaguaacaccaagguugauaaaaagguggagccuaagagcugcgacaaaacgcauacuuguccaccgugccccgccccugaacuggcgggcgcaccauccguauuucuguuucccccuaagccaaaagauacacucaugaucucucgcacccccgaggugacuugugucgugguugacgugagccacgaagauccggaggucaaguuuaauugguauguggacgguguagagguucauaacgccaaaacaaagccucgagaggaacaauacaauucaaccuaucguguggucaguguguuaacgguccugcaccaggauuggcuuaacgggaaagaauacaagugcaagguguccaauaaggcuuugcccgccccaauugagaaaaccaucagcaaagcaaagggacagccuagagaaccccagguuuauacacugccacccucuagggacgagcuaacuaaaaaccaagugucacucaccugucugguaaagggcuucuacccuagugauauugcugucgagugggaaagcaauggccagccagagaacaacuauaagacaacuccgcccgugcuugacuccgaugggucuuucuuccuguacucgaaauugaccguugacaagagccgguggcagcaaggaaauguguuuuccugcucagucaugcacgaagcccuccauaaccacuacacacagaaaagucugucuuuaagcccugguaag

SEQ ID NO: 23579 - RNA, 657 nt, Artificial Sequence
  derived and/or modified sequence opt3 from Ozanezumab_LightChain1
gacaucgugaugacccagagcccccuguccaacccugucacacucggccaaccaguuucuauuucaugcagaaguagcaagucccuucuguacaaagaugggaagacuuauuugaauugguucuuacagaggccgggacagucuccccagcugcuaauauaccucaugucgacgcgggccucaggugugccugaccgcuuuagcggcgggggaaguggcaccgauuucacacugaaaaucucccgaguagaggcugaagacgugggugucuauuacugucaacagcuuguggaguauccacugacuuuugggcagggaaccaaguuggaaauuaaacguacaguugcagcccccucuguguucaucuuuccuccaagcgaugagcagcucaaguccggcaccgcgucagucgugugccugcugaacaauuucuaccccagagaagcuaagguacaauggaaaguugacaacgcccuccagaguggcaauagccaggagucugugacugagcaggauuccaaggacucaacauauagcuuaaguucuacccugacgcuuuccaaagcagauuacgaaaagcacaaagucuacgccugugaggugacucaucaaggguugagcucgccugugaccaagucuuuuaacaggggagaaugc

SEQ ID NO: 23580 - RNA, 1089 nt, Artificial Sequence
  derived and/or modified sequence opt3 from Ozoralizumab_HeavyChain1
gaggugcagcuggucgaaagcggcgggggacucguucaacccgguggcucccuuagacugucuugcgccgcuucaggguucaccuuuagugacuacuggauguauugggugaggcaggcaccuggaaagggcuuggaguggguaagcgaaaucaacacaaaugguuuaauuacuaaauacccagauuccgugaaggggcgguucacgauaucucgcgacaacgccaaaaauacccuguaucuacagaugaacucgcuccgaccggaggauacagcggucuacuauugugcucguucacccagcggauuuaauagaggccagggcacucuggugaccguuaguuccgggggagguggcucugggggaggcagcgaagugcaacuugucgaguccggugggggacuggugcagccuggcaacucauugaggcucaguugcgccgcaagcggcuucacauuuucuuccuucgggaugucauggguacggcaggccccaggaaagggucuggaguggguuagcaguaucucuggcuccgggagcgacacccuguacgcugauucggugaaaggacgcuuuacuauuucuagagacaaugcaaagacaacccucuauuuacagaugaacucccugaggcccgaagauacggccgucuacuacuguacuaucggcgguucacuuagucggagcucccaagggaccuuggugacagugucuagcggcggaggcgggucaggagguggcagugagguccagcugguugaauccgggggaggccuagugcagccuggugggagccuccgccugucuugcgcugccucaggcuucacuuuuagugacuauuggauguacuggguacgacaggcgccaggaaagggccuugagugggugagcgagauuaauaccaacgggcugaucacaaaauaucccgauuccgucaagggaagauucaccauaucuagggacaaugccaaaaacacguuguaccuccaaaugaacucgcugcggccugaagauacugcaguguauuacugugcucguagcccauccgguuuuaaucgcggccaggggacauuaguuaccgugucaagu

SEQ ID NO: 23581 - RNA, 1350 nt, Artificial Sequence
  derived and/or modified sequence opt3 from Palivizumab_HeavyChain
caggugacccugagagagagcggccccgcccucgucaagccuacacaaacucuuacgcugaccugcacauucuccggguuuucuuugucaacaaguggaaugagcguugguuggaucaggcagccaccgggcaaagcauuagaauggcuggcugacauuuggugggaugacaagaaagauuacaaccccucccuaaagucucggcucaccauaucgaaagacacaucaaagaaucaggugguacugaaggugaccaacauggauccugccgacacugcgacauauuacugugcucgcagcaugaucaccaauugguauuucgaugucuggggagccgggacgacugugaccguuaguuccgcaucuacaaaaggcccaagcguguuuccccuugccccuuccucaaagaguacuagcggugggaccgcugcacugggaugcuuggucaaagacuacuucccagagcccgugacaguaucuuggaacuccggcgcccucaccucaggcguucacacguuuccugcugugcugcagagcagugggcuguauucucucuccagcgucgugacugugccaucgucuuccuuaggaacacaaaccuacauuuguaaugucaaccauaagccgucaaauacuaaaguugauaagcgaguggaacccaagaguugcgacaaaacacacaccuguccuccaugccccgccccugagcugcuugguggcccaagcguauucuuguuucccccgaagccuaaagauacgcugaugaucucccguacccccgaagugacaugugucgugguugacgugucucaugaggauccagaggucaaguucaacugguauguggacgggguagaaguucacaaugcgaaaacuaagccuagagaggaacaguacaacagcaccuacaggguggucucagugcuaacaguccuccaucaggacuggcugaauggaaaagaguauaagugcaaggugaguaacaaagcacuucccgccccaauugagaagacuaucuccaaagcuaagggccagccccgggaaccucaaguuuacacccugccaccgagccgcgaggaaaugacuaaaaaucaggugucuuugaccugucucguaaaggguuuuuaucccucagauauagccgucgagugggaaaguaacgggcagccugagaauaacuacaagacuacgccacccgugcuggacagcgauggauccuucuuuuuauauucuaaacugacaguugacaagucgagauggcagcaaggcaacguguucagcugcuccgucaugcacgaggcacuccacaaucauuacacccagaaaucacuuagucugucuccuggcaag

SEQ ID NO: 23582 - RNA, 639 nt, Artificial Sequence
  derived and/or modified sequence opt3 from Palivizumab_LightChain
gacauccagaugacccaaagccccuccacacugucugccucagugggcgauagagucacuauuacgugcaagugucagcucaguguuggguacaugcacugguaucagcagaaaccuggaaaggcuccaaaacuucugauauacgacaccagcaaguuggcauccggugugccgucuagguucucgggcucagggagcggaacagaguuuacuuuaaccaucaguucccugcaacccgaugacuucgccacauauuacugcuuucagggcucugguuauccuuucaccuuugggggaggcacuaaacuagaaauuaagcggacaguagcggcuccaagcguguucaucuuucccccuuccgaugagcagcucaagucaggcaccgccagugucgugugucugcuuaacaauuucuacccacgcgaagcaaaaguucaguggaagguggacaacgcccugcaaagcggaaauucucaggaguccgucacggaacaggauucaaaagacagcacuuauaguuugucuuccacccucacacugagcaaggcugauuacgagaaacauaagguguacgcaugcgagguaacucaccaggggcugucgucucccguuaccaaguccuuuaaccgaggugaaugu

SEQ ID NO: 23583 - RNA, 360 nt, Artificial Sequence
  derived and/or modified sequence opt3 from Palivizumab_VH-Region
caggugacccugagagagagcggccccgcccucgucaagccuacacaaacucuuacgcugaccugcacauucuccggguuuucuuugucaaccaguggaaugagcguugguuggaucaggcagccaccgggcaaagcauuagaauggcuggcugacauuuggugggaugacaagaaagauuacaaccccucccuaaagucucggcucacuauaucgaaagacacaucaaagaaucaggugguacugaaggugaccaacauggauccugccgacacugcgacauauuacugugcucgcagcaugaucaccaauugguauuucgaugucuggggagccgggacgacugugaccguuaguucc

SEQ ID NO: 23584 - RNA, 1347 nt, Artificial Sequence; identical to SEQ ID NO: 23220
  derived and/or modified sequence opt3 from Pamrevlumab_HeavyChain1

SEQ ID NO: 23585 - RNA, 642 nt, Artificial Sequence; identical to SEQ ID NO: 23221
  derived and/or modified sequence opt3 from Pamrevlumab_LightChain1

SEQ ID NO: 23586 - RNA, 1305 nt, Artificial Sequence
  derived and/or modified sequence opt3 from Panitumumab_HeavyChain1
caggugcaacugcaggagagcggccccgggcucgucaagccuuccgaaacccuuucucugacaugcacuguuucaggagguagugugagcuccggcgacuacuauuggacguggaucagacagucuccagggaaaggauuggaguggauuggccacauauacuauucggguaacaccaauuacaacccgucauuaaagagcaggcugacaaucaguauugauacuuccaaaacccaguucucucuaaagcucagcuccguaacagccgcugacaccgcaaucuauuacugugugcgggaucgcgucacuggggccuuugacauuuggggacaaggcacaauggugaccguuucaagugcgagcacgaaaggccccucuguguucccucuggcuccaugcucccgaucaacuagcgaaaguaccgccgcacuugggugucuggucaaggauuauuuucccgagccugugacaguaucuuggaacuccggagccuugacuagcgguguucauaccuucccagcugugcuccagucgucuggccuguacucccugucaagugucgugacagugcccagcuccaauuuugggacccagacguacacuugcaaugucgaccacaagccuucuaacacaaaaguugaugaacguaaguguugcguggaguguccagcaggaccgagcguauuccucuuucccccuaaaccaaaggacaccuuaaugaucucaagaacucccgaggugacaugcgucgugguugaugugagucaugaagacccugagguccaguucaauugguauguggauggcguagaaguucacaacgccaaaaccaagccaagggaggagcaauuuaauuccacguuccggguggucagcgugcugaccgucgugcaucaggacuggcuuaacgguaaggaauacaaauguaagguuucuaauaaaggguugcccgcuccgauagagaagacaaucucaaaaacuaagggacagccucgcgaaccccagguguauacccugccaccuaguagagaggaaaugacuaaaaaccaaguaagccuaacaugccucgucaagggcuuuuaccccuccgauauugccguggagugggagucuaauggccagccagaaaacaauuauaagaccacacccccuaugcuggacucggacgggagcuucuuucuuuacuccaaacugaccguugauaagucaagguggcagcaaggaaacguguucaguuguucugucaugcacgaggcguugcacaaccauuauacucagaaaagccucucccugucaccagguaag

SEQ ID NO: 23587 - RNA, 642 nt, Artificial Sequence
  derived and/or modified sequence opt3 from Panitumumab_LightChain1
gacauccagaugacccaaagccccuccucucugucagccagugugggcgauagagucacaauuacuugccaggcuagccaggacauauccaacuaccucaauugguaucagcaaaagccugggaaagcaccaaaacuucugaucuacgaugccucuaacuuggagacgggaguuccgucgagguucucagguagcggcagugggaccgacuuuacauucacuauuuccucuuuacagcccgaagauaucgcgaccuauuuuugucagcacuucgaccaucugccucuagcuuuuggaggcgguacaaagguggagauuaagcggaccguagccgcaccaagcguguucaucuuucccccuuccgaugaacagcucaaaucagggacugccagugucgugugccugcuuaauaacuucuacccacgcgaggcuaagguucaauggaagguggacaaugcacugcagagcggaaacucucaggaauccgucacagagcaggauucaaaagacagcaccuauaguuugucuuccacgcucacucugagcaaggccgauuacgagaaacacaagguguaugcuugugaaguaacccaucaaggccugucgucucccguuacaaaauccuuuaaucgaggcgagugc

SEQ ID NO: 23588 - RNA, 1326 nt, Artificial Sequence
  derived and/or modified sequence opt3 from Pankoab_HeavyChain1
gaggugcagcuggucgaaagcggcgggggacucguucaacccgguggcuccagacuuucuugcguggccucaggguucccuuuuaguaacuacuggaauuggguaaggcaggcuccaggaaagggccuggagugggugggugaaauccgguugaaaagcaacaauuauaccacacacuacgcagaguccgucaaggggcgcuucacuauuucucgagacgauucgaaaaacucauuauaucugcagaauagccuaaagacggaagacaccgccguguacuauuguacacgucauuacuauuuugauuacuggggacagggcacucucguuaccgugaguuccgcgucuacaaaaggcccgagcgucuucccccuggcuccuuccucaaagaguaccagcgggggaacugccgcacuugguugccuggugaaggacuacuuuccagagcccguaacaguuucuuggaacuccggcgccuugaccucaggggugcacacguucccugcuguccuccaaagcaguggacuguauucucuguccagcguggugacugucccaucgucuucccucggcacccagacauacauauguaauguuaaccauaaacccucaaauacuaagguggauaaaaagguagagccuaaaaguugcgacaagacccacacauguccaccgugccccgcaccugaauuacugggugggccaagcguguuucuuuuucccccuaagccaaaagauaccuugaucuccagaacgcccgaggucacuugugugguuguggacgucucucaugaagauccggaggugaaguucaacugguauguagacggaguugaggugcacaaugccaaaacaaagccuagggaggaacaguacaacagcaccuaucgggucgugucaguccugacugugcuacaccaggauuggcucaauggcaaagaauacaagugcaaaguuaguaacaaggcucugcccgccccaauugagaagacaaucuccaaagcgaagggccaaccucgcgaaccccagguguauacccuuccacccagcagagacgagcugacgaaaaaucagguaucuuugaccugucucgucaagggguucuacccuucagauauugcaguggagugggaaaguaacggacagccagagaacaauuacaaaacaacuccgcccguucuggacagcgacgguuccuuuuucuuauauucuaagcugaccguggauaagucgagguggcaacagggcaacgucuuuagcugcuccgugcaugaagggcuccacaaucauuacacacagaaaucacuuagucugucuccuggaaag

SEQ ID NO: 23589 - RNA, 651 nt, Artificial Sequence
  derived and/or modified sequence opt3 from Pankoab_LightChain1
gacaucgugacccagagcccccuguccaacccugucacaccaggcgagccggccucuauuucaugcagaaguagcaagucccuccuucacucuaaugggauaacuuacuucuuuugguaucugcaaaaacccggacagucgccucaguuguuaaucuaccagucaaaccuggcuagcgguguuccagauagguucaguggcuccgggucuggaacggacuuuacccuacggauuagccgcguggaagcagaggauguaggcguguauuacugugcccaaaaucucgaacugcccccuacauucggucaggggacuaaggucgagaucaaacgaaccguggcggcuccauccguuuuuauuuuucccccuucagacgaacagcuuaagaguggaacagccagcguggucugccuguugaacaauuucuauccacgugaggcaaaagugcaguggaagguagauaacgcccuccaaucuggcaauucccaggagucaguuaccgaacaggacagcaaggauaguacuuacucucuguccagcacacugacccucucgaaagcugacuaugagaagcauaaaguguacgcaugugaagucacgcaccagggcuuaucuuccccggugacuaagucauucaacagaggggagugc

SEQ ID NO: 23590 - RNA, 651 nt, Artificial Sequence
  derived and/or modified sequence opt3 from Pankoab_LightChain2
gacaucgugacccagagcccccuguccaacccugucacaccaggcgagccggccucuauuucaugcagaaguagcaagucccuccuucacucuaaugggauaacuuacuucuuuugguaucugcaaaaacccggacagucgccucaguuguuaaucuaccagucaaaccuggcuagcgguguuccagauagguucaguggcuccgggucuggaacggacuuuacccuacggauuagccgcguggaagcagaggauguaggcguguauuacugugccgguaaucucgaacugcccccuacauucgggcaaggaacuaaggucgagaucaaacgaaccguggcggcuccauccguuuuuauuuuucccccuucagacgaacagcuuaagaguggcacagccagcguggucugccuguugaacaauuucuauccacgugaggcaaaagugcaguggaagguagauaacgcccuccagucuggcaauucccaagagucaguuaccgaacaggacagcaaggauaguacuuacucucuguccagcacacugacccucucgaaagcugacuaugagaagcauaaaguguacgcaugugaagucacgcaccagggguuaucuuccccggugacuaagucauucaacagaggagagugc

SEQ ID NO: 23591 - RNA, 351 nt, Artificial Sequence
  derived and/or modified sequence opt3 from PankoMab_HeavyChain_VDJ-Region
gaggugaagcuggucgaaagcggcgggggacucguucagcccgguggcuccaugaaacuuucuugcguggccucaggguucaccuuuaguaacuacuggaugaauuggguaagacaaagcccugagaagggacuggaauggguggcugagaucagguugaaauccaacaauuauacaacucacuacgcagaaucugucaagggccgguucacgauuucgcgcgacgauucaaaaagcaguguguccuuacagaugaacaaucugcgaguugaggacaccgguauauauuacuguacacgucauuauuacuuugauuauugggggcagggaacuacccuaacagugucuagc

SEQ ID NO: 23592 - RNA, 339 nt, Artificial Sequence
  derived and/or modified sequence opt3 from PankoMab_LightChain_VJ-Region
gacaucgugaugacccaggccgcuuucagcaaccccgucacacugggcacuuccgcaucuauuucaugcagaaguagcaagucccuccuucacucuaaugggauaacguacuuuuucugguaucugcaaaaaccuggauugucgccacaguuacugaucuaccagaugucaaaccuagccagcgguguuccggauagguuuaguuccucuggcagcgggaccgacuucacacuccggauuucccgcguggaggcggaagauguaggaguguauuacugugcucagaaucuggagcuucccccuacuuuuggcggugggaccaagcuggaaaucaaacga

SEQ ID NO: 23593 - RNA, 1707 nt, Artificial Sequence
  derived and/or modified sequence opt3 from Panobacumab_HeavyChain1
gaggaacagguggucgagagcggcgggggauucguucaacccgguggcucccugagacucucuugcgccgcuucaggguuuaccuucaguccuuacuggaugcacugggugaggcaggcaccaggaaagggccuuguaugggugagccggaucaacuccgacgguucuacauauuacgccgauucggucaaagggcgcuuuacuauuucacgagacaaugcgcguaacacgcuguauuugcagaugaauagcuuaagagcugaagauaccgccguguacuauugugcaagggaccgguacuauggaccggagauguggggccagggcacaaugguuacugugaguuccgggucugccagcgcucccacccuguucccucuagucuccugcgaaaacucaccaagugauacaagcucuguggcaguaggaugucucgcccaagacuuucugcccgauuccauaaccuucucauggaaguacaaaaauaacagcgacaucaguucuacucgcgguuuuccuuccguucuuagaggcgggaaguacgcugccacaagccaggugcuguugccaucgaaagaugucaugcagggaaccgacgagcauguggugugcaagguccagcaccccaauggcaacaaggagaaaaauguuccucucccagugauugcggaacugccgcccaagguaucuguguucgucccuccaagggauggguuuuucgguaacccccggaaauccaagcugaucugucaagcaacgggauuuucaccucgccagauucaggugaguuggcuccgagagggcaaacagguuggcagcggggugacuaccgaccaaguccaggccgaagcuaaggaguccggaccaacaacuuauaaggugaccucuacauuaaccaucaaagagagcgauuggcugucacagaguauguucacgugcagaguagaccauaggggucuuacuuuucaacagaaugccuccagcauguguguucccgaccaggauacagcaauacggguguucgcuaucccgccuucuuucgccucaauuuuucucaccaagaguacuaaacugacaugccuagucaccgaccucacgaccuacgauagcgugacaaucuccuggacucgucagaacggcgaagcggucaagacccacacaaauauuucugagucgcaucccaacgccacuuucagcgcagugggggaggcuuccaucugugaagacgauuggaacucaggagaacgcuuuaccugcacaguuacccacacugaccugccaaguccucuuaaacaaacgauaucuagacccaagggcguggcccugcacaggccagauguauauuuguugcccccugcucgggagcagcugaauuuacgagagagcgccacaauuaccugucuggucacugguuucuccccagcagacguguuuguucaguggaugcagcgcgggcaaccgcucucacccgaaaaauacgugaccagcgccccuaugccagagccccaggcuccuggcagauauuucgcgcauucuauccuuacagucuccgaagaggaauggaacaccggagagacuuacacaugcgugguagcacacgaggcccugccaaauagggugacggaacggaccguugauaagaguacuggcaagcccacauuguauaacgucagccuagugaugucugacaccgcugggacaugcuac

SEQ ID NO: 23594 - RNA, 657 nt, Artificial Sequence
  derived and/or modified sequence opt3 from Panobacumab_LightChain1
gacguggucaugacccagagcccccugucccucccuguuacacuuggccaaccagccucuaucucaugcagaaguagccagucccugguguacucugaugggaacacuuauuugaauugguuccagcagaggccgggacaaucgccccggcgcuuaauuuacaagguaucaaaccgagacagcggugugccugaucguuuuaguggcuccgggucuggaacggacuucacccugaaaauaagcagagucgaggcugaagaugugggcguuuauuacuguaugcaggguacacacuggccacuaacuuuugggggaggcaccaagguggagaucaaaaggacagucgcagcccccuccguguucauuuuuccuccaucagacgaacagcucaagaguggcaccgcgagcguaguuugccugcuuaauaacuucuauccccgggaggcuaaagugcaguggaaggucgauaaugcccugcaaucugggaacucccaggaaucagugacugagcaggacagcaaggauaguacauacucuuuguccagcacccucacgcugucgaaagcagacuaugagaagcauaaaguguacgccugugaagucacucaccagggacugucuuccccuguuaccaagucauuuaaucgcggugagugc

SEQ ID NO: 23595 - RNA, 414 nt, Artificial Sequence
  derived and/or modified sequence opt3 from Panobacumab_LightChain2
ggcgacgaugaggccaccauccuggcugacaacaagugcauguguacaagagugacuagcaggauuauacccuccacggaagauccuaaugaggacaucgucgaacggaacauucgcaucguugugccacucaauaaccgagagaauauuucugauccgaccucaccccuucguagaaacuucguauaccaccugagugacgugugcaaaaagugugauccugucgaaguggaguuggaggaccagguugugacagcaacucaaagcaauaucugcaacgaagaugacggggucccagagaccuguuauauguacgauaggaauaaaugcuauacaaccauggugcccuuacgguaccauggagaaacuaagaugguacaggccgcgcugacaccugacuccuguuauccagau

SEQ ID NO: 23596 - RNA, 1359 nt, Artificial Sequence
  derived and/or modified sequence opt3 from Parsatuzumab_HeavyChain1
gaggugcagcuggucgaaagcggcgggggacucguucaacccgguggcucccuuagacugucuugcgccgcuucaggguacaccuucaucgacuauuacaugaacugggugaggcaggcaccuggaaagggcuuggaguggguaggugauauuaauuuagacaacagugggacacacuauaaucagaaauuuaagggacgguucacuauaagccgcgauaaauccaagaacacggccuaccugcagaugaauagccuacgagcggaagacaccgcuguguauuacugugcccgugagggcgucuaucaugauuacgacgauuacgcaauggacuauuggggccaagggacacucgugacuguuucgucagccagcaccaaaggaccaaguguguuuccgcuggcucccuccucuaagagcacauccgguggcaccgcagcccuugggugccuggucaaggauuacuucccugaaccagugacuguaucauggaacaguggagcuuugacaagcggcguucacaccuuucccgccgugcuccagucuuccggucuguauucacugagcagugucgugacggugccuucuuccagccucgggacucagaccuacaucuguaaugucaaccauaaaccaucgaauacaaagguugacaaaaagguggagcccaaaucuugcgauaagacucacaccuguccuccaugcccggcgcccgaguuacugggaggcccuuccguauuccuuuuuccacccaagccuaaagacacauugaugauuucaagaaccccagaagugacgugugucgugguugaugugagucaugaggaccccgaagucaaguucaacugguauguggacggcguagagguucacaaugcaaaaacuaagccgagggaggaacaguacaacagcacauaucggguggucuccgugcugaccguccuacaccaagauuggcucaaugggaaagaguacaagugcaaagugucuaacaaggcccugccugcucccaucgaaaagacuauuagcaaagccaagggacagccacgcgagccucagguuuacacacuucccccaucaagagaagagaugaccaaaaaucaggugagucugacguguuugguaaaggguuuuuaucccuccgacaucgcagucgagugggaaagcaacggccaaccugagaacaauuacaaaaccacaccaccggugcucgauucugacgggucauucuuucuguauaguaaguuaacuguugauaagucuagguggcagcagggaaacguguucuccugcucugucaugcaugaagcucugcacaaucauuacacccaaaaaucgcucagccuuucccccggcaag

SEQ ID NO: 23597 - RNA, 657 nt, Artificial Sequence
  derived and/or modified sequence opt3 from Parsatuzumab_LightChain1
gacauccagaugacccaaagccccuccucucugucagccagugugggcgauagagucacaauuacuugcaggacgagccagucccucguucacauaaacgcuaucaccuaccuucauugguaucagcagaagccugggaaagcaccaaagcuguugauuuaccgggugucuaaucgcuucucgggaguaccgucacgauuuagcgguaguggcuccgggacagacuucacuuuaaccaucucuagccugcaacccgaggauuuugccacauauuacuguggacaguccacccacgugccucuaacuuucggccaggguacaaaagucgaaauuaagcguaccguggcggcuccaucaguuuuuaucuuucccccuagugacgagcagcucaaaagcgggacggccucuguggucugccugcuuaacaauuucuauccaagagaagcaaaggugcaauggaagguagauaacgcccugcaguccggaaauucacaggagagcguuacugaacaggacaguaaagauucuaccuacuccuugagcucgacacucacucugucuaaggcugacuaugagaaacauaagguguacgcaugugaggucacccaccaaggccuguccucacccgugacaaaaaguuucaacaggggcgaaugc

SEQ ID NO: 23598 - RNA, 1353 nt, Artificial Sequence
  derived and/or modified sequence opt3 from Pascolizumab_HeavyChain1
caggugacccugagagagagcggccccgcccucgucaagccuacacaaacucuuacgcugaccugcacauucuccggguuuucuuugucaacuagcggaauggguguuagcuggaucaggcagccaccgggcaaaggguuagaauggcuggcucacauuuacugggacgaugacaagcgguauaaccccucccuaaaaucucgccucaccauaucgaaggauacaucacgaaaucaggugguacugaccaugacuaacauggacccuguggauacagcaaccuacuauugugcccguagagagacggucuucuacugguauuuugacguguggggaaggggcacuccaguuaccgugagcagugcguccacaaaaggucccucugucuucccucuugcuccaagcuccaagucaacuucugggggaaccgccgcacugggcugcuuggugaaggauuacuuucccgaaccuguaacaguuagcuggaauaguggcgcccucaccuccggggugcauacguucccagcuguccugcagucaagcggacuguauagucucucuuccguggugacugucccgagcucgucuuuagguacacaaaccuacaucuguaacguuaaucacaaacccuccaacacuaagguggacaaacggguagagccuaagucaugcgauaaaacacauaccuguccacccugcccugcaccagaacugcuuggcgggcccaguguguuuuuguucccgccuaagcccaaggacacgcugaugauuagccgcaccccagaggucacaugugugguuguggaugucucccacgaggacccugaagugaaauuuaauugguacguagauggaguugaggugcauaacgccaagacuaaacccagagaggaacaguauaauucuaccuacagggucgugagcguccuaacagugcuccaccaggacuggcugaacggcaaggaguauaaaugcaagguuucaaauaaagcccuuccagcucccaucgaaaagacuauuaguaaggcgaaaggucagccucgggagccacaaguguacacccugccgcccucccgcgaagagaugacaaagaaccagguaaguuugaccugucucgucaaaggguucuauccuucugacaucgcaguggaaugggagucaaauggacagccagagaacaauuacaagacuacgcccccuguucuggauagugacggcagcuuuuucuuauauuccaaacugacaguggauaagucucgauggcagcaaggcaacgucuuuucgugcagcgugaugcacgaagcccuccauaaccacuacacccagaagucccuuucacugaguccagggaaa

SEQ ID NO: 23599 - RNA, 654 nt, Artificial Sequence
  derived and/or modified sequence opt3 from Pascolizumab_LightChain1
gacaucgugcugacccagagccccuccucucucucagccagugucggcgauagaguuacaauuacuugcaaggcuagccaauccguggacuacgauggggacucuuauaugaacugguaccagcagaaaccuggaaaggcaccaaaacuucugauauaugccgcgucgaauuuggagucagguaucccgagcagguucaguggcuccgggucuggaacggauuuuaccuucacaauuagcuccuuacagcccgaagacaucgcuacuuacuauugucaacagucaaacgaggauccuccaaccuuuggccaggguacaaagguagaaauuaaacggaccguggccgcacccagugucuucaucuuuccuccaagcgacgagcagcugaagucugggacugccuccgugguuugccuacucaauaacuucuacccccgcgaagcuaaggugcaauggaaagucgauaaugcacugcagucaggaaacagccaggagagugugacagagcaggacucuaaggauuccaccuauagccuuucgucuacgcugacuuuguccaaagccgacuacgaaaagcacaaaguauacgcuugugagguuacccaucaaggccucucaaguccugugacaaagagcuuuaaucgaggcgaaugc

SEQ ID NO: 23600 - RNA, 1512 nt, Artificial Sequence
  derived and/or modified sequence opt3 from Pasotuxizumab_HeavyChain1
caggugcaacuggucgagagcggcgggggacucguuaagcccggugaaucccuuagacugucuugcgccgcuucaggcuucaccuuuagugacuacuauauguacugggugaggcaggcaccugggaaaggauuggaguggguagccaucauuagcgauggcgguuauuacacauauuacuccgacauaaucaaggggcgguucacuauuucucgcgauaacgcgaaaaauucguuauaucugcagaugaacucacuaaaggcugaagacacggccguguacuacugugcacgaggauuuccacuccugcgucacggcgccauggauuauuggggccaggggacccuugucacagugagcaguggagguggcggguccggaggcggugggucuggaggcggcgggagcgacauccaaaugacucaguccccgucaagucugagcgcuucuguuggagauagagugaccauuacaugcaaagcaucccagaaugucgacaccaacguggccugguaccagcaaaagcccggucaggcuccuaagucauugaucuauagcgccaguuacagguauucugauguaccaucccgguucagcggcucggcgucugggacugacuuuacacucaccauauccucaguucagagugaggauuucgcaacguacuauugucagcaauacgacagcuaccccuauacuuuuggaggcgguaccaaacuggaaaucaaguccgggggcggaggcucugaggugcagcuggucgagagcgggggaggucucgugcagccuggcgggucauuaaaacugaguugcgccgcuuccggauucacauuuaauaaguacgccaugaacugggugcgccaagcaccaggcaaaggucuugaaugggucgcuagaauuaggagcaaguauaauaacuacgccacuuauuacgcggauucuguuaaggaccgguucaccaucucacgcgacgauaguaaaaauacagccuauuugcagaugaacaaucugaagaccgaggacacggcaguguacuacuguguacgacaugggaacuuuggcaauagcuauauuuccuacugggcuuauuggggacagggcacucuagugacagucucuucgggaggggguggcagcgggggaggcgguuccgggggcggaggcucacagaccgugguuacucaagaacccagucucacagugucuccugggggaaccgucacgcugaccugcggcagcuccacaggugccgugacuucagggaacuacccaaauuggguacagcagaaaccgggacaggcucccagaggccuuaucgguggcaccaaguuccuggccccugggacaccagcaagguuuagcggaucuuugcucggcgggaaagccgcucugacuuuauccggaguucaacccgaggaugaggcggaauauuacugugugcugugguauaguaaccggugggucuucggcggugggaccaagcucacagugcuucaccaucaccaucaccac

SEQ ID NO: 23601 - RNA, 1512 nt, Artificial Sequence
  derived and/or modified sequence opt3 from Pasotuxizumab_SingleChain
caggugcaacugguccagagcggcgggggacucguuaagcccggugagucccuuagacugucuugcgccgcuucaggcuucaccuuuagugacuacuauauguacugggugaggcaggcaccugggaaaggauuggaauggguagccaucauuagcgauggcgguuauuacacauauuacuccgacauaaucaaggggcgguucacuauuucucgcgauaacgcgaaaaauucguuauaucugcagaugaacucacuaaaggcugaggacacggccguguacuacugugcacgaggauuuccacuccugcgucacggcgccauggauuauuggggccaagggacccuugucacagugagcaguggagguggcggguccggaggcggugggucuggaggcggcgggagcgacauccagaugacucaguccccgucaagucugagcgcuucuguuggagauagagugaccauuacaugcaaagcaucccagaaugucgacaccaacguggccugguaccaacagaagcccggucaggcuccuaagucauugaucuauagcgccaguuacagguauucugauguaccaucccgguucagcggcucggcgucugggacugacuuuacacucaccauauccucaguucagagugaagauuucgcaacguacuauugucaacaguacgacagcuaccccuauacuuuuggaggcgguaccaaacuggagaucaaguccgggggcggaggcucugaagugcagcuggucgagagcgggggaggucucgugcaaccuggcgggucauuaaaacugaguugcgccgcuuccggauucacauuuaauaaguacgccaugaacugggugcgccaggcaccaggcaaaggucuugagugggucgcuagaauuaggagcaaguauaauaacuacgccacuuauuacgcggauucuguuaaggaccgguucaccaucucacgcgacgauaguaaaaauacagccuauuugcagaugaacaaucugaagaccgaagacacggcaguguacuacuguguacgacaugggaacuuuggcaauagcuauauuuccuacugggcuuauuggggacagggcacucuagugacagucucuucgggaggggguggcagcgggggaggcgguuccgggggcggaggcucacaaaccgugguuacucaggagcccagucucacagugucuccugggggaaccgucacgcugaccugcggcagcuccacaggugccgugacuucagggaacuacccaaauuggguacagcagaaaccgggacaagcucccagaggccuuaucgguggcaccaaguuccuggccccugggacaccagcaagguuuagcggaucuuugcucggcgggaaagccgcucugacuuuauccggaguucagcccgaagaugaggcggaguauuacugugugcugugguauaguaaccggugggucuucggcggugggaccaagcucacagugcuucaccaucaccaucaccac

SEQ ID NO: 23602 - RNA, 1341 nt, Artificial Sequence
  derived and/or modified sequence opt3 from Pateclizumab_HeavyChain1
gaggugcagcuggucgaaagcggcgggggacucguucaacccgguggcucccuuagacugucuugcgccgcuucaggguacaccuucacaaguuaugugauccacuggguaaggcaggcaccuggaaagggcuuggaguggguggguuacaacaauccauauaacgccgggacuaauuacaacgaaaaauuuaagggacgguucacgauuagcuccgacaaaucuaagaauaccgcguauuuacagaugaacucgcugcgcgcugaggauacagccgucuacuauuguucacgaccgacuaugcuacccugguuugcauacuggggccagggcacccucgugacaguuagcagugccuccaccaaagggccuucuguguucccacuggcucccagcuccaagucaacuucuggagguacagcagcccuuggcugccuggucaaggacuacuuuccugaaccagugaccguaagcuggaauaguggggcuuugacguccggaguucauacuuuccccgccgugcuccaaucaagcggccuguauagucugucuuccgucgugaccgugccuagcucgucucucgguacacagacuuacauauguaacgucaaucacaaaccauccaacaccaagguugauaaaaagguggagccgaaaucaugcgacaagacacauaccugucccccuugcccagcgcccgaguuacuugggggaccuaguguauuucuguucccacccaagccgaaagauacguugaugaucagccguacuccugaagugacaugugucgugguugacgugucccacgaggaucccgaagucaaguuuaauugguauguggacggcguagagguucauaacgcaaaaaccaagccaagagaggaacaguacaauucuacuuauaggguggucagcgugcugacaguccuacaccaggauuggcucaacggcaaagaguacaagugcaaagugucaaauaaggcccugccugcucccauugaaaagaccaucaguaaagccaaggggcaaccacgggagccccagguuuauacgcuuccuccaucccgcgaagagaugaccaaaaaccaggugagccugacauguuugguaaagggauucuacccgucugacauugcagucgagugggaaucaaacggucagcccgagaauaacuacaaaacuaccccuccagugcucgauagugacggcagcuuuuuccuguauuccaaguuaacaguugauaagucuagauggcaacaggggaauguguuuucgugcagcgucaugcacgaagcucugcauaaccacuacacucagaaaucccucucacuuagucccgga

SEQ ID NO: 23603 - RNA, 642 nt, Artificial Sequence
  derived and/or modified sequence opt3 from Pateclizumab_LightChain1
gacauccagaugacccaaagccccuccucucugucagccagugugggcgauagagucacaauuacuugcagggcuagccaggcaguuuccucugccguggcgugguaccagcagaagccugggaaagcuccaaagcuccuuauauauucggccucacaccgguacacgggaguaccgagccgcuucagugguuccggcucugggaccgacuuuacacugacuaucagcuccuugcaacccgaggauuucgcaaccuauuacugucaggaaucauauaguacaccuuggaccuuuggacagggcacuaaaguggagauuaagcgaacagucgccgcuccaagcguguucaucuuucccccuucugacgaacaguuaaaauccgguaccgcaucaguugugugccugcuaaacaauuucuacccacgugaggccaagguccaauggaagguggauaacgcucuccagagcgggaauagucaggaaucuguaacggagcaggacuccaaagauagcacuuauucgcugucuuccacccuuacacugucaaaggccgacuacgagaaacauaagguuuacgcgugugaagugacucaccaaggauugaguagccccgucaccaaauccuuuaacagaggcgagugc

SEQ ID NO: 23604 - RNA, 1341 nt, Artificial Sequence
  derived and/or modified sequence opt3 from Patritumab_HeavyChain1
caagugcaacugcagcaguggggcgccgggcuccuuaagcccagcgagacccuguccuugacaugcgcugucuacggagguucuuucucaggcuauuacuggaguuggaucagacagccuccagggaaaggauuagaauggauuggcgagauaaaccacagcgguuccacuaauuauaacccgucucugaagucgaggguuacgaucucaguggaaaccagcaaaaaucaauuuagucuaaagcucuccucuguaacagcagccgacacugcgguguacuauugugcucgggauaaauggaccugguacuucgaccugugggggcgcggaacacuugucaccgugagcuccgccucaacuaagggccccaguguuuuuccucuggcaccaagcucuaaguccacaucaggcgggaccgccgcuuugggaugccucgugaaagauuauuuccccgagccugucacggugagcuggaacaguggugcacugacuucuggcguacauaccuuuccagccguucugcaguccagcgggcucuacucguuaucuuccguggucacagugcccucaaguagccugggaacucagaccuacauuuguaaugugaaccacaagccuuccaauacaaaagucgacaagcgaguugaaccaaaaucuugcgauaagacccauacguguccgcccugcccugcuccagagcuuuugggcggucccagcguguuccuguuuccuccaaagcccaaagacacucuaaugaucucacguacaccggagguaaccuguguggucguggauguuagucacgaagacccugaggugaaguucaacugguaugucgaugggguggaaguacauaaugccaaaacuaagcccagagaggagcaguacaacuccacauauaggguugugagcguccucaccgugcugcaccaagacuggcuuaauggaaaagaauacaagugcaaagucucuaacaaggcgcugccagcaccuauugagaagacgaucucaaaagccaagggccagccccgggaaccacagguguauaccuugcccccuagucgcgaggaaaugacuaaaaaucagguuagccucacaugucuggugaagggcuuuuacccauccgauauagcuguagagugggagucuaacgggcaaccggaaaauaacuauaaaaccacacccccugucuuagacucggaugguagcuucuuucuguacuccaagcucacuguggacaagucaagauggcagcagggaaacguuuucaguugcucugugaugcacgaggcccuucauaaucacuacacccagaaaagccuguccuugucaccaggcaag

SEQ ID NO: 23605 - RNA, 681 nt, Artificial Sequence; identical to SEQ ID NO: 23561
  derived and/or modified sequence opt3 from Patritumab_hinge-CH2-CH3

SEQ ID NO: 23606 - RNA, 660 nt, Artificial Sequence
  derived and/or modified sequence opt3 from Patritumab_LightChain1
gacaucgagaugacccagagccccgauucccuggccgugucucucggcgaaagagcuacaauuaacugcaggucaagucaaagcguccuuuacuccucuucgaaucggaacuaucuggcaugguaccagcagaauccugggcagccaccgaaauuguuaauauauugggccucaacucgcgagagcggaguucccgaccgauucagugguuccggcucugggacggauuuuacccugacaaucagcucccuacaagcggaagacguggcuguauacuauugucagcaguacuauucaacuccucguaccuucggacagggcacaaaaguggagauuaagagaaccgucgccgcaccaaguguguuuaucuuucccccuagcgaugaacaacucaaaucugguacugccuccguugugugccugcuuaacaauuucuacccaagggaggcuaagguccaguggaaaguggacaacgcacugcagucagggaauagccaggagaguguaacagaacaagauucuaaggacuccaccuacagcuugucgucuacgcucacucuguccaaggccgauuaugagaaacacaagguuuacgcuugugaagugacccaucagggacugucaagucccgucacaaagagcuucaaccggggcgagugc

SEQ ID NO: 23607 - RNA, 1341 nt, Artificial Sequence; identical to SEQ ID NO: 23422
  derived and/or modified sequence opt3 from Pembrolizumab_HeavyChain1

SEQ ID NO: 23608 - RNA, 654 nt, Artificial Sequence; identical to SEQ ID NO: 23423
  derived and/or modified sequence opt3 from Pembrolizumab_LightChain1

SEQ ID NO: 23609 - RNA, 1356 nt, Artificial Sequence
  derived and/or modified sequence opt3 from Perakizumab_HeavyChain1
gaggugcagcuggucgaaagcggcgggggacucguucagcccgguggcucccuuagacugucuugcgccgcuucaggguucaccuuuagugacuacacaauguugugggugaggcaggcaccuggaaagggcuuagaguggguagccaucauuaaaagcgguggguccuauucuuacuauccagauucggugaagggacgguucacuauaucacgcgacaacgcgaaaaauagccuguaccuacagaugaacagucuccgagcugaagauacggccgucuauuacugugcacgugacggcgauuauggcuccucuuacggggccauggacuacuggggacaggguacccuggugacaguuagcuccgcuucaacuaagggcccgaguguguuuccccuugcaccuagcucuaaauccaccucagggggaacagccgcucugggcugcuuggucaaggauuauuucccagagcccgugaccguaagcuggaauaguggugcccucacuucugggguucacacauuuccugcggugcugcaauccagcggacuguacucgcucucuuccgucgugaccgugccaucaaguagcuuaggcacgcagacuuauaucuguaacgucaaucauaagcccuccaacaccaaaguugacaagaaaguggaaccuaagucuugcgauaaaacacacacuuguccaccgugccccgcaccugaggccgcuggcgggccaagcguauuccuguuucccccuaagccaaaggacacccuuaugauuucaagaacacccgaggugaccugugucgugguugaugugagucaugaagacccggaggucaaauucaauugguacguggauggaguagaaguucacaacgccaagacgaaaccuagggaggagcaguauaauuccacuuaccggguggucagcguguugacaguccugcaucaggacuggcuaaacgguaaggaauauaaaugcaaggugucuaauaaagcacuccccgcuccaaucgagaagaccauuucaaaggccaaaggccaaccucgcgaaccccagguuuacacucugccacccaguagagacgagcuuacaaagaaccaggugagccugaccuguuugguaaaaggguuuuacccuuccgauaucgcggucgaaugggagucuaauggacagccagagaacaauuauaagacgaccccgcccgugcucgacucggauggcagcuucuuucuguacuccaaauuaacaguugacaagucaagguggcaacaggguaacguguucaguugcucugucaugcacgaagcccugcacaaccauuauacucaaaagagccucucccuuucaccugggaaa

SEQ ID NO: 23610 - RNA, 645 nt, Artificial Sequence
  derived and/or modified sequence opt3 from Perakizumab_LightChain1
gacauccagaugacccaaagccccuccucucugucagccagugugggcgauagagucacaauuacuugcagggcuagccaggacauaaacuccuaccucucuugguuccagcagaagccugggaaagcaccaaagucgcuuaucguucgggccaaucgccugguggauggaguaccgucacgauuuagcgguaguggcuccgggcaagacuauucuuugacgauuagcuccuuacagcccgaggauuucgcgaccuacuauugucugcaguacgacgcuuuuccuccauauacauucggacagggcacuaaacuagaaaucaagcguaccguggccgcacccucagucuuuauuuucccuccaagugaugagcaacucaaaagcgguacagccucugugguuugccugcuuaacaauuuuuaccccagagaagcuaaggugcaguggaaggucgacaacgcacugcaguccggaaauucacaggagagcgugaccgaacaagauaguaaagacucuacuuauuccuugagcucgacacucacccugucuaaggccgauuacgagaaacacaagguauacgcuugugagguuacgcaucaggggcuguccucaccugugacuaaaaguuucaacaggggcgaaugc

SEQ ID NO: 23611 - RNA, 1332 nt, Artificial Sequence
  derived and/or modified sequence opt3 from Pertuzuab_HeavyChain1
gaggugcagcuggucgaaagcggcgggggacucguucaacccgguggcucccuuagacugucuugcgccgcuucaggguucaccuuuacagacuacacugauugggugaggcaggcaccuggaaagggcuuggaguggguagccgacgugaacccaaauaguggugggagcaucuauaaccagcgguucaaaggacgcuuuacguuauccgucgaucgaucuaagaauacccuguaccuacagaacucgcuccgugcggaagacacagcuguguauuacugugccagaaaucugggcccgucauucuauuuugauuacuggggccaagggacucuuguuaccgugagcagugcauccacaaaaggacccucugucuucccucuggccccaagcuccaagucaaccagugguggcacugcugcauuggggugccucgugaaagacuauuuucccgagccuguaacaguuagcuggaacucuggagcccugaccuccggcgugcacacguucccagcuguccugcagucaagcggucucuacaguuuaucuuccguggugacuguccccagcucgucucuggggacccagacauacauuuguaauguuaaccauaagccuuccaauacuaagguggauaaaaagguagaaccaaaaucaugcgacaagacccacacauguccgcccugcccugccccagagcuuuugggaggccccaguguguuucuguucccuccaaaacccaaggauacccuaauaagcaggacgccggaggucacuugugugguuguggacgucucccaugaagauccugaggugaaguuuaacugguauguagacggcguugaagugcacaaugcgaaaacaaagccccgggaggagcaguacaacucuaccuaucgcgucgugagcguccucacugugcugcaucaagauuggcuuaaugggaaagaauacaagugcaaaguuucaaacaaggcacugccagccccuaucgagaaaacaauuaguaaggcuaagggacagcccagagaaccacagguguauaccuugcccccuuccagggaggaaacgaaaaaucagguaagccucaccugucuggucaaggguuucuacccaucugacaucgccguggagugggagucaaacggccaaccggaaaacaauuauaaaacaacucccccuguuuuagacagugaugggagcuuuuuccuguacuccaagcucaccguggacaaaucucgguggcagcagggaaacgucuucucgugcagcgugcacgaggcacuucacaaucauuacacacaaaagucccugucauugaguccaggcaag

SEQ ID NO: 23612 - RNA, 639 nt, Artificial Sequence
  derived and/or modified sequence opt3 from Pertuzuab_LightChain1
gacauccagacccaaagccccuccucucugucagccagugugggcgauagagucacaauuacuugcaaggcuagccaggacguuuccauagggguggcaugguaccagcagaaaccuggaaaggccccaaaacuccuuaucuauucugcgucguacagguauacggguguaccgucacgguucagcggcaguggguccggaaccgauuuuacacugacuauuucuagcuugcaacccgaggacuucgcuaccuacuauugucagcaguacuauaucuacccuuacacauuuggccaggguaccaagguggaaauuaaacgcacugucgccgcaccauccguguucaucuuucccccuucagaugagcaauuaaagagugggacagccagcguugugugccugcuaaacaauuucuauccacgagaagcuaagguccaguggaaaguggacaacgcacuccagucuggaaauucccaggagucaguaaccgaacaagauagcaaggacaguacguacucucuguccagcacucuuacccugucgaaagccgauuaugagaagcacaaaguuuacgcuugugaggugacacaucagggcuugucuucccccgucacuaagucauuuaaccguggcgaaugc

SEQ ID NO: 23613 - RNA, 642 nt, Artificial Sequence
  derived and/or modified sequence opt3 from Pertuzumab_HeavyChain
gacauccagaugacccaaagccccuccucucugucagccagugugggcgauagagucacaauuacuugcaaggcuagccaggacguuuccauagggguggcaugguaccagcagaaaccuggaaaggccccaaaacuccuuaucuauucugcgucguacagguauacggguguaccgucacgguucagcggcaguggguccggaaccgauuuuacacugacuauuucuagcuugcaacccgaggacuucgcuaccuacuauugucagcaguacuauaucuacccuuacacauuuggccaggguaccaagguggaaauuaaacgcacugucgccgcaccauccguguucaucuuucccccuucagaugagcaauuaaagagugggacagccagcguugugugccugcuaaacaauuucuauccacgagaagcuaagguccaguggaaaguggacaacgcacuccagucuggaaauucccaggagucaguaaccgaacaagauagcaaggacaguacguacucucuguccagcacucuuacccugucgaaagccgauuaugagaagcacaaaguuuacgcuugugaggugacacaucagggcuugucuucccccgucacuaagucauuuaaccguggcgaaugc

SEQ ID NO: 23614 - RNA, 1344 nt, Artificial Sequence
  derived and/or modified sequence opt3 from Pertuzumab_LightChain
gaggugcagcuggucgaaagcggcgggggacucguucaacccgguggcucccuuagacugucuugcgccgcuucaggguucaccuuuacagacuacacuauggauugggugaggcaggcaccuggaaagggcuuggaguggguagccgacgugaacccaaauaguggugggagcaucuauaaccagcgguucaaaggacgcuuuacguuauccgucgaucgaucuaagaauacccuguaccuacagaugaacucgcuccgugcggaagacacagcuguguauuacugugccagaaaucugggcccgucauucuauuuugauuacuggggccaagggacucuuguuaccgugagcagugcauccacaaaaggacccucugucuucccucuggccccaagcuccaagucaaccagugguggcacugcugcauuggggugccucgugaaagacuauuuucccgagccuguaacaguuagcuggaacucuggagcccugaccuccggcgugcacacguucccagcuguccugcagucaagcggucucuacaguuuaucuuccguggugacuguccccagcucgucucuggggacccagacauacauuuguaauguuaaccauaagccuuccaauacuaagguggauaaaaagguagaaccaaaaucaugcgacaagacccacacauguccgcccugcccugccccagagcuuuugggaggccccaguguguuucuguucccuccaaaacccaaggauacccuaaugauaagcaggacgccggaggucacuugugugguuguggacgucucccaugaagauccugaggugaaguuuaacugguauguagacggcguugaagugcacaaugcgaaaacaaagccccgggaggagcaguacaacucuaccuaucgcgucgugagcguccucacugugcugcaucaagauuggcuuaaugggaaagaauacaagugcaaaguuucaaacaaggcacugccagccccuaucgagaaaacaauuaguaaggcuaagggacagcccagagaaccacagguguauaccuugcccccuuccagggaggaaaugacgaaaaaucagguaagccucaccugucuggucaaggguuucuacccaucugacaucgccguggagugggagucaaacggccaaccggaaaacaauuauaaaacaacucccccuguuuuagacagugaugggagcuuuuuccuguacuccaagcucaccguggacaaaucucgguggcagcagggaaacgucuucucgugcagcgugaugcacgaggcacuucacaaucauuacacacaaaagucccugucauugaguccaggc

SEQ ID NO: 23615 - RNA, 750 nt, Artificial Sequence
  derived and/or modified sequence opt3 from Pexelizumab_h5g1.1-scFv
auggccgacauccagaugacccaaagccccuccucucugucagcuagugugggcgauagagucacaauuacuugcggggcaagcgagaacauauacggagcccucaauugguaucagaggaagccugguaaagcgccaaaacuucugaucuacggcgcuacgaacuuggccgacgggguuccgucccgguucucuggaucgggcucagguaccgauuauacauuaacuauuagcagucugcagcccgaagacuuugcaaccuacuauugucagaaugugcuaaacacaccucucaccuucgggcaaggaacuaagguagagaucaagcgcacaggcggcgggggauccgguggcgggggaucuggcggugggggaagccaggugcagcugguccaguccggcgccgaaguggagaaaccaggcgcuucaguuaagaaggugaguugcaaagcaagcggguacaucuuuucuaauuauuggauucaauggguccgacaggcccccggacagggucuugaauggaugggcgagauacugccuggguccggaucaaccgaguacgcucagaaguuccaaggccgugugacgaugacugccgauaccagcacaaguacugcguacauggaauugucuucccucagaagcgaggacaccgcaguauauuacugugccagguacuuuuucgguucgucuccaaacuauugguauuuugauguuugggggcagggcacacuggugaccgucuccuca

SEQ ID NO: 23616 - RNA, 345 nt, Artificial Sequence
  derived and/or modified sequence opt3 from Pexelizumab_h5g1.1VHC_+_F_Heavy_Chain_V-Region
caggugcaacugguccagagcggcgccgagguuaagaaacccggggcuuccgugaagguaucuugcaaagcaucaggauacaucuucaguaacuauuggauucagugggugagacaggccccuggucaaggccucgaauggaugggggagauacuuccaggaagcggcuccaccgaauacgcgcagaaguuucaggguagggucacaaugacugcugacacgucuaccucgacagccuauauggagcugagcucauugcggagugaagauacugcaguguacuauugugcccgcuacuucuuuggguccucuccgaauugguauuucguuuggggacagggcacc

SEQ ID NO: 23617 - RNA, 318 nt, Artificial Sequence
  derived and/or modified sequence opt3 from Pexelizumab_h5g1.1VHC_+_F_Light_Chain_V-Region
gacauccagaugacccaaagccccucccugucugccucagugggcgauagagucacaauuacuugcggggcuagugagaacauauacggagcacucaauugguaucagaggaagccugguaaagccccaaaacuucugaucuacggcgcgacgaacuuggcugacgggguuccgagccgguucuccggaucuggcucggguaccgauuauacauuaacuauuucaagccugcagcccgaagacuuugccaccuacuauugucagaaugugcuaaacacaccucucaccuucgggcaaggaacuaagguagagaucaag

SEQ ID NO: 23618 - RNA, 1326 nt, Artificial Sequence
  derived and/or modified sequence opt3 from PF-05082566_HeavyChain1
gaggugcagcugguccaaagcggcgccgaaguuaagaaacccggggagucccucagaaucucuugcaagggaucagguuacaguuucagcaccuauuggauuuccugggugaggcagaugccuggcaaagggcuugaauggaugggaaagauauacccaggcgacucuuauacaaacuacucgccgucauuucagggucagguaacuaucagcgcugauaaaaguauuuccacggcauaucugcaauggucuagcuugaaggccuccgacaccgcgauguacuauugugcucggggguacggaaucuucgauuacuggggccagggcacauuagugacugucucaagugccagcaccaaggggcccucuguguuuccucuggcaccaugcucccgcucaacaagcgagaguaccgccgcucuaggaugucucguuaaagacuauuuccccgaaccugugacugucucuuggaauagcggugcacugacaagcggcgugcacaccuuuccagccguacuucagucgucugggcuguacuccuugucaaguguugugacgguccccagcuccaacuucggaacucagaccuauacaugcaauguggaucauaagccuucuaacacuaaaguggacaagaccgucgagcgaaaauguugcguugaguguccaccgugccccgcuccuccaguggccggccccagcguauuucucuucccuccaaagcccaaggauacacugaugauuucacguaccccggaagugacgugugucgugguugacgugagucacgaggauccugaaguccaauuuaauugguacguggacgguguagagguucauaacgcgaaaacuaagcccagagaggaacaguucaauuccacauuuaggguggucagcgugcugaccgucgugcaccaggauuggcucaacgggaaagaguauaagugcaaaguuucuaauaagggauuaccagcaccuaucgaaaagacuauaucaaagacaaagggccagccccgggagccacaaguguacacccugcccccuagucgcgaagagaugacgaaaaaccagguaagccuuaccuguuuggucaagggcuucuauccauccgacaucgccguggagugggaaucuaaugggcagccggagaacaauuacaaaacaacucccccuaugcuggauucggacggauccuuuuuccuauacuccaagcucaccguugacaaaucaagauggcaacaggguaacguguucaguugcucugucaugcaugaagcucugcacaaucacuauacacagaaaagccuuucccugucaccaggcaag

SEQ ID NO: 23619 - RNA, 642 nt, Artificial Sequence
  derived and/or modified sequence opt3 from PF-05082568_LightChain1
agcuacgagcugacccagcccccuuccgugucugucucaccaggccaaacagccaguaucacuugcagcggggacaacauuggagaucaguaugcucacugguaccagcagaagccgggucaaucccccguucucgugauauaucaggacaaaaauagaccuucuggcaucccagaaagguucucggggucaaacagcggaaauacggcaacccuuacaauuaguggcacucaggccauggaugaggcggacuacuauugugcuaccuacacagguuuugggucccuggccguauucggaggcggcaccaaguugacuguguuagggcagcccaaagcagccccuucugucacacuguuuccacccagcuccgaagaacuacaagcuaacaaggcaacccucgugugccugaucucagauuucuauccuggagccguuacgguggcuuggaaagccgacaguagcccagucaaggcggguguggaaacuaccacaccgucuaagcaguccaauaacaaauacgcagccucaagcuaccuuagucugacucccgagcaguggaagucucaucgguccuauagcugucagguaacccacgagggcucgacaguugagaaaaccguggcuccuacggagugcucu

SEQ ID NO: 23620 - RNA, 1341 nt, Artificial Sequence
  derived and/or modified sequence opt3 from Pidilizumab_HeavyChain1
caggugcaacugguccagagcggcuccgagcucaagaaacccggggccucuguuaagaucucaugcaaagcuaguggauacaccuucacaaacuaugguaugaauugggugagacaggcaccuggccaggggcuucaauggaugggauggauuaacacugacagcggcgaauccacguacgccgaggaauuuaaggguagguucguauuuucucuggauaccucggugaauacagcguauuugcagauaacuucauuaaccgcugaggacacagggauguacuucuguguccgggugggauaugaugcccuggacuacuggggccagggcacccuaguuacugugagcagugcauccacaaaagggccaucugucuuuccgcucgcccccagcuccaagucaaccaguggagguacggcugcacugggcugccuugugaaggauuauuucccugaaccaguaacuguuagcuggaacucuggggcccugaccuccggagugcacacauuucccgcugucuugcagucaagcggccucuacagucugucuuccguggugacugucccuagcucgucucuggguacccaaacauacaucuguaauguuaaccauaaaccauccaauaccaagguggacaaacgcguagagcccaagucaugcgauaaaacgcacacuuguccuccaugcccggcccccgagcucuuagggggaccuaguguguuccuguuuccacccaagccuaaggacacacuuaugauuagccgaaccccagaagucacuugugugguuguggaugucucccaugaggaccccgaagugaaauucaacugguauguagauggcguugaggugcacaaugcgaagacaaaaccgcgugaggaacaguacaacucuaccuauagagucgugagcgucuugacggugcugcaucaggacuggcuaaauggcaaggaguacaaaugcaagguuucaaacaaagcacucccugcccccaucgaaaagaccauuaguaaggcuaaagggcagccaagggagccucaaguguauacacugcccccaucccgggaagagaugacuaagaaucagguaagccuuaccugucuggucaaaggauuuuaccccucugauaucgccguggagugggaaucaaacggucagccugagaauaacuauaagacaacuccaccgguuuuggacagugacggcagcuucuuucucuacuccaaacugaccguggauaagucucgcuggcaacaggggaacgucuucucgugcagcgugaugcacgaagcauuacacaaucauuacacacagaagucccugucacucagucccggaaaa

SEQ ID NO: 23621 - RNA, 639 nt, Artificial Sequence
  derived and/or modified sequence opt3 from Pidilizumab_LightChain1
gagaucgugcugacccagagccccuccucucucucagccagugucggcgacagaguuacaauuacuugcagcgcuagguccucugugucguacaugcacugguuccaacagaagccugggaaagcaccaaaacuuuggauauaucggacgucaaaccuggccagcggaguaccgagucgcuuuuccgguucuggcagcgggaccuccuacuguuugacaaucaauucauuacagcccgaagauuucgcgacuuauuacugccagcaacgaaguagcuuuccucugaccuucggaggcgguacaaagcuagagauuaagcguaccguggcugccccaucugucuuuaucuuucccccuuccgacgaacagcucaaaucagggacugcaagcgugguuugucugcuuaacaauuucuauccaagagaggccaaggugcaguggaaggucgauaacgcucugcagaguggaaauucucaagaauccgugacagagcaggacagcaaagauucgaccuacucuuuguccucaacgcucacucugaguaaggcagacuaugagaaacauaagguauacgccugcgaaguuacccaccagggccugagcucccccgugacaaaaucuuucaacaggggcgagugu

SEQ ID NO: 23622 - RNA, 1350 nt, Artificial Sequence
  derived and/or modified sequence opt3 from Pinatuzumab_vedotin_HeavyChain1
gaggugcagcuggucgaaagcggcgggggacucguucaacccgguggcucccuuagacugucuugcgccgcuucaggguacgaguucaguaggagcuggaugaacugggugcggcaggcaccuggaaagggcuuggaauggguaggucgcaucuauccaggggacggagauaccaauuacuccggcaaauuuaagggccgauucacaauuucugccgacacuucgaaaaacacggcguauuuacagaugaauagccugcgugcugaggauaccgccguguacuauugugcaagagacgggucaaguugggauugguacuuugacgucuggggacaggguacauuagugacuguuuccucugccagcaccaagggcccguccguguucccccucgcuccuucaaguaaaagcacaucugggggaaccgcagcccugggcugccuugucaaggauuauuuuccagaacccgugacuguauccuggaacucaggugcucugacaagcgggguucacaccuucccugccguguugcaaaguucuggacucuacucccugagcucggucgugacggugccaucuuccucacugggcacucagaccuacauauguaaugucaaccauaagcccaguaauacaaaaguugacaagaaaguggagccuaagagcugcgauaaaacucacaccuguccaccgugccccgcgccugagcucuuaggcgggccauccguauuucuguuucccccuaagccaaaggacacacuuaugaucucuaggacccccgaagugacgugugucgugguugaugugagccaugaggacccggaagucaaauuuaacugguauguggauggaguagagguucacaaugcaaagacuaaaccucgggaggaacaguacaacucaacauaucgcguggucaguguguugaccguccugcaucaggacuggcuaaaugguaaggaguacaaaugcaagguguccaacaaagcccuccccgcuccaauugaaaagacuaucagcaaggccaaaggccaaccuagagagccccagguuuauacacugccacccucuagggaagagaugaccaagaaucaggugucacuuacgugucugguaaaaggguucuacccuagugacauugcagucgagugggaaagcaacggacagccagagaauaacuauaagaccacaccgcccguguuggauuccgacggcucuuucuuccucuacucgaaacugacuguugauaagagccgguggcaacaggguaacguguuuuccugcucagucaugcacgaagcucuacacaaucauuacacccagaagagucugucucucagcccugggaaa

SEQ ID NO: 23623 - RNA, 657 nt, Artificial Sequence
  derived and/or modified sequence opt3 from Pinatuzumab_vedotin_LightChain1
gacauccagaugacccaaagccccuccucucugucagccagugugggcgauagagucacaauuacuugcaggagcucccagucuauaguucacucgguggggaacacguuccucgagugguaccagcagaagccuggaaaagcuccaaaacuucugaucuauaagguaucaaaucgguuuagcggugugccgagucgcuucuccggcucugggagcggaaccgacuuuacauugacuauuuccucauuacaacccgaagauuucgcaaccuacuauuguuuucagggcagucaguucccuuacacauuuggucaggggaccaaggucgagaucaaacgaacuguggccgcgccaagcguuuucauuuuucccccuucugacgaacaacugaaguccggaacagcuucaguggucugccuacucaacaauuucuauccacgugaggccaaggugcaguggaaaguagauaacgcacugcagagcggcaauagucaggaaucuguuaccgagcaagacuccaaggauagcacguacucgcuuucuuccacucugaccuugucaaaagccgacuaugagaagcauaaaguguacgcuugugaagucacacaccagggccucaguagccccgugacuaaguccuuuaacagaggggagugc

SEQ ID NO: 23624 - RNA, 1023 nt, Artificial Sequence
  derived and/or modified sequence opt3 from Placulumab_chain1
gacauccagaugacccaaagccccuccucucugucagccagugugggcgauagagucacaauuacuugcagggcuagccaggcaauagacuccuaccuccacugguaucagcagaagccugggaaagccccaaaacuucugaucuacucugcgucgaacuuggagacgggaguuccgucacgguucagcgguaguggcuccgggaccgauuuuacauuaacuauuucuagccugcuacccgaagacuucgcuaccuauuacugucaacaggugguauggcgcccuuuuacauucggacagggcaccaagguggagaucaagcgagucgaaccaaaauccucagauaagacucauacaugcccgccuuguccagcccccgagcuccugggugggccuaguguguuucuuuucccaccgaagcccaaagacacccugaugauuagccguacgccugaaguuacuugcguggucguggauguaucucacgaggacccagagguuaaguuuaauugguauguggauggagucgaagugcauaacgcaaaaaccaagcccagagaggaacaguacaauuccacauauaggguggucucaguuuugacugugcuccaccaagacuggcugaacggcaaagaguacaaguguaagguaagcaauaaagcccugccugcuccaaucgagaagaccauaaguaaagcaaagggccagccccgggaaccccagguguacacacucccucccucucgcgaugaguuaaccaaaaaccaggucucccugacgugccuugugaagggguucuauccaagcgacaucgccguugaaugggagucgaauggacaaccugaaaacaauuacaaaacuacacccccaguguuggauucugacgguuccuuuuuccuguauucaaagcuaaccgucgacaagaguagauggcagcagggcaacguguuuagcuguuccguaaugcaugaggcucuccacaaucacuacacucaaaaaucucugagccuuucacccgggaag

SEQ ID NO: 23625 - RNA, 1023 nt, Artificial Sequence; identical to SEQ ID NO: 23624
  derived and/or modified sequence opt3 from Placulumab_HeavyChain1

SEQ ID NO: 23626 - RNA, 1341 nt, Artificial Sequence
  derived and/or modified sequence opt3 from Plozalizumab_HeavyChain1
gaggugcagcuggucgaaagcggcgggggacucguuaagcccgguggcucccuuagacugucuugcgccgcuucaggguucaccuuuagugcauacgccaugaacugggugaggcaggcgccuggaaaaggcuuggaguggguaggucggauccgcacaaagaauaacaauuaugcuacuuacuaugccgacagcgugaaagaucgauucacgauuucccgugacgauucuaagaacaccuuauaccugcagaugaauagucuaaaaacagaagacacugcagucuauuacuguaccacauuuuaugggaacggaguguggggccagggcacccucguuacugugucaagcgccaguacaaaggggccauccgucuucccgcuggcucccucuagcaaguccaccucaggagguacggcagcccuuggcugccuggugaaagauuacuuuccugagccaguaacuguuaguuggaauagcggggcuuugaccucuggagugcacacauuccccgccguccuccaguccucaggccuguacagccugaguucuguggugacugucccuuccagcucgcucgguacccaaacauauauauguaacguuaaucauaagccaucuaacaccaaaguggacaagaaaguagaacccaaguccugcgauaagacgcacacuuguccuccaugcccggcgcccgaguuagcaggggccccuucaguguuucuguucccacccaaaccuaaggacacacuuaugaucaguagaaccccagaggucacuugugugguuguggaugucagccaugaagaccccgaggugaaauuuaauugguacguagauggaguugaagugcacaacgcuaagacaaaaccgagggaggagcaguauaauuccaccuaccgggucgugucugucuugacggugcugcaucaggacuggcuaaacggcaaggaauauaaaugcaagguuagcaauaaggcccucccugcacccauugagaaaaccaucucaaaggcuaaaggccagccacgcgaaccucaaguguacacacugcccccaaguagagaugagcuuacuaagaaccagguaucccugaccuguuuggucaaaggguucuaucccagcgacauugccguggaaugggagucuaacggacagccugagaauaacuacaagacaacuccaccgguucucgacucagaugguucguuuuuccuguacagcaaguuaaccguggacaaauccagguggcagcaaggcaaugucuuuucuugcucggugaugcacgaagcgcugcacaaccauuauacacaaaagagccucucccuuucacccgggaaa

SEQ ID NO: 23627 - RNA, 657 nt, Artificial Sequence
  derived and/or modified sequence opt3 from Plozalizumab_LightChain1
gacguggucaugacccagagcccccugucccucccuguuacacuuggccaaccagccucuaucucaugcaagaguagccagucccuguuggauucugacgggaaaacuuucuuaaacugguuucagcagagaccgggacaaucgcccaggcggcugauuuaccuagugucaaagcucgauagcgguguaccugaccgcuucaguggcuccgggucuggaacggauuuuacccugaaaauaagccgaguggaggcugaagacgucggcguguauuacuguuggcaggguacacacuucccauauacuuuugggcagggaacccgucuugagaucaagagaacaguugcagcccccuccguguucauuuuuccuccaucagaugaacagcugaaaaguggcaccgcgagcgucgugugcuugcucaauaacuucuaccccagggaggcuaagguacaauggaagguugacaaugcccugcagucuggcaacucccaggaaucagugacugagcaggauagcaaagacaguacauauucucuguccagcacccucacguuaucgaaggcagauuacgagaaacauaaggucuaugccugugaagugacucaccaagggcugucuuccccugugaccaaaucauuuaaucggggagagugc

SEQ ID NO: 23628 - RNA, 1341 nt, Artificial Sequence
  derived and/or modified sequence opt3 from Pogalizumab_HeavyChain1
gaggugcagcugguccaaagcggcgccgaaguuaagaaacccggggcuuccgugaagguaucuugcaaagcaucaggauacaccuucacagacaguuauaugagcugggugagacaggccccuggucagggccucgaguggaucggggauauguacccagacaacggagauuccucuuauaaucagaaguuuagggaacgggucacuauuacgcgcgacaccucgacaucaacugcguaccuugagcugagcaguuugcgauccgaagauaccgcuguguauuacuguguuuuagccccgcguugguauuucucuguguggggccaagguacacuggucaccgugagcuccgcaucaacuaaagggcccaguguauuuccucuagccccaagcucuaaguccacaucaggaggcaccgcugcacucggcugccugguuaaggacuacuuccccgagccugugacggucagcuggaacaguggggcccuuacuucuggagugcacaccuuuccagcugugcugcaguccagcgguuuguacucgcucucuuccgucguuacagugcccucaaguagccugggcacucagaccuauauauguaauguaaaccauaaaccuuccaauacaaagguggauaaaaaggucgagccaaaaucuugcgacaagacccacacguguccgcccugcccugccccagaacugcucgggggacccagcguguucuuauuuccuccaaagcccaaagauacucugaugaucucaagaacaccggagguuaccuguguggucguggacguaagucaugaagauccugagguuaaguucaacugguacguggacggcgucgaggugcacaaugcgaaaacuaagcccagggaggaacaguauaacuccacauaccgggucgugagcguucuuaccguguugcaucaagauuggcugaaugguaaagaauauaagugcaaaguaucuaacaaggcacuaccagccccuauugagaagacgaucucaaaagcuaaggggcagccccgcgaaccacaggucuacacccugcccccuaguagagaggagaugacuaaaaaucaggugagccucacaugucuuguuaagggauuuuauccauccgacauugccguggaaugggagucuaacggccaaccggaaaauaacuacaaaaccacacccccuguccuggacucggauggcagcuucuuuuuguacuccaagcucacuguggacaagucaagguggcagcaggggaauguauucaguugcucugugaugcacgaggcacugcacaaccauuauacccaaaagagcuuaucccugucaccaggaaaa

SEQ ID NO: 23629 - RNA, 642 nt, Artificial Sequence
  derived and/or modified sequence opt3 from Pogalizumab_LightChain1
gacauccagaugacccaaagccccuccucucugucagccagugugggcgauagagucacaauuacuugcagggcuagccaggacauauccaacuaccucaauugguaucagcagaagccugggaaagcaccaaaacuucugaucuacuauacgucucgguugcgcucgggaguuccgucacgauucagcgguaguggcuccgggaccgauuuuacauuaacuauuucuagccugcaacccgaggacuucgccaccuacuauugucagcagggacacacacuaccuccaaccuuuggccaggguacuaagguggaaaucaagcguacaguagcggcucccuccguguucauuuuuccuccaucagaugagcaacucaaaagugggaccgccagcgucgugugccugcuuaacaauuucuaccccagagaagcaaagguucaguggaagguggacaacgcccugcagucuggaaauucccaggagucagucacggaacaagauagcaaagacaguacuuauucuuuguccagcacccucacacugucgaaggcugauuacgagaaacauaagguguacgcaugugagguaacucaccagggccugucuuccccuguuaccaaaucauuuaacaggggcgaaugc

SEQ ID NO: 23630 - RNA, 1341 nt, Artificial Sequence
  derived and/or modified sequence opt3 from Polatuzumab_vedotin_HeavyChain1
gaggugcagcuggucgaaagcggcgggggacucguucaacccgguggcucccuuagacugucuugcgccgcuucaggguacaccuucaguagcuauuggaucgagugggugaggcaggcaccuggaaagggcuuggaauggauuggugagauauuaccagggggaggcgacacaaacuacaaugaaaucuuuaaaggccgggccacuuucuccgcggauacgucuaagaacaccgcuuaucugcagaugaacucgcuacgcgccgaggacacagcaguauacuauuguacucgacgugugccgauuagacucgauuacugggggcagggaacccuggucacagugucaagcgccaguaccaaaggucccuccguuuuuccucuugcuccaucuagcaaguccacuucaggcgggacagcagcccugggaugcuuggugaaagacuauuuccccgagccugucaccgugaguuggaauagcggcgcucucacgucugguguacacacuuuuccagccguucugcaauccucagggcuguacagccucaguucuguggucaccgugcccuccagcucguuaggaacacagacuuacaucuguaaugugaaccauaagccuucuaauaccaaggucgauaaaaagguugaaccaaaauccugcgacaagacacacaccuguccgcccugcccugcgccagagcugcuuggcggccccucaguguucuuguuuccuccaaaacccaaggauacgcugaugauuaguaggacuccggaaguaacauguguggucguggacguuagccaugaggauccugaggugaaguucaacugguaugucgacgggguggaaguacacaaugcaaaaaccaagccccgggaggaacaguacaacuccacuuaucgcguugugucuguccuaacagugcuccaucaggauuggcugaauggaaaagaguacaagugcaaagucagcaacaaggcccuuccagcuccuaucgaaaagaccauaucaaaggccaagggucaacccagagagccacagguguauacgcugcccccuaguagggaggaaaugaccaaaaaucagguuuccuugacaugucucgugaagggcuuuuacccaagcgacaucgcaguagagugggaaucuaacgggcagccggagaauaacuauaaaacuacacccccuguccuggauucagacggaaguuucuuuuuauacagcaagcugaccguggacaaaucccgguggcaacagggcaacguuuucucuugcucggugaugcacgaagcucuccacaaucauuacacucagaaaagccuuucccugucaccagguaag

SEQ ID NO: 23631 - RNA, 654 nt, Artificial Sequence
  derived and/or modified sequence opt3 from Polatuzumab_vedotin_LightChain1
gacauccagcugacccaaagccccuccucucucucagccagugugggcgauagagucacaauuacuugcaaggcuagccaguccguugacuacgagggggauucuuuccuuaacugguaucagcagaaaccuggaaaggcaccaaaacuguugauauacgccgcgucgaauuuagaaucaggugugccgagcagguuuaguggcuccgggucuggaacggacuucacccugacaaucagcucccuacaacccgaggauuuugcuacuuauuacugucagcagucaaacgaagacccucucaccuucggccaggguacaaagguagagauuaaacggaccguggccgcaccaagugucuuuaucuuucccccuagcgaugaacaacugaagucugggacugccuccgugguuugccuucugaauaacuucuauccacgcgaggcuaaggugcaguggaaagucgacaaugcauugcagucaggaaacagccaggagagugugacagaacaagauucuaaggacuccaccuacagccucucgucuacgcugacucuguccaaagccgauuaugagaagcacaaaguauacgcuugugaaguuacccaucagggccucucaagucccgugacaaagagcuucaaucgaggcgagugc

SEQ ID NO: 23632 - RNA, 1326 nt, Artificial Sequence
  derived and/or modified sequence opt3 from Ponezumab_HeavyChain1
caggugcaacugguccagagcggcgccgagguuaagaaacccggggcuuccgugaagguaucuugcaaagcaucaggauacuauaccgaagccuacuauauccacugggugagacaggcgccuggucagggccucgaguggauggggaggauugacccagcuacaggaaacacuaaguacgccccgcggcuucaagaucgcgucacgaugacccgagacacaaguacuagcaccguguauauggaacuguccucuuugcguucggaggauacagcaguuuacuauugugccucauuauacagccugcccguguacuggggccaggguaccacugucacagugaguuccgcuucuaccaaagggccuagcguauucccacuagcacccugcuccagaucaacgagugaaagcacugccgcucucggaugucugguuaaggacuauuuuccugagccagugaccgucucuuggaacuccggcgcccuuacaucaggcgugcauacuuuccccgcggugcugcagagcaguggguuguacucucucuccagcgucguuaccgugccuucgucuaauuuuggaacacagaccuauacgugcaauguagaucacaagccauccaacacuaaaguggacaagacagucgagaggaaauguugcguggaauguccgcccugcccugcaccacccguugccgguccuucaguguuccuguuuccacccaagccgaaagauacccugaugauaagucggacuccugaggucacaugugugguaguugacgugagccaugaagaucccgagguccaauucaauugguacguggacggcgucgaggugcacaacgcuaagaccaagccacgcgaggaacaguuuaauuccacguucagaguugugucuguacucaccgucgugcaucaggauugguuaaacgggaaagaauauaagugcaaaguuagcaauaagggacugccuucaaguaucgagaaaacaauuuccaagacuaaaggccagcccagggaaccacaaguguacacccuucccccuagccgggaggagaugacaaagaaccaggucucuuugacuugucuggugaaggguuuuuauccaucagacaucgccguagaaugggagaguaaugggcagccggaaaacaauuacaaaaccacacccccuaugcuagauagcgacggauccuucuuucucuacucuaagcugaccguggacaaaucgcgcuggcaacagggcaacguuuucagcugcuccgucaugcacgaggcacuucacaaucauuauacucagaagucacugaguuugucuccaggcaaa

SEQ ID NO: 23633 - RNA, 657 nt, Artificial Sequence
  derived and/or modified sequence opt3 from Ponezumab_LightChain1
gacguggucaugacccagagcccccugucccucccuguuacacuuggccaaccagccucuaucucaugcaagaguagccagucccuguuguacucugaugcuaaaacuuauuuaaacugguuccagcagagaccggggcaaucgcccaggcggcugauuuaccagauaucacgccuagacccuggagugccagaucgauuuagcgguaguggcuccgggacggacuucacccucaagaucucucguguagaggcagaagaugugggagucuauuacugucugcagggcacacacuaucccgugcuuuuuggucaggggacuagacuggagauuaaaaggaccguugccgcgccuagcguguucaucuuuccacccuccgacgaacaauugaagucaggaacagcuagugucgugugccuccugaauaacuucuacccucgggaggccaaaguacaguggaagguugauaaugcacugcagagcggcaacucucaggaauccgugaccgagcaagacucaaaggauagcacuuauagucucucuuccacauuaacccugagcaaagccgacuacgagaagcauaaagucuacgcuugugaagugacgcaccagggccuuucgucuccagugacuaaguccuuuaaucgcggggagugc

SEQ ID NO: 23634 - RNA, 1362 nt, Artificial Sequence
  derived and/or modified sequence opt3 from Pritoxaximab_HeavyChain1
caggugcaacugcaggagagcggcgccgaacucgucagauccggggcuucuguuaggaugucaugcaaggcaaguggauacaccuucacaagcuauaacaugcacugggugaaacagacucccggucagggccuugaguggaucggguacauuuauccuggaaauggcgguacgaacuacauacaaaaguuuaaagggaaggccauccugaccgcggacacauccucuucgacugcuuauaugcagauuagcagcuugaccagugaagauuccgccguauacuucuguacacggucuccaagccauuauuccucagacccguacuuugauuacuggggacagggcaccacuuuaacagugaguagcgaguucgcaucuaccaaaggccccuccgucuuuccucuggccccaucaagcaagaguacgucugggggaacugcugcacuagguugccucgugaaggacuauuuccccgaaccuguuaccguguccuggaauagcggcgcccugacaucggggguccacacuuuuccagcugugcuucagucuuccggacuguacucauugaguagcguaguuaccgugcccuccucuagccucggcacacaaaccuauaucuguaacgucaaucauaaaccuucaaacacgaagguggauaaaaagguggagccaaaaaguugcgacaagacucacacauguccgcccugcccugccccagagcugcugggugggcccuccgucuuccucuuuccuccaaagcccaaagauaccuuaaugauuagccgcacuccggaaguuacaugugugguaguggacgucucucaugaggauccugaagugaaguucaauugguacguugacggaguggagguccacaacgcgaaaaccaagccccgagaggaacaguauaauucaacguaccgugugguaaguguucugaccgugcuucaccaggauugguugaacggcaaagaguauaagugcaaagucagcaauaaggcacugccagccccuaucgaaaagacaauauccaaagcuaagggccagcccagagagccacaaguguacacucuacccccuucuagggacgaacucaccaaaaaccaggucucgcugacaugucuugugaagggguuuuacccaagcgauaucgccguugagugggaguccaauggacagccggaaaacaauuauaaaacuacacccccugugcuggacucagacgguaguuucuuuuuguacucuaagcucaccguagauaagagccgguggcaacagggcaacgucuucuccugcucagugaugcaugaggcacugcacaaccauuauacccagaaaucauuaucucuguccccagggaag

SEQ ID NO: 23635 - RNA, 642 nt, Artificial Sequence
  derived and/or modified sequence opt3 from Pritoxaximab_LightChain1
gacaucgugaugagccagucccacaaguucaugucuaccucagucggcgauagaguuaguauuacaugcaaagccagccaagacguggggacugcuguagcaugguaccagcagaaccccggacaguccccuaaguuucugauauauugggccucuacgaggcauaccggugugccagaucgguucacaggcucggggucaggaacugacuuuacccucacaaucaccaauguccaaagcgaggaucuugcggacuacuucugucagcaguauaguuccuacccgcugacuuuuggcgcugguacaucuuuggaauuaaaacgcaccguggccgcacccagcguuuucauuuuuccuccauccgaugagcagcugaagucagggacggccaguguggucugccuacucaacaauuucuauccccgagaagcuaaagugcaauggaagguagacaacgcacugcagagcggaaauucucaggaguccguuacugaacaggauucaaaggacagcaccuacagucuuucuuccacacugacuuugagcaaagccgauuaugagaagcacaaaguguacgcuugugaggucacccaucaaggccucucgucuccugugacaaaguccuuuaaccguggcgaaugc

SEQ ID NO: 23636 - RNA, 1350 nt, Artificial Sequence
  derived and/or modified sequence opt3 from Pritumumab_HeavyChain1
gaggugcagcugcucgaaagcggcggggaccuuguccaacccggagguucccugagauugucuugcgccgcuucaggcuucaccuuuaguaacuacgcaaugagcuggguuaggcaggccccugggaagggauuagaguggguguccgcgaucacaccaucuggcgguucgacuaauuaugcugauucaguaaaagggcgguucacgauuagccgcgacaacagucagaauacccuguaccuacagaugaacucccuccgaguggaagauacagccgucuauauauguggacgugugccguacagaucuacuugguauccccuguacuggggccaaggcacccuuguuacagugagcuccgcaucaaccaaggggccuagugucuuuccacuggcccccagcucuaaauccacuucaggagguacagcugcauugggcugccucgugaaggacuauuucccugagccaguaaccguuagcuggaauaguggggcccugacgucuggagugcacacuuuucccgcuguccugcaguccagcggccucuacucguuaucuuccguggugaccgucccuucaaguagccuggguacacagacuuacaucuguaacguuaaucauaaaccauccaacaccaagguggauaagaaaguagaaccgaagucuugcgacaaaacacacaccugucccccuugcccagcccccgagcuuuugggagggccuagcguguuccuguuuccacccaagccgaaagauacgcuaaugauuucaaggacuccugaggucacaugugugguuguggacgucagucaugaagaucccgaggugaaguucaauugguauguagacggcguugaagugcacaacgcgaagaccaaaccacgggaggagcaguacaauuccacuuaucgcgucgugagcguccucacagugcugcaucaagauuggcuuaacggcaaggaauacaaaugcaagguuucuaauaaagcacugccugcccccaucgagaagaccauuucaaaagcuaaggggcagccaagagaaccccagguguauacguugccuccaaguagggacgagcucaccaagaaccagguaagccugacauguuuagucaaaggauuuuacccguccgauaucgccguggaaugggagucuaauggucaacccgagaacaacuauaagacuaccccuccaguucuggacucggacggcagcuucuuucucuacuccaaacuuacaguggauaagucacgguggcagcaggggaaugucuucaguugcucugugaugcacgaagcacugcacaaccauuacacucaaaagagcuugucccuaucacccggaaaa

SEQ ID NO: 23637 - RNA, 642 nt, Artificial Sequence
  derived and/or modified sequence opt3 from Pritumumab_LightChain1
gacauccagaugacccaaagccccuccucucugucagccagugugggcgauagagucacaauuacuugcagggcuagccaggacauauccaacuaccucgcaugguuccagcagaagccugggaaagccccaaagucucuuaucuaugcggcuucgucacugcacagcaaaguuccgacgcaauuuaguggauccgguucuggcaccgauuucacauugacuauuagcuccuuacagcccgaggacuuugccaccuacuauugucugcaguacucaacauauccuaucaccuucgggggaggcacuaagguggaaauuaaacggacaguagcagccccaaguguguuuaucuuucccccuagcgaugagcagcuaaagucugguaccgcuuccgucgugugccuccugaauaacuucuacccacgcgaagcaaagguucaauggaaaguggacaaugcccuucagucagggaacagccaggagagugucacggaacaggauucuaaggacuccacuuauagccugucgucuaccuugacacucuccaaagcugauuacgagaagcauaaaguguacgccugugagguaacucaccaaggacugucaagucccguuaccaagagcuucaaucgaggcgaaugc

SEQ ID NO: 23638 - RNA, 1341 nt, Artificial Sequence
  derived and/or modified sequence opt3 from Quilizumab_HeavyChain1
gaggugcagcuggucgaaagcggcgggggacucguucaacccgguggcucccuuagacugucuugcgccgcuucaggguucaccuuuagugacuacggaaucgcaugggugaggcaggccccuggcaaggguuuggaguggguagcguucauuagcgauuuagcuuauacaauauacuaugccgacacugugacggggcgguuuaccaucucccgcgauaacucuaaaaauacacuguaccuacagaugaacucgcuccgagcagaagacacugccgucuauuacugugcucgugauaauugggacgcaauggauuauuggggacagggcacccuggugacaguuucaagcgccaguaccaagggcccauccguguucccgcuugcucccucuagcaaauccacuucagggggaacagccgcgcuggguugcuuggucaaggacuacuuuccugagccagugaccguaaguuggaacagcggcgcacucacgucugggguucacacuuuccccgccgugcugcaauccucaggacuguacagccucaguucugucgugaccgugccuuccagcucguuaggcacacagacuuauauuuguaaugucaaccauaaaccaucuaauaccaagguugauaagaaaguggaacccaaguccugcgacaaaacacacaccuguccuccaugcccggcucccgagcugcuuggugggccuucaguauuuuuguucccacccaagccuaaagauacgcugaugaucaguagaacuccagaggugacaugugucgugguugacgugagccaugaagaucccgaggucaaguuuaacugguacguggacggaguagaaguucacaaugccaagaccaaaccgagggaggagcaguauaacuccacuuaccggguggucucugugcuaacaguccuccaucaggacuggcugaauggcaaggaauauaaaugcaaggugagcaacaaagcacuuccugcucccauugagaagaccaucucaaaagccaagggccaaccacgcgaaccucagguuuacacgcugcccccaaguagagaggaaaugaccaagaaucagguguccuugacaugucucguaaaaggguucuaucccagcgauauagcggucgagugggagucuaacggacagccugaaaauaacuacaagacuaccccaccggugcuggacucagaugguagcuuuuucuuauacaguaaacugacaguugacaaguccagguggcaacagggcaacguguuuucuugcucggucaugcacgaggcccuccacaaucauuauacucagaaaagccuuucccugucacccgggaag

SEQ ID NO: 23639 - RNA, 657 nt, Artificial Sequence
  derived and/or modified sequence opt3 from Quilizumab_LightChain1
gacauccagaugacccaaagccccuccucucugucagccagugugggcgauagagucacaauuacuugcaggagcucccagucucucguucacaacaaugcuaacacguaccuucauugguaucagcagaagccugggaaagcaccaaagcuguugauauacaaagugucgaaucgguucucaggaguaccgagccgcuuuagugguuccggcucugggaccgacuucacauuaacuaucagcucccugcaacccgaggauuuugccaccuauuacuguucacagaacacccuagugccuuggacauucggacagggcacuaaggucgaaauuaaacgaacaguggcggcuccaaguguuuuuaucuuucccccuagcgacgagcagcucaagucugguaccgccuccguggucugccugcuuaauaacuucuauccacgugaagcaaaggugcaauggaaaguagauaaugcccugcagucagggaacagccaggagaguguuacggaacaggacucuaaggauuccacuuacagcuugucgucuacccucacacuguccaaagcugacuaugagaagcacaaaguguacgcaugugaggucacucaucaaggacugucaagucccgugaccaagagcuucaauagaggcgaaugc

SEQ ID NO: 23640 - RNA, 1335 nt, Artificial Sequence
  derived and/or modified sequence opt3 from Racotumomab_HeavyChain1
caggugcaacugcagcagagcggcgccgagcucgucaagcccggggcuuccguuaaacuuucuugcaaggcaucaggauacaccuucacaaguuaugacaucaacugggugagacagaggccugaacaaggucuggaguggauuggcuggauauuuccaggggauggaagcacuaaauacaaugaaaaguucaaaggcaaggccacguugaccacagacaaguccucuucgacugcguauaugcaguuaucacggcugaccagcgaggauagugcuguauacuuuugugcccgcgaagacuauuacgauaacuccuauuacuucgacuacuggggucaggggacaacccuaacugugucuagcgcaaaaacaaccccgcccuccgucuauccucucgccccaggaucagcugcacagacgaauaguauggugacucugggcugccuuguuaagggcuacuuucccgagccugugaccgucacauggaacagcgggucucuguccucaggagugcacacuuucccagccguauugcaaagcgaucucuauacccugaguucuuccguuacagugcccagcucgccucgaccaucugagaccgucacguguaauguggcucauccggccuccucaacuaaaguggacaagaaaaucgucccccgugauugcgguuguaagccuugcauuuguacaguuccagaagugaguagcguauuuaucuuucccccuaagccaaaagacgugcugaccauuacucucacacccaaggugaccugcgucguuguggauaucuccaaagacgauccggagguccaguucucuugguucguggacgacguagaaguucacacggcgcagacccagccuagagaggagcaauuuaacagcacauucaggucagugagugaauuacccauaaugcaucaggauuggcugaauggcaaggaguuuaaaugucgggucaacuccgcagccuucccagcuccuaucgaaaagacuauuagcaaaaccaaggggcgccccaaggccccacagguguacacaauucccccuccaaaagagcaaauggcaaaggacaaagucucucuuacuugcaugaucaccgauuucuuuccggaagacaucacaguggaguggcaguggaauggacagcccgcugagaacuauaagaauacccagccuauaaugaacacuaauggcucauacuucguuuauaguaaauugaacgugcaaaagagcaauugggaagccgguaacacguuuacauguuccguacugcacgaggggcuacauaaccaccacaccgaaaagucucucucgcauagcccaggaaaa

SEQ ID NO: 23641 - RNA, 642 nt, Artificial Sequence
  derived and/or modified sequence opt3 from Racotumomab_LightChain1
gacauccagaugacccaaacaacuagcucccugucugccucacucggcgauagagugacgauuaguugcagggcuagccaggacauauccaacuaccuuaauugguaucagcagaagcccgaugggaccgucaaacuguugaucuacuauacaucucgguuacacucgggaguuccuucacgcuucagcgguaguggcuccgggacugacuacucucugaccauuagcaaccuagagcaagaagauaucgcaacauauuuuugucagcagggaaauacccucccauggacuuucggcggugggacaaagcuggagauuaaacgagccgacgcggcuccgaccguguccaucuuucccccuucaagugaacagcuuacgagcggaggcgccucuguagugugcuuccugaacaauuuuuacccaaaggauauaaacgucaaauggaagaucgacggcuccgagcgucaaaaugggguguugaacucauggacugaucaggacagcaaggauaguaccuauucuauguccagcacacucacucugaccaaagacgaauacgagagacauaauucguacacaugugaggcaacccacaagacgucuacuucccccauuguuaaaucauucaacaggaaugaaugc

SEQ ID NO: 23642 - RNA, 1089 nt, Artificial Sequence; identical to SEQ ID NO: 23580
  derived and/or modified sequence opt3 from Racotumomab_scVH-VH'-VH_chain

SEQ ID NO: 23643 - RNA, 1071 nt, Artificial Sequence
  derived and/or modified sequence opt3 from Radretumab_HeavyChain1
gaggugcagcugcucgaaagcggcgggggacuuguccaacccgguggcucccugagauugucuugcgccgcuucaggguucaccuuuaguagcuucuccaugucuuggguuaggcaggcaccuggaaagggcuuagagugggugucgucaaucagcgguaguuccgggacaacuuacuaugccgacucuguaaaaggacgguuuacgauuagccgcgauaacuccaagaauacccuguaccuacagaugaacucacuccgagcggaagacacagcuguguauuacugugccaaaccauucccguauuuugauuacuggggccagggcacucuggucaccgugaguagcggggacggaucuuccgguggcucagggggagcaagcgagauaguucuuacacaaagucccggcacccugucuuuguccccuggugaacgugccacucucagcugcagagcuucgcagucuguguccucaaguuuccuggcaugguaucagcagaagccagggcaagcccccaggcugcucaucuacuacgcuagcucccgggccacaggcauuccugaucgcuuuucuggaagcggcucagggaccgacuucacguuaacuaucaguagacuggagccagaggauuuugcggucuauuacugucagcagaccggaaggauucccccuacauucggucagggcacuaaaguggaaaucaaguccgggggaagcggcgguccacgggcagccccggagguauaugcuuuugccacccccgaauggccugggucucgcgacaagcgaacacuugcaugcuugauacaaaauuucaugccagaggauaucucaguucaguggcugcacaacgaggugcagcuacccgacgcuagacauaguaccacgcaaccuaggaaaacuaagggcagcggauuuuucgucuucucccggcucgaagugacacgugccgagugggaacagaaagaugaguuuauuugucgcgcggugcacgaagccgcaucuccaucgcagaccguccagagagcuguuagcgugaaucccgaguccucaaggcggggcgggugc

SEQ ID NO: 23644 - RNA, 414 nt, Artificial Sequence; identical to SEQ ID NO: 23595
  derived and/or modified sequence opt3 from Radretumab_j_chain

SEQ ID NO: 23645 - RNA, 1368 nt, Artificial Sequence
  derived and/or modified sequence opt3 from Rafivirumab_HeavyChain1
caggugcaacugguccagagcggcgccgagguuaagaaacccggguccucugugaagguaucaugcaaagcuaguggagguaccuucaacagauacacagugaauugggucaggcaggcaccuggccaggggcucgaauggaugggaggcaucauuccaauauuugguacugccaacuaugcgcaacgguuccaggggcgccuuacgaucaccgcugacgagagcacauccacugccuacauggaacugucuucguugcgaucagaugacaccgcaguguauuuuugugcccgugagaauuuagauaacagcggaacauacuauuacuucaguggcugguuugacccguggggccaggggacccugguuacuguguccucugcuagcacaaagggacccuccgucuucccucuagcaccaucaaguaaaagcaccucugguggcacggccgcucucgggugccuggugaaggauuauuuucccgaaccuguaacuguuuccuggaacucaggagcccuuaccagcggcgugcacacauucccagcgguccugcagaguucugguuuguacucccucagcucgguggugacuguccccucuuccucacuggggacccaaacauacauuuguaauguuaaucauaagccuaguaacaccaaaguggacaagagaguagagccaaaaagcugcgauaagacgcacacuuguccgcccugcccugcaccagagcugcucggaggccccuccguguuuuuauucccuccaaaacccaaggacacacugaugaucucuaggaccccggaagucacuugugugguuguggaugucagccaugaggacccugaagugaaguuuaauugguauguagauggcguugaggugcacaacgccaaaacaaagccccgggaggaacaguacaauucaaccuaucgcgucgugaguguccuuacgguguugcaucaggacuggcugaacgggaaagaguacaagugcaaaguuuccaauaaggcucuaccagccccuauugagaaaaccaucagcaaggcaaagggacagcccagagaaccacaaguguauacacugcccccuucuagggaagagaugacuaaaaaccagguaucacucaccugucuugucaaggguuucuacccaagugauauagcuguggagugggaaagcaauggccagccggagaacaacuauaaaacaacucccccuguucuggacuccgacgggucguuuuucuuguacucuaagcucaccguggauaaaagccgguggcaacagggaaaugucuucuccugcucagugaugcacgaagcccugcacaaccauuacacacagaagaguuuaucucugagcccaggc

SEQ ID NO: 23646 - RNA, 1368 nt, Artificial Sequence
  derived and/or modified sequence opt3 from Rafivirumab_HeavyChain
gaggugcagcugguccaaagcggcgccgaaguuaagaaacccggguccucugugaagguaucaugcaaagcuaguggagguaccuucaacagauacacagugaauugggucaggcaggcaccuggccaggggcucgaguggaugggaggcaucauuccaauauuugguacugccaacuaugcgcagcgguuccaagggcgccuuacgaucaccgcugacgaaagcacauccacugccuacauggagcugucuucguugcgaucagaugacaccgcaguguauuuuugugcccgugaaaauuuagauaacagcggaacauacuauuacuucaguggcugguuugacccguggggccaggggacccugguuacuguguccucugcuagcacaaagggacccuccgucuucccucuagcaccaucaaguaaaagcaccucugguggcacggccgcucucgggugccuggugaaggauuauuuucccgagccuguaacuguuuccuggaacucaggagcccuuaccagcggcgugcacacauucccagcgguccugcagaguucugguuuguacucccucagcucgguggugacuguccccucuuccucacuggggacccagacauacauuuguaauguuaaucauaagccuaguaacaccaaaguggacaagagaguagagccaaaaagcugcgauaagacgcacacuuguccgcccugcccugcaccagaacugcucggaggccccuccguguuuuuauucccuccaaaacccaaggacacacugaugaucucuaggaccccggaggucacuugugugguuguggaugucagccaugaagacccugaggugaaguuuaauugguauguagauggcguugaggugcacaacgccaaaacaaagccccgggaggaacaauacaauucaaccuaucgcgucgugaguguccuuacgguguugcaucaggacuggcugaacgggaaagaauacaagugcaaaguuuccaauaaggcucuaccagccccuauugagaaaaccaucagcaaggcaaagggacagcccagagaaccacagguguauacacugcccccuucuagggaggagaugacuaaaaaccaaguaucacucaccugucuugucaaggguuucuacccaagugauauagcuguggaaugggagagcaauggccagccggaaaacaacuauaaaacaacucccccuguucuggacuccgacgggucguuuuucuuguacucuaagcucaccguggauaaaagccgguggcagcaaggaaaugucuucuccugcucagugaugcacgaggcccugcacaaccauuacacacagaagaguuuaucucugagcccaggc

SEQ ID NO: 23647 - RNA, 654 nt, Artificial Sequence
  derived and/or modified sequence opt3 from Rafivirumab_LightChain1
cagagcgcccugacccaacccagauccgugucuggcucaccugggcagagugucacaaucagcugcacuggaacguccucugacauugguggcuacaacuucguuucgugguaucagcagcacccagggaaggcuccgaaacucaugauauacgaugcaaccaagaggcccucaggagugccugaccgguuuagcggcaguaaauccgguaauacagccucucuuacuaucagcgggcugcaagcggaggaugaagcugacuauuacuguugcuccuaugccggagauuacaccccaggcguaguguucggcgggggaacaaaguugaccgucuuaggucagcccaaagcagccccuucagugacucuguuuccacccaguagcgaggaacuacaggcuaacaaggcaacacucguuugucugauuucugacuucuauccuggcgccgugaccgucgcuuggaaggccgauuccucaccagugaaagcggggguagagacgacuaccccgagcaagcagaguaauaacaaauacgcagccucuuccuaccuuagccugacacccgaacaauggaagucgcaucgcucuuauuccugccagguuacucacgagggaucaaccguggagaaaacagucgcuccuaccgaauguagu

SEQ ID NO: 23648 - RNA, 654 nt, Artificial Sequence
  derived and/or modified sequence opt3 from Rafivirumab_LightChain
gagagcgcccugacccagcccagauccgugucuggcucaccugggcaaagugucacaaucagcugcacuggaacguccucugacauugguggcuacaacuucguuucgugguaucagcagcacccagggaaggcuccgaaacucaugauauacgaugcaaccaagaggcccucaggagugccugaccgguuuagcggcaguaaauccgguaauacagccucucuuacuaucagcgggcugcaggcggaagaugaggcugacuauuacuguugcuccuaugccggagauuacaccccaggcguaguguucggcgggggaacaaaguugaccgucuuaggucaacccaaagcagccccuucagugacucuguuuccacccaguagcgaagaacuacaggcuaacaaggcaacacucguuugucugauuucugacuucuauccuggcgccgugaccgucgcuuggaaggccgauuccucaccagugaaagcggggguagaaacgacuaccccgagcaagcagaguaauaacaaauacgcagccucuuccuaccuuagccugacacccgagcaguggaagucgcaucgcucuuauuccugccaaguuacucacgagggaucaaccguggagaaaacagucgcuccuaccgaguguagu

SEQ ID NO: 23649 - RNA, 1332 nt, Artificial Sequence
  derived and/or modified sequence opt3 from Ralpancizumab_HeavyChain1
caggugcaacugguccagagcggcgccgagguuaagaaacccggggcuuccgugaagguaucuugcaaagcaucaggauacaccuucacaaguuauuacaugcacugggugagacaggccccuggucagggccucgaauggaugggggagauccauccaagcggaggcaggacuaacuauaaugaaaaguuuaaaucccgggucacgaugacccgcgacacaucuacuucgaccguguacauggagcuuucaagccugcgaagugaagauacagcgguuuauuacugugcucgugagagaccguuguaugccuccgacuuauggggucaagggaccacugugacagucucuagcgcauccaccaagggacccucaguguucccucuggccccaugcaguaggagcacgucugaguccacugcugcacuaggcugucucguaaaggauuacuuucccgaaccuguuaccgugucauggaacagcggcgcccugacaagugggguccacacuuucccagcugugcuucagucuuccggacuguacagcuugucgucuguggucaccguucccuccucaaauuuugguacacagaccuauacgugcaacguggaccauaaaccuaguaauacuaagguagauaaaacaguggagcggaaguguugcgucgaauguccaccgugccccgccccuccaguggcgggccccagcguuuuccucuuuccuccaaaacccaaggacacccugaugauuucccgcacuccggaggugacaugugucgugguagauguuucucacgaggacccugaagugcaguucaacugguacgucgaugggguggagguccauaaugcaaagaccaaacccagagaggaacaauuuaacagcacguucagggugguuucagugcugaccguaguccaccaggacuggcucaauggaaaggaauauaaaugcaaggugaguaacaaaggcuuaccauccagcauagagaagacaaucucuaaaacuaagggucagccucgggagccccagguuuacacccugccacccucacgcgaagagaugacaaagaaucaagugagucuuacuuguuuggucaaaggguuuuauccuagcgauauugccguggaaugggaguccaacggacagccagaaaauaacuacaagaccacaccgcccaugcuggacucugauggcucguucuuucuauauagcaaacucaccguagacaagucccgauggcagcaaggcaauguguucucaugcaguguuaugcacgaggcucugcauaaccacuacacucagaaaucucuuagccuguccccugggaag

SEQ ID NO: 23650 - RNA, 642 nt, Artificial Sequence
  derived and/or modified sequence opt3 from Ralpancizumab_LightChain1
gacauccagaugacccaaagccccuccucucugucagccagugugggcgauagagucacaauuacuugcaaggcuagccaggacguucacacggcaguggccugguaccagcagaaaccugggaaggcgccaaaacuccuuauauaucaugcuuccuacagguauaccggaguaccgucucgguucucggguucaggcagcgggacagauuuuacuuucaccaucaguucccugcaacccgaggacauugccacauacuauugucagcagcgcuacucuuuguggcgaaccuuuggacagggcacuaaguuagaaaucaaacguacaguggcagccccuagcgucuucauuuuuccacccuccgaugagcaacugaagucagguaccgcuagugugguuugccuacucaacaauuucuauccuagagaagcaaaggugcaguggaaagucgacaacgcccugcagagcggaaauucucaggaguccgugacggaacaagauucaaaggacagcacuuacagucuuucuuccacccugacauugagcaaagcugauuacgagaagcacaaaguauaugccugugagguuacucaucaggggcucucgucuccagugaccaaguccuuuaacaggggcgaaugc

SEQ ID NO: 23651 - RNA, 1338 nt, Artificial Sequence
  derived and/or modified sequence opt3 from Ramucirumab_HeavyChain1
gaggugcagcugguccaaagcggcgggggacucguuaagcccgguggcucccuuagacugucuugcgccgcuucaggguucaccuuuaguagcuacuccaugaacugggugaggcaggcaccuggaaaaggcuuggaauggguaucuucgaucucaagcaguuccucuuauauuuacuaugccgacagcgugaagggucgguucacaauaucccgcgauaaugcgaaaaacucauuauaccugcagaugaauagucuacgagcugaggacacugccgucuauuacugugcacgugugacggaugccuuugacaucugggggcagggaaccaugguuacagugagcucugcuuccacuaagggcccaucagucuucccgcucgcacccagcaguaaaucuaccuccggcgggacagccgcucugggaugccuugugaaggauuauuuuccugaaccaguaaccguuagcuggaacucgggugcccugacuucuggcgugcacacauuccccgcggucuugcaauccucagggcucuacagucugagcuccguggugaccgucccuucuagcucacugggaacgcagacuuacauuuguaauguuaaccauaagccaaguaauaccaaaguggacaagaaaguagagcccaaguccugcgauaaaacacacacuuguccuccaugcccggcacccgaacucuuaggcgguccuagcguguuucuguucccacccaagccuaaggacacccuuaugaucucuagaacaccagaggucaccugugugguuguggaugucucacaugaggaccccgaagugaaauuuaacugguauguagaugggguugaggugcacaaugccaagacgaaaccgagggaggaacaguacaacaguacuuaucgggucgugagcgucuugacagugcugcaucaggacuggcuaaauggaaaggaguacaaaugcaagguuuccaacaaagcucucccugcccccauugaaaagaccaucucuaaggcaaaaggccaaccacgcgagccucagguguauacucugcccccaucgagagaagagaugacaaagaaucagguaagccuuaccugucuggucaaaggcuucuaccccuccgauauagcuguggaaugggagucaaacgggcagccugagaauaacuauaagacgaccccaccgguuuuggacagugacggaucuuucuuucucuacagcaaacugacaguggauaaguccagguggcaacaggguaacgucuuuucaugcagcgugaugcacgaagccuuacacaaucauuacacucagaagucucugucccucagucccggcaaa

SEQ ID NO: 23652 - RNA, 642 nt, Artificial Sequence
  derived and/or modified sequence opt3 from Ramucirumab_LightChain1
gacauccagaugacccaaagccccuccucugugucagccaguauuggcgauagagucacaauaacuugcagggcuagccaggggaucgacaacuggcugggaugguaccagcagaagccugguaaagcaccaaagcuccuuauuuaugaugccuccaaucuggacacgggcguuccgucucgguucucggggucaggaagcggcaccuacuuuacauugacuaucaguuccuuacaagcggaggauuucgcuguguauuuuugucagcaggccaaagcauuucccccuaccuucggugggggaacaaagguagacauuaaaggcaccguggccgcuccaucugucuucaucuuucccccuagcgaugaacagcugaaguccggcacugcaucagugguuugccuacucaacaauuucuacccacgcgaggccaaggugcaauggaaagucgacaacgcucugcagagugggaauagccaggaaucugugacagagcaggauuccaaggacucaaccuauagccuuaguucuacgcugacuuuguccaaagccgauuacgaaaagcacaaaguauaugcgugugagguuacccaucaaggacucagcucgcccgugacaaagucuuuuaaccgaggugagugc

SEQ ID NO: 23653 - RNA, 687 nt, Artificial Sequence
  derived and/or modified sequence opt3 from Ranibiziuab_HeavyChain1
gaggugcagcuggucgaaagcggcgggggacucguucaacccgguggcucccuuagacugucuugcgccgcuucaggguacgacuucacccacuauggaaacugggugaggcaggcaccuggcaaggguuuggaguggguaggguggaucaauacauacacuggagaaccaacguaugccgcggauuuuaaacggcgcuucaccuuuaguuuagacacaagcaaguccacugcuuaccugcagaacucucuacgagccgaggauaccgcaguguauuacugugccaaauauccguacuacuauggcacaucgcauugguacuucgacgucuggggccaggggacccucgugacuguuucaagcgcuaguacaaagggacccuccguguuuccucuggcaccaucuagcaaauccaccucagguggcacggccgcucuugggugccuggucaaggauuauuuccccgaaccugugacuguaaguuggaauagcggagccuugaccucuggcguucacacauuuccagcggugcuccaauccucaggucuguacagccugaguucugucgugacugugcccuccagcucgcucgggacccagacauauauuuguaacgucaaucauaagccuucuaacaccaaaguugacaagaaaguggagccaaaguccugcgauaaaacgcacuua

SEQ ID NO: 23654 - RNA, 642 nt, Artificial Sequence
  derived and/or modified sequence opt3 from Ranibiziuab_LightChain1
gacauccagcugacccaaagccccuccucucucucagccagugugggcgauagagucacaauuacuugcagcgcuucccaggacauaucuaacuaccuuaauugguaucagcagaagccugggaaagcaccaaagguucugaucuacuucacgucgucauugcacagcggagugccgaguagguuuuccgguucuggcagcgggaccgauuucacauuaacuauuuccucacugcaacccgaggacuuugccaccuauuacugucagcaguauaguacaguaccuuggaccuucggacagggcacuaaaguggaaaucaagcggacagucgcggcuccaagcguguuuauuuuucccccuucugaugagcaacuaaaauccgguaccgccucaguugugugccuccugaacaauuucuacccacgcgaagcaaagguccaguggaagguggacaacgcccuucagagcgggaauagucaggagucuguaacggaacaagauuccaaagacagcacuuauucgcugucuuccaccuugacacucucaaaggcugauuacgagaaacauaagguuuacgcaugugaggugacucaccagggacugaguagccccgucaccaaauccuucaaccgaggcgaaugc

SEQ ID NO: 23655 - RNA, 639 nt, Artificial Sequence
  derived and/or modified sequence opt3 from Ranibizumab_fab_fragment
gacauccagcugacccaaagccccuccucucucucagccagugugggcgauagagucacaauuacuugcagcgcuucccaggacauaucuaacuaccuuaauugguaucagcagaagccugggaaagcaccaaagguucugaucuacuucacgucgucauugcacagcggagugccgaguagguuuuccgguucuggcagcgggaccgauuucacauuaacuauuuccucacugcaacccgaggacuuugccaccuauuacugucagcaguauaguacaguaccuuggaccuucggacagggcacuaaaguggaaaucaagcggacagucgcggcuccaagcguguuuauuuuucccccuucugaugagcaacuaaaauccgguaccgccucaguugugugccuccugaacaauuucuacccacgcgaagcaaagguccaguggaagguggacaacgcccuucagagcgggaauagucaggagucuguaacggaacaagauuccaaagacagcacuuauucgcugucuuccaccuugacacucucaaaggcugauuacgagaaacauaagguuuacgcaugugaggugacucaccagggacugaguagccccgucaccaaauccuucaaccgaggcgaa

SEQ ID NO: 23656 - RNA, 693 nt, Artificial Sequence
  derived and/or modified sequence opt3 from Ranibizumab_HeavyChain
gaggugcagcuggucgaaagcggcgggggacucguucaacccgguggcucccuuagacugucuugcgccgcuucaggguacgacuucacccacuauggaaugaacugggugaggcaggcaccuggcaaggguuuggaguggguaggguggaucaauacauacacuggagaaccaacguaugccgcggauuuuaaacggcgcuucaccuuuaguuuagacacaagcaaguccacugcuuaccugcagaugaacucucuacgagccgaggauaccgcaguguauuacugugccaaauauccguacuacuauggcacaucgcauugguacuucgacgucuggggccaggggacccucgugacuguuucaagcgcuaguacaaagggacccuccguguuuccucuggcaccaucuagcaaauccaccucagguggcacggccgcucuugggugccuggucaaggauuauuuccccgaaccugugacuguaaguuggaauagcggagccuugaccucuggcguucacacauuuccagcggugcuccaauccucaggucuguacagccugaguucugucgugacugugcccuccagcucgcucgggacccagacauauauuuguaacgucaaucauaagccuucuaacaccaaaguugacaagaaaguggagccaaaguccugcgauaaaacgcacuua

SEQ ID NO: 23657 - RNA, 654 nt, Artificial Sequence
  derived and/or modified sequence opt3 from Ranibizumab_LightChain
gaggugcagcuggucgaaagcggcgggggacucguucaacccgguggcucccuuagacugucuugcgccgcuucaggguacgacuucacccacuauggaaugaacugggugaggcaggcaccuggcaaggguuuggaguggguaggguggaucaauacauacacuggagaaccaacguaugccgcggauuuuaaacggcgcuucaccuuuaguuuagacacaagcaaguccacugcuuaccugcagaugaacucucuacgagccgaggauaccgcaguguauuacugugccaaauauccguacuacuauggcacaucgcauugguacuucgacgucuggggccaggggacccucgugacuguuucaagcgcuaguacaaagggacccuccguguuuccucuggcaccaucugguaccgccgcucuuggcugccuggucaaagauuauuuccccgaaccugugacgguaagcuggaacuccggggccuugacuucaggaguucacaccuuuccagcggugcuccaaaguagcggccuguacucucuguccucagucgugacagugcccagcaguucucucgguacucagaccuauauuuguaaugucaaucauaagccuuccaacacaaagguugacaaaaagguggagccaaaa

SEQ ID NO: 23658 - RNA, 642 nt, Artificial Sequence; identical to SEQ ID NO: 23654
  derived and/or modified sequence opt3 from Ranibizumab_LightChain_variant

SEQ ID NO: 23659 - RNA, 1368 nt, Artificial Sequence
  derived and/or modified sequence opt3 from Refanezumab_HeavyChain1
caggugcaacugguccagagcggcuccgagcucaagaaacccggggccucuguuaaggugucaugcaaagcuaguggauacaccuucacaaacuaugguaugaauuggguaagacaggcaccuggccaggggcuugaauggaugggauggaucaacacuuacacgggcgagccaaccuaugccgacgauuuuacagguagguucguguuuagccuggacacuuccgucucuaccgcguacuugcaaauuucgucauuaaaggcugaagauacagccguguauuacugugcacggaauccgauaaacuauuacgggaucaauuacgagggauauguuauggacuacuggggccagggcacccuggugacugucagcagugccuccacaaaagggcccucuguguucccucuagcuccaagcuccaagucaaccaguggagguacggcagcccucggcugccugguaaaggauuauuuucccgaaccuguuacugugagcuggaacucuggggcucuuaccuccggaguccacacauucccagccgugcugcagucaagcggcuuguacagucucucuuccguggucacuguucccagcucgucucuggguacccagacauauauuuguaaugugaaccauaaaccuuccaauaccaagguagacaaaaagguggagccaaaaucaugcgauaagacgcacacuuguccgcccugcccugcgccagagcuggcaggggcccccagugucuuucucuucccuccaaagcccaaagacacauuaaugaucagccgcaccccggaagugacuuguguuguggucgaugugucccaugaggacccugaaguaaaguuuaacugguacguugauggaguggagguccacaaugcuaaaacaaagccccgagaggaacaauauaacucuaccuaccguguggucagcgugcugacgguucuucaucaggacugguugaauggcaaagaguacaagugcaaagugucaaacaaggcccugccagcaccuauugaaaagaccaucaguaaagcuaagggccagcccagagagccacagguauauacacuacccccuuccagggaugaacucacuaaaaaucaagucagccugaccugucuugugaagggguucuacccaucugacauagccguugagugggagucaaacggacagccggaaaacaauuauaaaacaacucccccugugcuggacagugaugguagcuuuuucuuguacuccaagcucaccgucgacaagucucgguggcagcaaggcaacguguuuucgugcagcguaaugcacgaggcgcugcacaaucauuauacacagaaauccuuaucacugaguccagggaag

SEQ ID NO: 23660 - RNA, 657 nt, Artificial Sequence
  derived and/or modified sequence opt3 from Refanezumab_LightChain1
gacaucgugaugacccagagccccgauucccuggccgucucucucggcgagagagcuacaauuaacugcaagucaagucacagcguucuuuacuccucuaaucaaaagaacuaucuggcaugguaccagcagaagccugggcagccaccgaaauuguuaauauauugggccucgacuagggaaucaggagugcccgaccgguucagcgguaguggcuccgggacggauuuuacccugacaaucucuagccuacaagcggaggacguagcuguguacuauugucaucaguaccucuccucacugacuuucggacagggcaccaaacuugaaauuaaacgcacagucgccgcaccuaguguguuuaucuucccacccagcgaugagcagcugaagucugguaccgccuccguugugugcuugcucaauaacuuuuauccucgagaagcuaagguccaauggaaaguggacaaugcacugcagucagggaacagccaggagaguguaacugagcaggauucuaaggacuccacauacagccugucgucuacccucacguuauccaaagccgauuacgaaaagcacaaaguuuaugcuugugaggugacucaucaaggacugucaaguccagucaccaagagcuucaaucguggcgaaugc

SEQ ID NO: 23661 - RNA, 1314 nt, Artificial Sequence
  derived and/or modified sequence opt3 from REGN2810_HeavyChain1
gaggugcagcugcucgaaagcggcgggguccuuguucaacccggagguucccugagauugucuugcgccgcuucaggcuucaccuuuaguaacuucgggacaugggugaggcaggcaccuggaaagggcuuagaguggguaagcgguaucuccgggggaggccgggacacuuacuuugccgauucugugaaaggccgcuucacgauuucgcgagacaauucaaagaacacccuguaucuacagaauagccucaaaggggaagauacagcggucuacuauugugugaaguggggaaacauauacuuugacuauuggggucagggcacucugguuaccgugaguuccgcuucuacaaaagggccaagcgucuucccgcuugcccccugcucccguucaaccagugagagcacugcagcccugggauguuuggugaaggauuacuuuccugaaccaguaacaguuucuuggaacuccggcgcucucaccucaggugugcacacguuccccgcaguccugcaaagcagugggcuguauucucucuccagcguggugacugucccuucgucuuccuuaggaaccaagacauacacuugcaauguugaccauaaaccaucaaauaccaagguggauaaaagaguagagaguaaguacgggcccccuuguccaccgugccccgccccugaguuucugggcggcccaagcguguuccuuuuucccccuaaaccaaaggacacauugaucuccaggacccccgaagucacgugugugguuguggaugucucucaggaggacccggaagugcaguucaacugguauguagauggaguugaggugcacaaugcuaagacuaaaccucgggaggaacaguuuaacagcacauaccgcgucgugucaguccugaccgugcuacaucaagacuggcucaaugguaaggaguauaaaugcaagguuaguaacaaaggccugcccuccagcauugaaaagacuaucucuaaagccaaggggcagccaagagagccucagguguacacacuucccccaucacaggaagagaccaagaaucaaguaagucugacguguuuggucaaaggauucuaucccagcgauauugcgguggagugggaauccaacggccagccugagaauaacuacaagaccacaccaccgguucucgacucugacgguucguucuuucuguauagcagguuaacuguggauaaaucccgguggcaggaagggaacgucuucucaugcagugugcacgaggcacugcauaaucacuacacccaaaagucucucagccuuucccugggc

SEQ ID NO: 23662 - RNA, 639 nt, Artificial Sequence
  derived and/or modified sequence opt3 from REGN2810_LightChain1
gacauccagacccaaagccccuccucucugucagccagugugggcgauagcauuacaauaacuugcagagcuucccucucuaucaacacguuccuuaauugguaccagcagaagccugggaaagcaccaaaccuguugauuuaugccgcgucgucauuacacggaggugucccgagcagguuuaguggcuccgggucuggaaccgacuucacacugacuauccggacccuacagcccgaggauuuugcuacauacuauugucaacagagcuccaauaccccuuucacuuuuggcccagguacaguuguggacuuccgccgaaccguagccgcacccucaguguuuauuuucccuccaagugaugaacagcucaagagcgggacggccucugucgugugccugcuuaacaauuuuuacccccgugaggcuaaaguucaguggaagguggacaacgcacugcaauccggaaauucacaggaaagcgucacugagcaggauaguaaagacucuaccuauuccuugagcucgacacucacucugucuaaggccgauuacgaaaagcauaaaguguaugcuugugagguaacccaccagggccuguccucaccuguuacaaagaguuucaacagaggcgagugc

SEQ ID NO: 23663 - RNA, 651 nt, Artificial Sequence
  derived and/or modified sequence opt3 from rhuMab_HER2(9CI)_LightChain
gugcacagcgacauccagaugacccaaucccccucuucacugagugccagcgucggcgauagaguuacaauuacuugcaaggcuucccaggacgugucuauagggguagcaugguaccagcagaaaccuggaaaggccccaaaacuccuuaucuauucggcgucauacagguauacgggugugccgagccgguucaguggcuccgggucuggaaccgauuuuacacugacuauuagcuccuugcaacccgaggacuucgcuaccuacuauugucagcaguacuauaucuacccuuacacauuuggccaggguaccaaggucgaaauuaaacgcacuguggccgcaccaucaguuuucaucuuucccccuagugaugagcaauuaaagagcgggacagccucuguggucugccugcuaaacaauuucuauccacgagaagcuaaggugcaguggaaaguagacaacgcacuccaguccggaaauucacaggagagcguuaccgaacaagauaguaaggacucuacguacucccugagcucgacucuuacccugucuaaagccgauuaugagaagcauaaaguguacgcuugugaggucacacaccagggcuuguccucacccgugacuaagaguuuuaaccguggcgaaugc

SEQ ID NO: 23664 - RNA, 1215 nt, Artificial Sequence
  derived and/or modified sequence opt3 from rhuMab_HER2_HeavyChain
gaggugcagcuggucgaaagcggcgggggacucguucagcccgguggcucccuuagacugucuugcgccgcuucaggguucaccuuuacagacuacacuauggauugggugaggcaggcaccuggaaagggcuugacggccguauauuacugugcgcggaacuuagguccaaguuucuauuuugacuacugggggcagggaacccuggugacagucagcuccgcuucuacuaaaggcccgucgguguucccccuagccccuucaagcaagaguaccuccggcgggacagcagcccucggaugccugguuaaagauuauuuuccagagcccgugaccgucucuuggaauagcggugcucuuacuuccggcgugcacacauucccugcaguacugcagucaaguggguuguacagccucucuuccguugugaccgucccaucaagcagucugggaacgcaaacuuauaucuguaacgugaaucauaagcccucuaacaccaaaguggacaagaaggucgaaccuaaauccugcgauaagacacacacuuguccaccgugccccgccccugagcugcucggcgguccaagcguuuucuuauuucccccuaaaccaaaggacacccugaugauuucgcgcacacccgaagugaccuguguaguggucgaugugucucaugaggacccggagguuaaauuuaauugguacguggauggggucgaagugcacaacgcuaagacgaagccucgagaggaacaguacaauuccacuuaucguguaguuucagugcuuacagucuugcaucaggacuggcugaacggaaaagaguacaagugcaaagugaguaauaaggcccuacccgcgccaauagagaaaaccaucagcaaggcaaaaggccagccuagagaaccccaagucuauacucucccacccuccagggaggaaaugacaaagaaccaggugucucugaccugucuuguuaagggcuucuacccuagcgauauugccguggagugggaaucaaaugggcagccagagaacaauuauaaaacgaccccgcccguacuggacagugauggauccuuuuucuuguacagcaagcucacagucgacaaaucucgguggcagcaagguaacguguuuucaugcaguguuaugcacgaggcucugcacaaucauuauacucaaaagagcuuaucccugucuccuggcccaaaa

SEQ ID NO: 23665 - RNA, 645 nt, Artificial Sequence
  derived and/or modified sequence opt3 from rhuMab_HER2_LightChain
agcgacauccagaugacccaaucccccucuucacugagugccagcgugggcgauagagucacaauuacuugcagggcuucccaggacguuaacacggcaguggccugguaccagcagaagccugggaaagcgccaaagcuccuuauauauucugcuucguuccuguacucaggaguaccgagccgguuuagugguucccgcucuggcaccgauuucacauugacuaucagcuccuuacaacccgaggacuuugccaccuauuacugucagcagcacuauacaaccccuccaacuuucgggcagggaacaaaaguggaaauuaagcgaaccgucgcagcccccucaguguuuaucuucccuccaagugaugagcaacugaaaagcggcacggcuucuguugugugccuacucaauaacuuuuacccccgugaagcaaagguccaguggaagguggacaaugcccugcaguccgguaacucacaggagagcguaacugaacaagauaguaaagacucuaccuauucccuuagcucgacacugacuuugucuaaggcugauuacgagaaacauaagguuuacgccugugaggugacccaccaggggcucuccucaccugucacaaaaaguuucaauagaggagaaugc

SEQ ID NO: 23666 - RNA, 318 nt, Artificial Sequence
  derived and/or modified sequence opt3 from rhuMab_HER2_LightChain_variant1
accguggccgcucccagcgucuucaucuuuccuccauccgacgagcagcugaagucuggcacagcaucaguugugugccuccuuaacaauuucuacccgagagaagccaaaguacaauggaagguggauaacgcgcugcagagugggaauagccaggaguccgucacugaacaggacucuaaagauucgacguauucauugagcaguaccuuaacacuguccaaggcugacuacgagaaacacaagguguaugccugugaaguuacucaucaaggacuaucuagccccgugaccaaguccuuuaacaggggugagugc

SEQ ID NO: 23667 - RNA, 642 nt, Artificial Sequence
  derived and/or modified sequence opt3 from rhuMab_HER2_LightChain_variant2
gacauccagaugacccaaagccccuccucucugucagccagugugggcgauagagucacaauuacuugcagggcuagccaggacguuaacacggcaguggccugguaccagcagaagccugggaaagcgccaaagcuccuuauauauuccgcuucuuuccuguacucgggaguaccgucacgguuuagcgguagucgcuccggcaccgauuucacauugacuaucucuagcuuacaacccgaggacuuugccaccuauuacugucagcagcacuauacaaccccuccaacuuucgggcagggaacaaaaguggaaauuaagcgaaccugcgcagcccccuccgucuuuaucuucccuccaucagaugagcaacugaaaaguggcacggcuagcgugguuugucuacucaauaacuuuuacccccgugaagcaaaggugcaguggaaggucgacaaugcccugcagucugguaacucccaggagucagugacugaacaagauagcaaagacaguaccuauucucuuuccagcacacugacuuugucgaaggcugauuacgagaaacauaagguauacgccugcgagguuacccaccaggggcucucuuccccugugacaaaaucauucaauagaggagaaugu

SEQ ID NO: 23668 - RNA, 642 nt, Artificial Sequence
  derived and/or modified sequence opt3 from rhuMab_HER2_LightChain_variant3
gacauccagaugacccaaagccccuccucucugucagccagugugggcgauagagucacaauuacuugcagggcuagccaggacguuaacacggcaguggccugguaccagcagaagccugggaaagcgccaaagcuccuuauauauuccgcuucuuuccuguacucgggaguaccgucacgguuuagcgguagucgcuccggcaccgauuucacauugacuaucucuagcuuacaacccgaggacuuugccaccuauuacugucagcagcacuauacaaccccuccaacuuucgggcagggaacaaaaguggaaauuaagcgaaccgucgcagcccccuccguguuuaucuucccuccaucagaugagcaacugaaaaguggcacggcuagcguugugugccuacucaauaacuuuuacccccgugaagcaaagguccaguggaagguggacaaugcccugcagucugguaacucccaggagucaguaacugaacaagauagcaaagacaguaccuauucucuuuccagcacacugacuuugucgaaggcugauuacgagaaacauaagguuuacgccugugaggugacccaccaggggcucucuuccccugucacaaaaucauucaauagaggagaaugc

SEQ ID NO: 23669 - RNA, 645 nt, Artificial Sequence; identical to SEQ ID NO: 23665
  derived and/or modified sequence opt3 from rhuMab_HER2_LightChain_variant4

SEQ ID NO: 23670 - RNA, 321 nt, Artificial Sequence
  derived and/or modified sequence opt3 from rhuMab_HER2_LightChain_V-Region
gacauccagaugacccaaagccccuccucucugucagccagugugggcgauagagucacaauuacuugcagggcuagccaggacguuaacacggcaguggccugguaccagcagaagccugggaaagcgccaaagcuccuuauauauuccgcuucuuuccuguacucgggaguaccgucacgguuuagcgguagucgcuccggcaccgauuucacauugacuaucucuagcuuacaacccgaggacuuugccaccuauuacugucagcagcacuauacaaccccuccaacuuucgggcagggaacaaaaguggaaauuaag

SEQ ID NO: 23671 - RNA, 1350 nt, Artificial Sequence
  derived and/or modified sequence opt3 from rhuMab_HER2_gamma1-Chain
gaggugcagcuggucgaaagcggcgggggacucguucaacccgguggcucccuuagacugucuugcgccgcuucaggguucaacaucaaggacaccuacauucacugggugaggcaggcaccuggaaaaggcuuggaguggguagcccggauauauccaacaaaugguuacacucgcuaugcggauagugugaaggggcgauuuacgaucagcgcugacaccuccaaaaacacagccuacuuacagaugaauagccugcgugcagaagauacugccgucuauuacuguucgagauggggaggcgacggcuucuaugcuauggauuacugggggcagggaacccuagugacaguuucaagcgcaaguaccaaggguccguccguguuuccccucgccccuucuagcaaauccacuucaggcgggacagcugcccugggaugccuugucaaggacuacuucccagagcccgugaccguaaguuggaacagcggcgcgcugacgucugguguucauacuuuuccugcaguguugcaauccucagggcucuauagccugaguucugucgugaccgugccauccagcucgcugggaacacagacuuacauuuguaaugucaaccacaagcccucuaauaccaaaguugauaagaaaguggaaccuaaguccugcgacaaaacacauaccuguccaccgugccccgccccugagcucuuaggcggcccaucaguauuccuguuucccccuaagccaaaggauacgcuuaugaucaguaggacucccgaggugacaugugucgugguugacgugagccacgaagauccggaggucaaauucaacugguauguggacgggguagaaguucauaaugcuaagaccaaaccucgggaggagcaguacaacuccacuuaucgcguggucucuguguugacaguccugcaccaggauuggcuaaauggaaaggaauacaaaugcaaggugagcaacaaagcccuccccgcaccaauugagaagaccaucucaaaggcuaaaggucaaccuagagaaccccagguuuauacgcugccacccaguagggaggaaaugaccaagaaucaggugucccuuacaugucugguaaaaggcuuuuacccuagcgacauagccgucgagugggagucuaacgggcagccagaaaauaacuacaagacuaccccgcccguguuggacucagauggaaguuucuuucucuauagcaaacugacaguugacaagucccgguggcaacagggcaacguguucucuugcucggucaugcacgaggcguuacauaaucacuacacucagaagucucugucccucucaccugguaaa

SEQ ID NO: 23672 - RNA, 1350 nt, Artificial Sequence
  derived and/or modified sequence opt3 from rhuMab_HER2__gamma1-Chain
gaggugcagcuggucgaaagcggcgggggacucguucaacccgguggcucccuuagacugucuugcgccgcuucaggguucaacaucaaggacaccuacauucacugggugaggcaggcaccuggaaaaggcuuggaguggguagcccggauauauccaacaaaugguuacacucgcuaugcggauagugugaaggggcgauuuacgaucagcgcugacaccuccaaaaacacagccuacuuacagaugaauagccugcgugcagaagauacugccgucuauuacuguucgagauggggaggcgacggcuucuaugcuauggauuacugggggcagggaacccuagugacaguuucaagcugcaguaccaaggguccguccguguuuccccucgcaccuucuagcaaauccacuucaggcgggacagccgcucugggaugucuugucaaggacuacuucccagagcccgugaccguaaguuggaacagcggcgcccugacgucugguguucauacuuuuccugcgguguugcaauccucagggcucuauagccugaguucugucgugaccgugccauccagcucgcugggaacacagacuuacauuugcaaugucaaccacaagcccucuaauaccaaaguugauaagaaaguggaaccuaaguccugugacaaaacacauaccugcccaccgugucccgcaccugagcucuuaggcggcccaucaguauuccuguuucccccuaagccaaaggauacgcuuaugaucaguaggacucccgaggugacaugcgucgugguugacgugagccacgaagauccggaggucaaauucaacugguauguggacgggguagaaguucauaaugccaagaccaaaccucgggaggagcaguacaacuccacuuaucgcguggucucuguguugacaguccugcaccaggauuggcuaaauggaaaggaauacaaauguaaggugagcaacaaagcucuccccgccccaauugagaagaccaucucaaaggcaaaaggucaaccuagagaaccccagguuuauacgcugccacccaguagggaggaaaugaccaagaaucaggugucccuuacaugccugguaaaaggcuuuuacccuagcgacauagcugucgagugggagucuaacgggcagccagaaaauaacuacaagacuaccccgcccguguuggacucagauggaaguuucuuucucuauagcaaacugacaguugacaagucccgguggcaacagggcaacguguucucuuguucggucaugcacgaggccuuacauaaucacuacacucagaagucucugucccucucaccugguaaa

SEQ ID NO: 23673 - RNA, 729 nt, Artificial Sequence
  derived and/or modified sequence opt3 from rhuMab_HER2_gamma1-Chain__rhuMab_HER2_LightChain_sc4D5
gaggugcagcuggucgaaagcggcgggggacucguucaacccgguggcucccuuagacugucuugcgccgcuucaggguucaacaucaaggacaccuacauucacugggugaggcaggcaccuggaaaaggcuuggaguggguagcccggauauauccaacaaaugguuacacucgcuaugcggauagugugaaggggcgauuuacgaucagcgcugacaccuccaaaaacacagccuacuuacagaugaacucucugcgugcagaagauacugccgucuauuacuguucgagauggggaggcgacggcuucuaugcuauggauuacugggggcagggaacccuagugacaguuucaagcgguggcgggggaaguggcggugggggauccggcggcgggggaucugacauucaaaugacccagagcccguccucacucagugcaagcgugggugauagggucacuaucacaugccgggccucucaggacgugaauaccgcuguagccugguaccagcaaaagcccggcaaagcgccuaagcugcuuauuuauuccgcaucauuucuguacagcgggguuccaagucgcuucucuggauccagaagcggcacggauuuuacuuugaccaucucgucucuccagcccgaggacuucgccacauauuacugucagcagcauuauacuaccccuccaacauuuggucaagggaccaagguggaaauaaaaagg

SEQ ID NO: 23674 - RNA, 1350 nt, Artificial Sequence; identical to SEQ ID NO: 23671
  derived and/or modified sequence opt3 from rhuMab_HER2_gamma1-Chain_variant1

SEQ ID NO: 23675 - RNA, 1350 nt, Artificial Sequence; identical to SEQ ID NO: 23672
  derived and/or modified sequence opt3 from rhuMab_HER2_gamma1-Chain_variant2

SEQ ID NO: 23676 - RNA, 1350 nt, Artificial Sequence
  derived and/or modified sequence opt3 from rhuMab_HER2_gamma1-Chain_variant3
gaggugcagcuggucgaaagcggcgggggacucguucaacccgguggcucccuuagacugucuugcgccgcuucaggguucaacaucaaggacaccuacauucacugggugaggcaggcaccuggaaaaggcuuggaguggguagcccggauauauccaacaaaugguuacacucgcuaugcggauagugugaaggggcgauuuacgaucagcgcugacaccuccaaaaacacagccuacuuacagaugaauagccugcguugugaagauacugcagucuauuacugcucgagauggggaggcgacggcuucuaugccauggauuacugggggcagggaacccuagugacaguuucaagcgcuaguaccaaggguccguccguguuuccccucgcaccuucuagcaaauccacuucaggcgggacagccgcucugggaugucuugucaaggacuacuucccagagcccgugaccguaaguuggaacagcggcgcccugacgucugguguucauacuuuuccugcgguguugcaauccucagggcucuauagccugaguucugucgugaccgugccauccagcucgcugggaacacagacuuacauuugcaaugucaaccacaagcccucuaauaccaaaguugauaagaaaguggaaccuaaguccugugacaaaacacauaccugcccaccgugucccgcaccugagcucuuaggcggcccaucaguauuccuguuucccccuaagccaaaggauacgcuuaugaucaguaggacucccgaggugacaugcgucgugguugacgugagccacgaagauccggaggucaaauucaacugguauguggacgggguagaaguucauaaugccaagaccaaaccucgggaggagcaguacaacuccacuuaucgcguggucucuguguugacaguccugcaccaggauuggcuaaauggaaaggaauacaaauguaaggugagcaacaaagcucuccccgccccaauugagaagaccaucucaaaggcaaaaggucaaccuagagaaccccagguuuauacgcugccacccaguagggaggaaaugaccaagaaucaggugucccuuacaugccugguaaaaggcuuuuacccuagcgacauagcugucgagugggagucuaacgggcagccagaaaauaacuacaagacuaccccgcccguguuggacucagauggaaguuucuuucucuauagcaaacugacaguugacaagucccgguggcaacagggcaacguguucucuuguucggucaugcacgaggccuuacauaaucacuacacucagaagucucugucccucucaccugguaaa

SEQ ID NO: 23677 - RNA, 360 nt, Artificial Sequence
  derived and/or modified sequence opt3 from rhuMab_HER2_gamma1-Chain_V-Region
gaggugcagcuggucgaaagcggcgggggacucguucaacccgguggcucccuuagacugucuugcgccgcuucaggguucaauaucaaggacaccuacauucacugggugaggcaggcaccuggaaaaggcuuggaguggguagcccggauauauccaacaaaugguuacacucgcuaugcggauagugugaaggggcgauuuacgaucagcgcugacaccuccaaaaacacagccuacuuacagaugaacucucugcgugcagaagauacugccgucuauuacuguucgagauggggaggcgacggcuucuaugcuauggauuacugggggcagggaacccuagugacaguuucaagc

SEQ ID NO: 23678 - RNA, 1359 nt, Artificial Sequence; identical to SEQ ID NO: 23009
  derived and/or modified sequence opt3 from rhuMAb-VEGF_HeavyChain1

SEQ ID NO: 23679 - RNA, 642 nt, Artificial Sequence; identical to SEQ ID NO: 23010
  derived and/or modified sequence opt3 from rhuMAb-VEGF_LightChain1

SEQ ID NO: 23680 - RNA, 642 nt, Artificial Sequence; identical to SEQ ID NO: 23010
  derived and/or modified sequence opt3 from rhuMAb-VEGF_LightChain

SEQ ID NO: 23681 - RNA, 321 nt, Artificial Sequence; identical to SEQ ID NO: 23019
  derived and/or modified sequence opt3 from rhuMAb-VEGF_LightChain__VG-Region

SEQ ID NO: 23682 - RNA, 1359 nt, Artificial Sequence; identical to SEQ ID NO: 23009
  derived and/or modified sequence opt3 from rhuMAb-VEGF_gamma1-Chain

SEQ ID NO: 23683 - RNA, 369 nt, Artificial Sequence; identical to SEQ ID NO: 23014
  derived and/or modified sequence opt3 from rhuMAb-VEGF_gamma1-Chain_VDG-Region

SEQ ID NO: 23684 - RNA, 1338 nt, Artificial Sequence
  derived and/or modified sequence opt3 from Rilotumumab_HeavyChain1
caggugcagcugcaggagagcggccccgggcucgucaagccuuccgaaacccuuucucugacaugcacuguuucaggagguaguaucagcauuuacuauugguccuggauaagacagccaccgggcaaaggguuggaguggaucggauacguguauuacucuggcucgacgaacuauaaucccucauuaaagagcaggguaaccauuaguguggacacauccaaaaaccaguucucucugaagcuaaauagcgucacugccgcugauaccgcaguguacuauugugcccgggguggguacgacuuuugguccggauacuucgauuauuggggccaaggcacacucguuaccgugucaagugcgagcacuaaagggccuucugucuuuccacuggcucccugcucccgcucaacaagcgaaaguaccgccgcacuuggaugucuggugaaggacuacuucccugagccaguaacgguuucuuggaacuccggugccuugacuagcggcgugcacaccuuucccgcuguccuccagucgucugggcuguauucccugucaaguguggugacagucccuagcuccaauuucggaacucagaccuacacaugcaacguugaucauaagccaucuaauaccaaaguggacaagacgguagaacgaaaauguugcguggaguguccgcccugcccugcaccacccgucgccggcccuagcguguuucucuucccacccaagccgaaagauacuuuaaugaucucacguacaccugagguuaccuguguggucguggacguaagucacgaagaucccgagguucaguuuaacugguauguggacggugucgaagugcauaaugcuaagacuaagccaagagaggagcaauucaacuccacauuuagggucgugagcguucugaccgugguacaccaggauuggcuuaaugggaaagaauacaagugcaaagucucuaacaagggauugccugcccccauugagaaaacgaucucaaagaccaaaggccagccacgggaaccccagguguauacacugccuccaagucgcgaggaaaugacuaagaaucaaguuagccuaaccugucucgugaagggcuucuacccguccgacauagcggucgagugggagucuaacgggcagcccgaaaauaacuacaaaacaacuccuccaaugcuggauucggacgguagcuuuuuccuuuauuccaagcugaccguggacaaaucaagauggcagcaaggaaacguauucaguugcucugugaugcaugaggcauugcacaaucacuacacacaaaagagccucucccugucacccggcaaa

SEQ ID NO: 23685 - RNA, 645 nt, Artificial Sequence
  derived and/or modified sequence opt3 from Rilotumumab_LightChain1
gagaucgugaugacccagagccccgccacacuguccgucucuccuggcgaaagagcuacucucucaugcagggcaagucaaagcguugacuccaaccuugccugguaccggcagaagccagggcaggcgccgcgccuguugauuuauggagcuucuacgcgagccaccgguauacccgcacguuucucgggcucagggagcggaacagaguuuacuuuaaccaucaguucccugcagucugaagauuucgccguguacuauugucaacaguacauuaauuggccuccaaucacauuuggccaggguaccagacuagagauuaaaaggacuguagcugcacccagcguguucaucuuuccuccauccgacgaacagcucaagucagggacagccagugucgugugccugcuuaacaauuucuauccccgggaggcuaaaguucaauggaagguggauaacgcccugcagagcggaaauucucaggaguccgucaccgaacaggacucaaaagauagcacguacaguuugucuuccacucucacccugagcaaggcggacuaugagaagcacaaaguguacgcaugugaaguaacacaucaaggccugucgucuccuguuacuaaguccuuuaaccgcggcgagugc

SEQ ID NO: 23686 - RNA, 1071 nt, Artificial Sequence; identical to SEQ ID NO: 23643
  derived and/or modified sequence opt3 from Rilotumumab_scFv-CH_chain

SEQ ID NO: 23687 - RNA, 1347 nt, Artificial Sequence
  derived and/or modified sequence opt3 from Rinucumab_HeavyChain1
cagcugcaacuccaggagagcggccccgggcuugugaagccuuccgaaacccugucuuugacaugcacugucucaggagguaguaucacgagcuccucuuacuauuggggcuggauuagacagccaccggggaaaggauuagaguggauaggcucgaucuacuauagggguucaaccaacuacaaucccagccugaagagucggguuacaauuuccguggacucuagcaaaaaccaguucuaucuaaagguauccucagugacugccgucgauaccgcuguguacuauugugcacgccaaaauggggccgcgcgaccuaguugguuugacccauggggacagggcacacucguuaccgugagcucugcuuccacuaaaggccccucagucuucccucuggccccaugcagccguaguacaucugaauccaccgcagcccuugggugucuggugaaggauuacuuucccgagccuguaacgguuagcuggaacucgggagcuuugacuucuggugugcacaccuucccagcaguccuccaguccucaggccuguacagucugagcuccguggugacagucccgucuagcucacucgggacuaagaccuauacaugcaauguugaccauaaacccaguaacaccaagguggauaaaagaguagaauccaaguacggaccuccaugucccccuugcccagcccccgaguuuuuaggcgguccgagcguguuccuguuuccucccaaaccaaaggacacgcuuaugaucucuaggacuccugaggucacaugugugguuguggaugucucacaggaagaccccgaggugcaauucaauugguauguagaugggguugaagugcacaacgcuaagaccaaaccacgggaggagcaguuuaauaguacuuaccgcgucgugagcgucuugacagugcugcaucaggacuggcuaaacggaaaggaauauaaaugcaagguuuccaauaaaggccuccccucuucgauugagaagaccaucagcaaagccaagggccagccuagagaaccacaaguguacacgcugccgcccucccaggaggaaaugaccaagaaccagguaucacuuacaugucuggucaaaggguucuauccuagugauauagcgguggagugggagucuaauggacaaccagaaaacaauuacaagacuacacccccuguuuuggacagcgaugguuccuuuuuccucuacucaaggcugaccguggacaaaagccgguggcaggagggcaacgucuuuucuugcuccgugaugcacgaagcauuacauaaccacuauacucagaagagucugagccucucucuugggaaa

SEQ ID NO: 23688 - RNA, 1344 nt, Artificial Sequence
  derived and/or modified sequence opt3 from Rinucumab_HeavyChain
cagcugcaacuccaggagagcggccccgggcuugugaagccuuccgaaacccugucuuugacaugcacugucucaggagguaguaucacgagcuccucuuacuauuggggcuggauuagacagccaccggggaaaggauuagaguggauaggcucgaucuacuauagggguucaaccaacuacaaucccagccugaagagucggguuacaauuuccguggacucuagcaaaaaccaguucuaucuaaagguauccucagugacugccgucgauaccgcuguguacuauugugcacgccaaaauggggccgcgcgaccuaguugguuugacccauggggacagggcacacucguuaccgugagcucugcuuccacuaaaggccccucagucuucccucuggccccaugcagccguaguacaucugaauccaccgcagcccuugggugucuggugaaggauuacuuucccgagccuguaacgguuagcuggaacucgggagcuuugacuucuggugugcacaccuucccagcaguccuccaguccucaggccuguacagucugagcuccguggugacagucccgucuagcucacucgggacuaagaccuauacaugcaauguugaccauaaacccaguaacaccaagguggauaaaagaguagaauccaaguacggaccuccaugucccccuugcccagcccccgaguuuuuaggcgguccgagcguguuccuguuuccucccaaaccaaaggacacgcuuaugaucucuaggacuccugaggucacaugugugguuguggaugucucacaggaagaccccgaggugcaauucaauugguauguagaugggguugaagugcacaacgcuaagaccaaaccacgggaggagcaguuuaauaguacuuaccgcgucgugagcgucuugacagugcugcaucaggacuggcuaaacggaaaggaauauaaaugcaagguuuccaauaaaggccuccccucuucgauugagaagaccaucagcaaagccaagggccagccuagagaaccacaaguguacacgcugccgcccucccaggaggaaaugaccaagaaccagguaucacuuacaugucuggucaaaggguucuauccuagugauauagcgguggagugggagucuaauggacaaccagaaaacaauuacaagacuacacccccuguuuuggacagcgaugguuccuuuuuccucuacucaaggcugaccguggacaaaagccgguggcaggagggcaacgucuuuucuugcuccgugaugcacgaagcauuacauaaccacuauacucagaagagucugagccucucucuuggg

SEQ ID NO: 23689 - RNA, 645 nt, Artificial Sequence
  derived and/or modified sequence opt3 from Rinucumab_LightChain1
gagaucgugcugacccagagccccgacacaauuucccucucuccuggcgaaagagccacucuuucaugcagggcuagucaaagcauauccucuaucuaccuggcaugguaucagcagaagccagggcaggccccgcgguuguuaauuuacggagcgucgucacgcgucacggguauccccgaucgauucagcguuaguggcuccgggaccgacuuuacacugacuauuucucgucuagagccugaagauuucgcuguguauuacugucaacacuauggaaucagcccauuuaccuucggccccgguacaaaaguagacauaagaaggaccguggccgcaccuuccgucuuuaucuucccacccucagaugagcagcucaagagugggacugccagcgugguuugccugcuuaacaauuuuuacccucgggaagcuaaagugcaguggaaggucgacaacgcacugcagucuggaaauucccaagagucagugacagagcaggauagcaaagacaguaccuauucuuuguccagcacgcucacucugucgaaggccgauuacgaaaagcauaaaguauacgcuugugagguuacccaccagggccugucuuccccagugacaaagucauucaaccgcggcgaaugc

SEQ ID NO: 23690 - RNA, 1347 nt, Artificial Sequence
  derived and/or modified sequence opt3 from Risankizumab_HeavyChain1
caggugcaacugguccagagcggcgccgagguuaagaaacccggguccucugugaagguaucaugcaaagcuaguggauacaccuucacagaccagacuauccacuggaugagacaggcaccuggucaaggccucgaauggauuggguauauauacccaagggaugacagcccgaaguauaacgagaauuuuaaaggaaaggugacgaucaccgccgauaaguccacaucuacugcguacauggaacuuucgucacugcggagcgaggacaccgcugucuauuacugugccauucccgaucgcaguggcuaugcaugguucaucuacuggggucaggggacauuggugaccguuuccucugccagcacuaaaggaccuuccguguuuccauuagcucccucaaguaagagcacaucuggcggcaccgcagcccuggggugccuagucaaagacuacuucccugaaccagugacgguauccuggaacucaggagcucucacuagcgguguucauaccuuucccgccgugcugcagaguucuggccuuuauucccugagcucggucgugacagugccuucuuccucauuggggacucagaccuacauuuguaaugucaaccacaagccaaguaauacaaaaguugauaagcgaguggagccgaaaagcugcgacaaaacccauacgugucccccuugcccagcgcccgaggcagccggaggcccuuccguauuccucuuuccacccaagccgaaagauacucugaugaucucucguacaccugaagugaccugugucgugguugacgugagccacgaggaucccgaagucaaguucaacugguauguggacgguguagagguucauaaugcuaaaacuaagccaagagaggaacaauacaacucaacauauaggguggucagugugcugaccguccuccaccaggauugguuaaaugggaaagaguacaagugcaagguguccaacaaagcccugccugcacccauagaaaagacgaucagcaaagcuaagggacagccacgggagccccagguuuauacccuuccuccaucucgcgaagagaugacaaagaaucaagugucauugacuugucugguaaagggcuuuuacccgagugacauugccgucgagugggaaagcaacggccagcccgagaauaacuacaagaccacaccuccagugcuagacuccgaugggucuuucuuucucuauucgaaacugacuguugacaagagcagauggcagcaaggaaauguguucuccugcucagucaugcacgaagcgcuucauaaccacuacacccagaaaagucugucuuugagccccggu

SEQ ID NO: 23691 - RNA, 642 nt, Artificial Sequence
  derived and/or modified sequence opt3 from Risankizumab_LightChain1
gacauccagaugacccaaagccccuccucucugucagccagugugggcgauagagucacaauuacuugcaaggcuagcagggacguugcaauagccguggcgugguaccagcagaaaccugggaagguaccaaaacuccuuaucuauugggcuuccacgcggcacaccggagugccgucucgcuucucggguucaggcagccgaacagauuuuacucugaccauuaguuccuugcagcccgaggacgucgccgauuacuucugucaucaauauucuagcuacccuuuuacauucggguccggaaccaaguuagaaaucaaacguacuguggcagccccaucaguuuuuauuuuucccccuagugacgagcagcuaaagagcggcacagcuucuguggucugccugcucaacaauuucuauccaagagaagcaaaggugcaguggaaaguagauaacgcccugcaguccgguaauucacaagagagcguuaccgaacaggacaguaaggauucuacguacucccuuagcucgacucugaccuugucuaaagcugacuaugagaagcacaaaguguacgccugugaggucacacaucaggggcucuccucacccgugacuaagaguuucaacaggggagaaugc

SEQ ID NO: 23692 - RNA, 1353 nt, Artificial Sequence
  derived and/or modified sequence opt3 from Rituximab_HeavyChain
caggugcaacugcagcagcccggcgccgagcucgucaagccuggggcuagcguuaaaauguccugcaaggcaucuggauacaccuucacaucauauaacaugcacugggugaaacagacuccagguagaggccuugaauggaucggggccauuuacccgggaaauggcgacacgaguuauaaccaaaaguuuaaagguaaggcgacccugacagcugauaagagcuccucuacugccuacaugcaguugucgucauuaaccagcgaggacagugcaguauauuacugugccagguccacauauuacgggggagauugguacuucaauguguggggcgcuggcaccacugucacagugucugcagccagcaccaaagggcccuccguuuuuccucuggcuccaucaaguaagagcacgucuggagguacugccgcgcuaggcugccucgugaaagacuauuuccccgaaccugucaccguguccuggaacucaggggcacugacaagcggaguacauacuuuuccagccguucuucagaguucuggccuguacuccuugagcucgguggucaccgugcccucuuccucacucgguacacagaccuauauauguaaugugaaccacaagccuaguaauacgaaagucgauaagaagguugagccaaaaagcugcgacaagacucauacauguccgcccugcccugcuccagaacugcucgggggacccuccguguuccuguuuccuccaaaacccaaggauaccuuaaugaucucucggacuccggagguaacauguguggucguggacguuagccacgaggauccugaagugaaauucaacugguacgucgacggcguggagguacauaaugccaagaccaaaccccgcgaagaacaauauaacucaacguaccgaguugugaguguccugaccgugcuucaccaggauugguugaauggcaaggaguauaagugcaaagucuccaacaaggcacugccagcuccuauugagaaaacaaucagcaaggccaaagggcagccccgugagccacagguguacacucuacccccuucuagagacgaacucaccaagaaucaaguuucacugacaugucuugugaagggauuuuacccaagugauauugcgguagagugggaaagcaacggucagccggagaauaacuauaaaacuacacccccuguccuggacuccgacggcucuuucuuuuuguacucgaagcucaccguggauaaauccagguggcagcaagggaacguuuucagcugcucagugaugcacgaggcccugcauaaucacuauacccagaagaguuuaucucugagcccaggaaaa

SEQ ID NO: 23693 - RNA, 1353 nt, Artificial Sequence
  derived and/or modified sequence opt3 from Rituximab_HeavyChain_variant
caggugcaacugcagcagcccggcgccgagcucgucaagccuggggcuagcguuaaaauguccugcaaggcaucuggauacaccuucacaucauauaacaugcacugggugaaacagacuccagguagaggccuugaauggaucggggccauuuacccgggaaauggcgacacgaguuauaaccaaaaguuuaaagguaaggcgacccugacagcugauaagagcuccucuacugccuacaugcaguugucgucauuaaccagcgaggacagugcaguauauuacugugccagguccacauauuacgggggagauugguacuucaauguguggggcgcuggcaccacugucacagugucugcagccagcaccaaagggcccuccguuuuuccucuggcuccaucaaguaagagcacgucuggagguacugccgcgcuaggcugccucgugaaagacuauuuccccgaaccugucaccguguccuggaacucaggggcacugacaagcggaguacauacuuuuccagccguucuucagaguucuggccuguacuccuugagcucgguggucaccgugcccucuuccucacucgguacacagaccuauauauguaaugugaaccacaagccuaguaauacgaaagucgauaagaaggcugagccaaaaagcugcgacaagacucauacauguccgcccugcccugccccagaacugcucgggggacccuccguuuuccuguuuccuccaaaacccaaggauaccuuaaugaucucucggacuccggaggugacauguguaguggucgacgugagccacgaggauccugaaguuaaauucaacugguacguggacggcgucgaggugcauaaugcaaagaccaaaccccgcgaagaacaauauaacucaacguaccgaguaguuagugugcugaccguccuucaccaggauugguugaauggcaaggaguauaagugcaaaguguccaacaaggcucugccagccccuauugagaaaacaaucagcaaggcgaaagggcagccccgugagccacaggucuacacucuacccccuucuagagacgaacucaccaagaaucaagugucacugacaugucuuguuaagggauuuuacccaagugauauugccguggagugggaaagcaacggucagccggagaauaacuauaaaacuacacccccuguacuggacuccgacggcucuuucuuuuuguacucgaagcucaccgucgauaaauccagguggcagcaagggaacguguucagcugcucaguuaugcacgaggcacugcauaaucacuauacccagaagaguuuaucucugagcccaggaaaa

SEQ ID NO: 23694 - RNA, 639 nt, Artificial Sequence
  derived and/or modified sequence opt3 from Rituximab_LightChain
cagaucgugcugagccaaucccccgccauucucucugcuucaccuggcgagaaggucaccaugacaugcagagcaaguagcuccguuucuuacauacacugguuccagcagaaaccagggucgucaccgaagcccuggaucuaugccacuagcaaccuugcgaguggagugccuguaagguuuuccgguucuggcagcgggacguccuacucacugaccauuagucggguggaagcugaggacgccgcaacauauuacugucagcaauggacuagcaauccacccaccuucggaggcgguacaaaauuggaaaucaagcgcaccgucgccgcuccuucuguguuuauuuucccacccuccgaugagcaguuaaaaucagggacugcaagcguugugugccugcuaaacaauuuuuauccucgagaagccaagguccaguggaagguggacaacgcucuccagaguggaaauucucaagaguccguaacagagcaggauagcaaagacucgaccuacucucuguccucaacgcuuacucugaguaaggccgauuaugaaaaacauaagguuuacgcgugugaggugacccaccagggcuugagcuccccagucacaaaaucuuucaaccguggcgaaugc

SEQ ID NO: 23695 - RNA, 714 nt, Artificial Sequence
  derived and/or modified sequence opt3 from Rivabazumab_pegol_HeavyChain1
gaggugcagcuggucgaaagcggcgggggaguugugcaacccgguaggucccucaggcuuucuugcgccgcuucaggcuucaccuuuaguaacuacccuaugcacuggguacggcaggcaccagggaagggacuggaguggguggccgucaucagcuaugacggcuccgaaaaaugguacgcggauucugugaagggucgcuucacaauuucgcgagacaauucaaagaacacuuuguauuuagagaugaauagccugcguccggaagauacggcuguuuacuauugugccagaaacagaggggacauauacuaugauuuuaccuacgcaauggacaucuggggacagggcacaacugugaccgucaguuccgccucuacaaaaggccccagcguguucccucuagcuccauccucaaaaaguaccagcgggggaacugcagcccucgguugccugguaaaggauuacuuucccgagccuguuacagugucuuggaacuccggcgcucuuaccucagggguccauacguucccagccgugcugcagagcaguggauuguauucucucuccagcguggucacuguucccucgucuucccugggcacccaaacauacauuuguaaugugaaucacaagccuucaaacacuaaaguagacaagaaaguggagccaaagaguagcgauaaaacccauacaugcccgcccuguccugcg

SEQ ID NO: 23696 - RNA, 642 nt, Artificial Sequence
  derived and/or modified sequence opt3 from Rivabazumab_pegol_LightChain1
gacauccagcugacccaaagccccuccacacucucugccucagugggcgauagugucacuauuacgugcagagcuagcgaggggguugacagguggcuugcaugguaccagcagaagccuggacgggccccaaaacuguugauauaugaugcguccaccuuacagucuggugugccgucgcgcuucucaggcagcgggaguggaacagaauuuucccugacuaucucuagccuacaacccgacgauguagcuaccuacuauugucagcacuucuggggcacaccuuacaccuuuggucaggggacuaagcucgagauuaaacgaacaguggccgcaccauccgucuucaucuuucccccuucagacgaacagcugaagaguggaaccgccagcgugguuugccuucugaacaauuucuauccacgugaggcuaaagugcaauggaaggucgauaacgcauugcagucuggcaauucccaggaaucagugacggagcaggacagcaaggauaguacuuacucucucuccagcacccugacacugucgaaagccgacuaugagaagcauaaaguauacgcuugugaaguuacucaccaaggccucucuucccccgugaccaagucauuuaacagaggggagagu

SEQ ID NO: 23697 - RNA, 1344 nt, Artificial Sequence
  derived and/or modified sequence opt3 from Robatumumab_HeavyChain1
gaggugcagcugguccaaagcggcgggggacucguuaagcccgguggcucccuuagacugucuugcgccgcuucaggguucaccuuuaguagcuucgcaaugcacugggugaggcaggccccuggaaaaggcuuggaauggaucuccguaauugacacacggggugcgacuuacuaugcugauucugugaaggggcgcuuuacgauaucgcgagacaacgccaaaaauucauuauaccugcagaugaacagccuacgugcagaggauaccgccgucuauuacugugcuagacucggaaauuucuauuacggcauggacguguggggccaggggacaacuguuaccgugaguuccgcaucuacaaagggaccaagcgucuuuccgcuggcccccuccucaaaaaguaccagcgguggcacugcugcccuugggugccuggugaaggauuauuucccugaaccaguaacaguuucuuggaacuccggagcguugaccucaggcgugcauacguuucccgcaguccuccaaagcaguggucuguacucucuguccagcguggugacugucccuucgucuucccucgggacccagacauacaucuguaauguuaaccacaagccaucaaauacuaaaguggacaagaaaguagagcccaagaguugcgauaaaacccauacauguccuccaugcccggcccccgaauuacugggaggcccuagcguguuccuuuuuccacccaagccuaaggacaccuugaugauuuccaggacgccagaggucacuugugugguuguggaugucucucacgaggaccccgaagugaaauucaacugguauguagauggcguugaggugcauaaugcuaagacaaaaccgcgggaggaacaguacaacagcaccuaucgcgucgugucaguccugacugugcuacaccaggacuggcucaaugggaaggaguacaaaugcaagguuaguaacaaagcccugccugcacccaucgaaaagacaauuuccaaggcuaaaggacaaccaagagagccucagguguauacccuucccccaagcagggaugaacugacgaagaaucagguaucuuugaccugucucgucaaagguuuuuaccccucagacaucgccguggagugggaaaguaacggccagccugagaauaacuauaagacaacuccaccgguucuggacagcgauggguccuucuuuuuauacucuaaacugaccguggacaagucgcgguggcaacagggaaacgucuucagcugcuccgugaugcacgaggcgcuccauaaucacuacacacagaagucacuuagucugucucccggcaaa

SEQ ID NO: 23698 - RNA, 642 nt, Artificial Sequence
  derived and/or modified sequence opt3 from Robatumumab_LightChain1
gagaucgugcugacccagagccccggcacacucuccgucucuccuggggaacgggccacucuuucaugcagggcuagucaaagcauuggauccucucugcacugguaccagcagaagccaggucaggcaccgcgguuguuaauaaaauaugccucgcaaucacugagcggcauccccgaccgcuucaguggguccggaucuggcacggauuuuacccuaacaauuagccgacucgagccugaagacuucgcgguuuacuauugucaucaguccucacgucugccacacacuuuuggucaggggaccaagguggagaucaaaagaacaguagcugcccccaguguguucauuuuuccuccaagcgaugaacagcuuaagucuggaaccgcauccgucgugugccuguugaacaauuucuaccccagggaggccaaaguucaauggaagguggacaacgcucuccagucaggcaauagccaggagagugucacugaacaggauucuaaggacuccacauauagccugucgucuacccugacgcucuccaaagcagauuacgagaagcauaaaguguaugccugugaaguaacucaccaaggcuuaucaaguccuguuaccaagagcuuuaacagaggggagugc

SEQ ID NO: 23699 - RNA, 1368 nt, Artificial Sequence
  derived and/or modified sequence opt3 from Roledumab_HeavyChain1
caggugcaacuggucgagagcggcgggggaguugugcagcccgguagaucccucaggcuuucuugcaccgccucaggcuucacauuuaagaacuacgcuaugcacuggguacggcaggccccugcaaaagggcuggaauggguggcgacuaucaguuaugacggacgcaauauucaguacgcugauagcgucaagggccgauucacguuuucccgugacaacucucaagauaccuuguauuuacagcuuaauucgcuaagaccagaggacacagccguguacuauugugcaaggccgguucggucacgcuggcuccagcugggucuugaagaugccuuccauauaugggggcagggaacuauggugaccgucagcagugcuuccacaaaaggccccucuguguuuccucuggcaccaagcuccaagucaaccaguggcgggacugccgcuuugggaugccucguaaaagacuacuuccccgagccuguuacagugagcuggaacucuggugcccugaccuccggcguccacacguuuccagcggugcugcaaucaagcgggcucuauaguuuaucuuccguggucacuguucccagcucgucucugggaacccagacauacaucuguaaugugaaccauaagccuuccaauacuaagguagauaaaaagguggaaccaaaaucaugcgacaagacccacacauguccgcccugcccugcaccagagcuuuugggcggucccagugucuuccuguuuccuccaaaacccaaggauacccuaaugauuagcagaacgccggaggugacuuguguuguggucgacgugucccaugaagauccugagguaaaguucaacugguacguugacgggguggaaguccacaaugccaaaacaaagcccagggaggagcaguauaacucuaccuaccggguggucagcgugcucacuguucugcaccaggauuggcuuaauggaaaagaauauaagugcaaagugucaaacaaggcucugccagccccuaucgagaaaacaauuaguaaggcaaagggccaaccccgcgaaccacagguauacaccuugcccccuucccgagacgagcucacgaaaaaucaggucagccugaccuguuuagugaagggcuuuuauccaucugacaucgcuguugaaugggagucaaacgggcaaccggagaauaacuacaaaacaacucccccugugcuggauagugacgguagcuucuuucucuauuccaagcugaccgucgauaaaucuagauggcagcagggaaacguguucucgugcagcguaaugcaugaagcccugcacaaucauuacacacagaaguccuugucacuaaguccaggcaag

SEQ ID NO: 23700 - RNA, 642 nt, Artificial Sequence
  derived and/or modified sequence opt3 from Roledumab_LightChain1
gccaucagaaugacccagagccccuccucuuucucagcuaguacaggcgacagggugacuauuacgugccgggcaagccaagauauacgcaacuacgucgccugguaucagcagaaguccgggaaagcgccuaaguuucugaucuacgcugccucuacccuccagucgggaguuccaucacgauucagcgguaguggcuccgggacagacuuuacucuuaccauuaauucucugcaaagcgaggauuucgcaacauauuacugucagcaguauuacaacuccccgcccaccuuuggacagggcacucguguggaaaucacaagaaccguagccgcuccuucaguguucauuuuuccacccagugacgagcaauugaaaagcgguacggcaucugucgugugcuuacugaauaacuucuauccuagggaagccaagguucaguggaaaguggauaaugcucuacaguccgggaacucacaggagagcgucacugaacaagacaguaaggauucuaccuacucccucagcucgacacugacucuuucuaaggccgacuacgagaaacacaagguguaugcgugugagguaacccaucagggacuguccucaccaguuacaaaaaguuuuaaucggggcgaaugc

SEQ ID NO: 23701 - RNA, 639 nt, Artificial Sequence; identical to SEQ ID NO: 23655
  derived and/or modified sequence opt3 from Romosozumab_fab_fragment

SEQ ID NO: 23702 - RNA, 1347 nt, Artificial Sequence
  derived and/or modified sequence opt3 from Romosozumab_HeavyChain1
gaggugcagcugguccaaagcggcgccgaaguuaagaaacccggggcuuccgugaagguaucuugcaaagcaucaggauacaccuucacagacuauaacaugcacugggugagacaggccccuggucagggccucgaguggaugggggaaaucaauccaaacaguggaggcgcggguuacaaucagaaguuuaaagggagggucacuaugacgaccgauacaagcacuuccaccgcuuauauggagcuucggucucugcgcucggacgauacagccguguacuauugugcacgauugggauacgacgauauuuaugacgauugguacuucgacguuuggggccaaggcaccacugugacagucucaagcgccaguaccaaggggccguccguguuucccuuagcuccuugcucucguagcacguccgaaucaacugcagcccugggaugucuaguaaaggauuacuucccagagcccguuaccgugaguuggaacagcggugcucucacaucuggcguccauacuuuuccugccgugcugcaguccucagggcuuuauagccugaguucuguggucaccguuccauccagcaauuucggaacacagaccuacacgugcaacguggaccacaaacccucgaauacuaagguagauaaaacaguggagagaaaguguugcgucgaauguccuccaugcccggcgcccccuguggcaggcccaucuguuuucuuguuucccccuaaaccaaaggacacccucaugauauccaggacucccgaggugacaugugucgugguagauguuucacaugaagacccggaggugcaguuuaacugguaugucgacgguguggagguccacaaugccaagaccaaaccucgggaggaacaauucaacaguacguuucgcgugguuagcgugcugaccguaguccaucaggauuggcugaaugggaaggaauacaaaugcaagguguccaacaaaggacuccccgcuccaaucgagaagacaauuucuaaaacuaagggccagccuagagaaccccagguuuauaccuuaccacccagcagggaggagaugacaaagaaucaagugucacugacuugucuugucaaaggcuucuacccuagugacaucgccguggaaugggaguccaacgggcagccagaaaauaacuauaagaccacaccgcccauguuggauagcgacggaucauuuuuccuguacucuaaacuaaccguagauaagagucgguggcagcaagguaacguguucagcugcuccguuaugcacgaggcacuccacaaucauuacacucagaaaucucugucgcuuagcccuggcaag

SEQ ID NO: 23703 - RNA, 642 nt, Artificial Sequence
  derived and/or modified sequence opt3 from Romosozumab_LightChain1
gacauccagaugacccaaagccccuccucucugucagccagugugggcgauagagucacaauuacuugcagggcuagccaggacauauccaacuaccucaauugguaucagcagaagccugggaaagcaccaaaacuucugaucuacuauacgucucgguuguuaucgggaguuccgucacgcuucagcgguaguggcuccgggaccgauuuuacacugacuauuucuagccuacaacccgaggacuucgccaccuacuauugucagcagggagauacacucccuuacaccuuuggcggugggacuaagguggaaaucaagcgaacaguagcggcuccauccguguucauuuuucccccuucagacgagcagcugaaaaguggaaccgccagcgucgugugccuucugaacaauuucuauccacgugaagcaaagguucaauggaagguggauaacgccuugcagucuggcaauucccaggagucagucacggaacaggacagcaaagauaguacuuacucucucuccagcacccugacacugucgaaggcugacuacgagaaacacaagguguaugcaugugagguaacucaucaaggccucucuucccccguuaccaaaucauuuaacagaggggaaugc

SEQ ID NO: 23704 - RNA, 1326 nt, Artificial Sequence
  derived and/or modified sequence opt3 from Rontalizuab_HeavyChain1
gaggugcagcuggucgaaagcggcgggggacucguucaacccgguggcucccuuagacugucuugcgccaccucaggguacacauucacugaguauaucauucacugggugaggcaggcuccuggaaagggcuuggaauggguagcaaguauaaacccagacuacgauaucacgaauuauaaccagcgguuuaaaggucgcuucaccauuagcuuagacaaguccaaacgaacagccuaccugcaaaauucucuacgugcggaggauacugcuguguauuacugugccucguggaucucagacuuuuucgauuauugggggcagggaacccucgucacagugagcagugcauccaccaagggcccgucuguuuuuccccuggccccuagcuccaaaucaacuagcggcgggacagcugcacuuggaugccuggugaaggacuacuucccagaacccgucaccgugagcuggaacucuggugccuugacguccggcguacauacuuuuccugcuguucuccagucaagcgggcuguacagucugucuuccguggucaccgugccaagcucgucucucggaacacagacuuauauuuguaaugugaaccacaagcccuccaauaccaaagucgauaagaaaguugagccuaagucaugcgacaaaacacauaccuguccaccgugccccgccccugaguuacugggcgguccaaguguguuccuuuuucccccuaagccaaaggauacguugaucagcagaacucccgaaguaacauguguggucguggacguuucccacgaggauccggaagugaaauucaacugguacgucgacgggguggagguacauaaugcgaagaccaaaccuagggaggaacaguauaacucuacuuaccggguugugagcguccugacagugcuacaccaagauuggcucaauggaaaggaguauaaaugcaaggucucaaacaaagcacugcccgccccaauagaaaagaccaucaguaaggcuaaaggccagccucgcgagccccagguguacacgcuuccacccuccagagaagagaccaagaaucagguuagccugacauguuuggugaaaggcuuuuauccuucugacauugccguagagugggaaucaaacgggcaaccagagaauaacuacaagacuaccccgcccguccucgacagugauggaaguuucuuucuguacuccaaauuaacaguggacaagucuagguggcagcaggguaacguuuucucgugcagcgugcacgaagcacugcauaaucacuauacucaaaagucccucucacuuaguccuggc

SEQ ID NO: 23705 - RNA, 648 nt, Artificial Sequence
  derived and/or modified sequence opt3 from Rontalizuab_LightChain1
gacauccagacccaaagccccuccucucugucagccagugugggcgauagagucacaauuacuugcagggcuagccaguccguuucuacgucgucauacagcuaucacugguaccagcagaagccugggaaagcaccaaaggugcucauaaguuaugccuccaaccuugagucuggaguaccgagccgguucuccgguucaggcagugggaccgacuuuacacugacuaucagcucuuugcaacccgaagauuucgcgaccuacuauugucagcauuccuggggcauuccucgcacauuuggacaggguaccaaaguggagaucaagcgaacugucgcugccccaucaguguucauuuuucccccuagcgacgaacaguuaaaaagugggacagcaucuguugugugccugcuaaauaacuucuacccacgugaggccaagguccaauggaagguggauaaugcucuccaguccggaaacagccaggaaucgguaaccgagcaggacucuaaagauuccacguauucacugaguagcacucuuacccuguccaaggcagacuacgagaaacacaagguuuacgccugugaagugacacaucaaggcuugucuagccccgucacuaaaucauuuaauagaggcgagugc

SEQ ID NO: 23706 - RNA, 1341 nt, Artificial Sequence
  derived and/or modified sequence opt3 from Rontalizumab_HeavyChain1
gaggugcagcuggucgaaagcggcgggggacucguucaacccgguggcucccuuagacugucuugcgccaccucaggguacacauucacugaguauaucauucacugggugaggcaggcuccuggaaagggcuuggaauggguagcaaguauaaacccagacuacgauaucacgaauuauaaccagcgguuuaaaggucgcuucaccauuagcuuagacaaguccaaacgaacagccuaccugcagaugaauagucuacgugcggaggauacugcuguguauuacugugccucguggaucucagacuuuuucgauuauugggggcaaggaacccucgucacagugagcagugcauccaccaagggcccgucuguuuuuccccuggccccuagcuccaaaucaacuucuggcgggacagcugcacuuggaugccuggugaaggacuacuucccagaacccgucaccgugagcuggaacucuggugccuugacguccggcguacauacuuuuccugcuguucuccagucaagcgggcuguacagucugucuuccguggucaccgugccaagcucgucucucggaacacagacuuauauuuguaaugugaaccacaagcccuccaauaccaaagucgauaagaaaguugagccuaagucaugcgacaaaacacauaccuguccaccgugccccgccccugaguuacugggcgguccaaguguguuccuuuuucccccuaagccaaaggauacguugaugaucagcagaacucccgaaguaacauguguggucguggacguuucccacgaggauccggaagugaaauucaacugguacgucgacgggguggagguacauaaugcgaagaccaaaccuagggaggaacaguauaacucuacuuaccggguugugagcguccugacagugcuacaccaagauuggcucaauggaaaggaguauaaaugcaaggucucaaacaaagcacugcccgccccaauagaaaagaccaucaguaaggcuaaaggccagccucgcgagccccagguguacacgcuuccacccuccagagaagagaugaccaagaaucagguuagccugacauguuuggugaaaggcuuuuauccuucugacauugccguagagugggaaucaaacgggcaaccagagaauaacuacaagacuaccccgcccguccucgacagugaugguagcuucuuucuguacuccaaauuaacaguggacaagucuagguggcagcagggaaacguuuucucgugcagcgugaugcacgaagcacugcauaaucacuauacucaaaagucccucucacuuaguccuggcaaa

SEQ ID NO: 23707 - RNA, 654 nt, Artificial Sequence
  derived and/or modified sequence opt3 from Rontalizumab_LightChain1
gacauccagaugacccaaagccccuccucucugucagccagugugggcgauagagucacaauuacuugcagggcuagccaguccguuucuacgucgucauacagcuauaugcacugguaccagcagaagccugggaaagcaccaaaggugcucauaaguuaugccuccaaccuugagucuggaguaccgagccgguucuccgguucaggcagugggaccgacuuuacacugacuaucagcucuuugcaacccgaagauuucgcgaccuacuauugucagcauuccuggggcauuccucgcacauuuggacaggguaccaaaguggagaucaagcgaacugucgcugccccaucaguguucauuuuucccccuagcgacgaacaguuaaaaagugggacagcaucuguugugugccugcuaaauaacuucuacccacgugaggccaagguccaauggaagguggauaaugcucuccaguccggaaacagccaggaaucgguaaccgagcaggacucuaaagauuccacguauucacugaguagcacucuuacccuguccaaggcagacuacgagaaacacaagguuuacgccugugaagugacacaucaaggcuugucuagccccgucacuaaaucauuuaauagaggcgagugc

SEQ ID NO: 23708 - RNA, 1341 nt, Artificial Sequence
  derived and/or modified sequence opt3 from Rovalpituzumab_tesirine_HeavyChain1
caggugcaacugguccagagcggcgccgagguuaagaaacccggggcuuccgugaagguaucuugcaaagcaucaggauacaccuucacaaacuaugguaugaauugggugagacaggccccuggccaggggcucgaauggaugggauggaucaacacuuacacgggcgagccaaccuaugcggacgauuuuaaggguagggucacaaugacuaccgacacaaguaccagcacugcuuacauggaacuucggucccugcgcucugaugacacagccguguauuacugugcacgaauuggggauucgucaccgagcgacuauuggggacaaggcaccuugguuacggugaguuccgccucuacuaaaggccccagcgucuucccuuuagcuccauccucaaagaguaccagcgggggaacagcagcccuggguugccuagugaaggauuacuuucccgagccuguaacuguuucuuggaacuccggcgcucucaccucaggggugcacacauucccagccguccugcagagcaguggacuuuacucucuguccagcguggugaccguccccucgucuuccuugggcacgcagacuuauauauguaauguuaaucauaaaccuucaaacacaaagguggacaaaaagguagaaccaaaaaguugcgauaagacccacacuuguccgcccugcccugcgccagagcuccugggugggcccagcguguuucuguucccuccaaagcccaaagacacacucaugaucucccguaccccggaggucacgugugugguuguggaugucucucaugaagacccugaggugaaguuuaauugguacguagauggaguugaagugcacaacgcaaaaaccaagcccagagaggagcaguauaauagcacauacagggucgugucagucuuaacugugcugcaucaagacuggcuuaacggcaaagaauauaagugcaaaguuaguaauaaggccuugccagcuccuauugagaagaccaucuccaaagccaagggccagccccgggaaccacagguguacacacugcccccuagccgcgacgagcuaacuaaaaaccagguaucucucaccugucuggucaagggguucuauccaucagauauugcaguggaaugggagaguaauggacaaccggagaacaauuacaaaacaacucccccuguucuugacagcgaugguuccuuuuuccuguacucuaaguugaccguggacaagucgagauggcagcagggcaacgucuuuagcugcuccgugaugcacgaagcucuccacaaccauuauacgcaaaaaucacugaguuuaucuccaggg

SEQ ID NO: 23709 - RNA, 642 nt, Artificial Sequence
  derived and/or modified sequence opt3 from Rovalpituzumab_tesirine_LightChain1
gagaucgugaugacccagagccccgccacacuguccgucucuccuggcgaaagagcuacucucucaugcaaggcaagucaaagcguuuccaacgacgugguaugguaccagcagaaaccagggcaggccccgaggcuucugauuuauuacgcgucuaaucgguauacgggaauacccgcucgcuucucggguucaggcagcgggaccgaguuuacauugacuaucaguuccuuacaaucugaagauuucgccguguacuauugucagcaggacuacaccagcccuuggacauuuggacagggcaccaagcuggagauuaaacgaacugucgcagccccauccguguucaucuuucccccuucagaugaacaacuaaagagugguacagcuagcguugugugccuccugaacaauuucuauccacgugaggcaaaaguccaguggaagguggacaacgcccuucagucuggaaauucccaggagucaguaaccgaacaagauagcaaggacaguacguacucucuguccagcacuuugacccucucgaaagcugauuacgagaagcacaaaguuuaugccugugaagugacacaucaggggcugucuucccccgucacuaagucauuuaacagaggcgagugc

SEQ ID NO: 23710 - RNA, 1341 nt, Artificial Sequence
  derived and/or modified sequence opt3 from Rovelizumab_HeavyChain1
caggugcaacugguccagagcggcgccgagguuaagaaacccggggcuuccgugaagguaucuugcaaagcaucaggauacaccuucacaaacaauuggaugcagugggugagacaggccccuggucaaggccucgaauggaugggggcgaucuuuccaggagacgaugagacuagguauacgcagaaguuccggggcaaagcuaccauuacagccgacaccaguacuagcacagcauacauggaacuuuccucucugcgcucggaggauaccgccgucuauuacuguggucgagggggaaaguugcguccguuugcuuuagacuauuggggccagggcacucuggugacaguuucaagcgcaaguaccaaggggcccuccguguucccucuagccccaugcucuagaagcacguccgaaucaacugcugcccucggaugucuggucaaagauuacuuucccgagccugugaccguaaguuggaacagcggugcgcuuacaucuggcguucacacuuucccagcagugcugcaguccucaggguuguauagccucaguucugucgugaccgugcccuccagcucgcugggaacaaagaccuacacgugcaaugucgaccauaaaccuucuaacacuaagguugauaaaaggguggaguccaaguacggcccaccgugucccucaugcccugccccagaauuucugggugggcccaguguauuccucuuuccuccaaagcccaaagacacauuaaugauaagccggaccccggaggugacuugugucgugguugaugugucccaagaagacccugagguccaguucaauugguauguggauggaguagagguucacaacgcuaagacaaaaccccgcgaggaacaguuuaauucuaccuacagaguggucagcgugcugacgguccuucaucaggacugguugaacggcaaggaauauaaaugcaaggugucaaauaaaggccugccaaguuccaucgagaagaccauuagcaaggccaaagggcaaccuagggaaccccagguuuacacacuaccacccucucaggaggagaugacuaagaaccaagugucacucaccugucugguaaaaggauucuauccuagugauaucgcagucgaaugggagagcaauggucagccagaaaacaauuacaagacaacuccgcccgugcuugacuccgacggcucguuuuuccuguauucucgguugaccguugauaaaagccgcuggcaggaggggaacguguucuccugcucagucaugcacgaagcucuccauaaucacuacacacagaagagucugucuuuaagccugggaaag

SEQ ID NO: 23711 - RNA, 654 nt, Artificial Sequence
  derived and/or modified sequence opt3 from Rovelizumab_LightChain1
gacauccagaugacccaaagccccuccucucugucagccagugugggcgauagagucacaauuacuugcagggcuagcgaguccguugaaucuuacgggaacaauuucauguauugguaccagcagaagccuggaaaagcaccaaagcuccuuauauaucuggccucgaacuuggagucaggugugccgagccgguuuaguggcuccgggucuggaacggacuucaccuuaacaaucagcucccugcagcccgaagauuuugcgacuuacuauugucaccaagacaaugaggauccuccaaccuucggccaggguacaaaacuagaaauuaagcgcaccguagcugcccccucaguguuuaucuucccuccaagugacgagcagcucaaaagcgggacugcaucugucgugugccugcuuaacaauuuuuacccccgagaggccaagguucaguggaagguggauaacgcucugcaauccggaaauucacaggaaagcgucacagagcaggacaguaaagauucuaccuauuccuugagcucgacgcucacucugucuaaggcagacuacgaaaaacauaagguguacgccugugagguaacccaccagggccuguccucaccuguuacaaaaaguuucaaccguggcgagugc

SEQ ID NO: 23712 - RNA, 1341 nt, Artificial Sequence
  derived and/or modified sequence opt3 from Ruplizumab_HeavyChain1
caggugcaacugguccagagcggcgccgagguugugaagcccggggcuuccguaaaacucucuugcaaggcaucaggauacaucuucaccaguuauuacauguauugggugaaacaggccccuggucagggccuugaauggauuggggagauaaacccaagcaauggagacacaaacuuuaaugaaaaguucaaauccaaggcgacucugacggucgauaagucugcuucgaccgccuacauggaguugagcucauuaagaagugaagacacagcaguguauuacuguacuagguccgauggccggaacgacauggauucuuggggucaagggacccugguuacagugagcuccgccucaaccaaaggaccgagugucuuuccccuagcuccuagcucuaaguccacuucaggcggcacagcagcccucgggugccuggugaaagacuauuucccagagcccguaaccguuagcuggaauaguggagcucuuacgucuggugugcacacuuuuccugccguccugcaguccagcggcuuguacucgcucucuuccguggugaccgucccaucaaguagccuggggacacagacuuacaucuguaacguuaaucauaagcccuccaacaccaaaguggauaagaagguagagccuaaaucuugcgacaagacacacaccuguccaccgugccccgcgccugaacugcucggaggcccaagcguguucuuauuucccccuaaaccaaaggauacgcugaugauuucacgcacucccgaggucacaugugugguuguggacgucagucaugaagauccggaggugaaauucaauugguauguagacgguguugaggugcacaacgcaaagaccaaaccucgagaagaacaguacaauuccacuuaucgugucgugagcguccuuacaguguugcaucaagauuggcugaacgggaaggaauacaagugcaaaguuucuaauaaggcccuacccgcuccaaucgagaaaaccauuucaaaggccaaaggacagccuagagaaccccagguguauacgcucccacccaguagggacgagcugaccaagaaccagguaagccuuacaugucuggucaagggcuuuuacccuuccgacaucgcaguggagugggaaucuaauggccaaccagagaacaacuauaaaacuaccccgcccguuuuggauucggacgggagcuucuuucucuacuccaagcugacaguggauaaaucacgguggcagcagggaaaugucuucaguugcucugugaugcacgaggcuuuacacaaccauuacacucaaaagagccugucccucucaccuggu

SEQ ID NO: 23713 - RNA, 654 nt, Artificial Sequence
  derived and/or modified sequence opt3 from Ruplizumab_LightChain1
gacaucgugcugacccagagccccgccacacucuccgucucuccuggcgagagagcuacuauuucaugcagggcaagucaacggguuagcuccucuacguacucguauaugcacugguaccagcagaaaccagggcagccgcccaaacuucugauaaaguaugccucaaacuuggaaagcggagugccugcgcgcuucagugguuccggcucugggaccgauuuuacauuaacuaucagcuccguagagccagaagacuucgcuaccuacuauugucaacauucaugggagauucccccuacauuuggaggcgguaccaaacuggaaaucaagcgaacuguggccgcaccaagugucuucauuuuucccccuagcgaugagcagcuaaaaucugggacagccuccgugguuugccuccugaauaacuucuacccacgugaggcuaaggugcaguggaaggucgacaaugcacuucagucaggaaacagccaagaaagugugaccgagcaggauucuaaagacuccacguauagccugucgucuacuuugacccucuccaaggccgauuacgaaaaacacaagguauacgcuugugagguuacacaucagggccugucaaguccggugacuaagagcuuuaauagaggcgagugc

SEQ ID NO: 23714 - RNA, 1353 nt, Artificial Sequence
  derived and/or modified sequence opt3 from Sacituzumab_govitecan_HeavyChain1
caggugcaacugcagcagagcggcuccgagcucaagaaacccggggccucugucaagguuucaugcaaagcuaguggauacaccuucacaaacuaugguaugaauugggugaagcaggcaccuggccaagggcuuaaauggaugggauggaucaacacuuacacgggcgaaccaaccuauacagacgauuuuaaggguagauucgccuuuagccuggacacuuccguaucuaccgcguacuugcagauuucgucauuaaaggcugaugacacagccguguauuucugugcaaggggaggguuuggcagcaguuacugguauuucgaugucuggggccaggggucccuggugaccguuucuagcgccuccacuaaaggaccgucaguguuuccccuagcuccuaguagcaagucuacauccgguggcaccgcagcccucgggugccuggucaaagacuacuucccagagcccgugacgguaucauggaauagcggagcucuuacaaguggcguucacaccuuuccugccgugcugcagucuuccgguuuguacagccucucgucugucgugacagugccauccucaagucuggggacucaaaccuauauauguaacgucaaucauaagcccagcaacacaaaaguugauaagcggguggaaccuaaguccugcgacaaaacccacacguguccaccgugccccgcgccugagcugcucggaggcccaucuguauucuuauuucccccuaagccaaaagauacucugaugaucagccgcacacccgaagugaccugugucgugguugacgugucacaugaggauccggaggucaaguucaauugguacguggacggcguagaaguucacaacgcaaaaacuaagccucgagaggaacaguauaauaguacauaccguguggucuccgugcuuaccgucuugcaucaggauuggcugaacgggaaagaguauaagugcaaggugagcaauaaagcccuacccgcuccaauugagaagacgaucucuaaagccaagggacagccuagagaaccccaaguuuacacccucccacccucaagggaggaaaugacuaaaaaccaggugagucugacuugucuuguaaaggguuuuuauccuagcgacauugcagucgagugggaauccaauggccagccagagaacaauuacaagaccacaccgcccgugcuggacucugaugggucguucuucuuguacagcaaacucacuguugacaagucccgguggcaacagggaaacguguuuucaugcagugucaugcacgaggcucugcacaaccauuauacccagaaaucuuuaagccuguccccuggcaag

SEQ ID NO: 23715 - RNA, 642 nt, Artificial Sequence
  derived and/or modified sequence opt3 from Sacituzumab_govitecan_LightChain1
gacauccagcugacccaaagccccuccucucucucagccagugugggcgauagagucagcauuacaugcaaggcuucccaggacguuucuauagcaguggccugguaccagcagaaaccugggaaggcgccaaaacuucugaucuauucggcuucauacagguauacuggaguaccggaucgguucagcgguaguggcuccgggacggacuuuaccuugacaauuucuagcuuacaacccgaggauuucgccguguacuauugucagcagcacuacaucacuccucugaccuuuggagcaggcacaaaggucgaaauuaaacgcaccguggccgcuccauccguuuucaucuuucccccuucagacgagcagcuaaagagugguacugcaagcguggucugccuccugaacaauuucuauccacgagaagccaaggugcaauggaaaguagauaacgcccuucagucuggaaauucccaggagucaguuacagaacaggacagcaaggauaguaccuacucucuguccagcacguugacucucucgaaagcugacuacgagaagcauaaaguguaugcgugugaggucacccaccaagggcugucuucccccgugacaaagucauuuaaccguggcgaaugc

SEQ ID NO: 23716 - RNA, 1326 nt, Artificial Sequence
  derived and/or modified sequence opt3 from Samalizumab_HeavyChain1
caggugcaacugcagcagagcggcuccgagcucaagaaacccggggccucugucaagaucucaugcaaagcuaguggauacagcuucaccgacuauauuauacuuuggguuagacagaacccugguaagggccuggaauggaucgggcacauugauccauacuauggauccucuaauuacaacuugaaauuuaagggcagggugacaaucacugcagaccaaucgacgaccacagccuauauggaguuaucaagccugcggagugaagauacugcgguauacuauuguggucgcuccaagcgagacuacuucgauuacugggggcagggaaccacacuaaccgugucuagcgcuuccacuaaaggcccgucagucuuuccccucgccccuugcagucguagcacaucugaguccaccgcagcccugggcugucuugugaaggacuauuucccagaacccguuacggugucauggaauagcggggcucugaccaguggaguccauacuuuuccugcaguguugcagucuuccggucucuacagccugucgucuguaguuacagugccauccucaaacuucggcacucagaccuauacaugcaaugucgaucacaaacccaguaacaccaagguggacaaaacgguggagagaaaguguugcgucgaguguccuccaugcccggcucccccuguugccgggccaagcguguuucuguuucccccuaagccaaaagauacucucaugauuuccaggacacccgaaguaaccuguguggucguggacguuucucaagaggauccggaagugcaguucaauugguacgucgacggaguggagguacauaacgccaagacuaaaccucgggaggaacaguucaauagcacauaucgcguugugucagucuuaaccgugcugcaccaggauuggcuuaacggcaaggaguacaaaugcaaggucaguaauaaagguuugcccuccagcaucgaaaagacgauaucuaaggcgaaagggcaaccaagagagccucagguguauacccugcccccaucacaggaagagaugacaaagaaccaaguuagucuaacuugucucgugaaaggauuuuaccccagcgacaucgcaguagagugggaauccaauggccagccugagaacaauuacaagaccacaccaccgguccuggacucugauggcucguucuuucuuuauagcaggcugacuguggacaaaucccgguggcaggaagggaacguuuucucaugcagugugaugcaugaggccuugcacaaccacuacacccagaagucucucagccuguccuuagga

SEQ ID NO: 23717 - RNA, 642 nt, Artificial Sequence
  derived and/or modified sequence opt3 from Samalizumab_LightChain1
gacauccagaugacccaaagccccuccucucugucagccaguauuggcgauagagugacaauaacuugcaaggcuagccaggacaucaacuccuaccucucuugguuccagcagaaaccugggaaggcaccaaaacuucugauuuauagggccaaucgguuggucgauggaguuccgucgcgcuuuucagguagcggcagugggacggacuacaccuuaacaaucuccucucugcaacccgaggauuucgcgguguauuacugucuacaguaugacgaauuuccuuacacuuucggaggcgguaccaagcucgagauuaaacgaacaguagcugccccaagcguguuuaucuuucccccuuccgaugaacagcugaagucagggaccgcaagugucgugugccuucugaacaauuucuauccacgugaggccaagguucaguggaaaguggacaacgcuuugcaaagcggaaauucucaggaauccgucacugagcaggauucaaaggacagcacauacagucucucuuccacccugacgcugagcaaagcagauuacgagaagcacaaaguguaugccugugaaguaacucaucagggccucucgucucccguuaccaaguccuucaacagaggcgagugc

SEQ ID NO: 23718 - RNA, 1338 nt, Artificial Sequence
  derived and/or modified sequence opt3 from Sarilumab_HeavyChain1
gaggugcagcuggucgaaagcggcgggggacucguucaacccgguagaucccuuaggcugucuugcgccgcuucacgguucaccuuugacgauuacgcaaugcacugggugcgccaggccccuggcaagggguuggaguggguaaguggaaucagcuggaacuccggccgaauugguuaugcggacucugugaaagggcguuucacaauaucgagagauaaugcugaaaacucauuauuucugcagaugaauggacuaagggccgaggacacugcacucuacuauugugccaagggccgggauagcuucgacaucuggggccaggggacgauggucaccgugaguuccgcuucuacaaaaggaccaagcguuuuuccgcuggcacccuccucaaagaguacuagcgguggcaccgccgcucuugggugccuggugaaagauuacuucccugaaccagucacagugucuuggaacuccggagccuugaccucaggcguacauacuuuucccgcgguucuccaaagcaguggucuguauucucuguccagcguggucacagugccuucgucuucccucgggacccagacguacauuuguaaugugaaccacaagccaucaaauacuaaggucgacaaaaagguugagcccaaaaguugcgauaagacccauacauguccuccaugcccggcacccgaguuacugggaggcccuagcguguuccuuuuuccacccaaaccuaaggacacuuugaugaucucccgcaccccagaaguaacauguguggucguggauguuucucacgaggaccccgaagugaaguucaacugguaugucgauggcguggagguacauaaugccaaaaccaagccgagagaggaacaguacaacagcacguacaggguugugucaguccugacugugcuacaccaggacuggcucaaugggaaagaguauaagugcaaagucaguaacaaggcucugccugcccccauugagaaaacaaucuccaaggcaaagggacaaccacgggaaccucagguguacacccuucccccaagccgcgacgaacugacuaaaaaucagguuucuuugacaugucucgugaaggguuuuuaucccucagauauagcuguagagugggagaguaacggccagccugaaaauaacuacaaaaccacgccaccgguccuggacagcgauggguccuucuuuuuauauucuaagcugaccguggacaaaucgcgauggcaacagggaaacguuuucagcugcuccgugaugcacgaggcccuccauaaucacuacacacagaagucacuuagucugucucccggcaag

SEQ ID NO: 23719 - RNA, 642 nt, Artificial Sequence
  derived and/or modified sequence opt3 from Sarilumab_LightChain1
gacauccagaugacccaaagccccuccucugugucagccagugucggcgauagaguuacaauuacuugcagggcuagccaggggauauccucuuggcuggcaugguaccagcagaagccuggaaaagccccaaagcuccuuaucuauggugcgucgucacuggagagcggcgugccgagucgguucuccgggucuggaagcggcacggacuuuaccuugacaauuuccucauuacaacccgaagauuucgcuaguuacuauugucagcaggccaacagcuuuccuuacacuuucggucaggggaccaaacuggagaucaagcgcacaguagcagccccaucuguguuuauuuuucccccuuccgacgaacaacuaaaaucaggaaccgcuagcgucgugugccuccugaauaacuucuauccacgagaggcaaagguucaguggaagguggauaaugcccuucagaguggcaacucucaggaauccgucacugagcaagacagcaaagauucgacauacucucuguccucaaccuugacgcucaguaaggcugacuaugagaaacacaagguguacgccugugaaguaacucaucagggccugagcucccccguuaccaaaucuuucaaucguggggagugc

SEQ ID NO: 23720 - RNA, 1296 nt, Artificial Sequence
  derived and/or modified sequence opt3 from Satumomab_pendetide_HeavyChain
caggugcaacugcagcagagcgacgccgagcucgucaagcccggcgcuuccguuaaaaucucuugcaaggcaucaggguacaccuucacagaucacgccauucauugggcgaaacagaagccugaacaaggacuugaguggauagguuauaucaguccaggcaacgacgauauuaaauacaaugaaaaguuuaaggggaaagcuacucugacggccgacaagagcuccucuaccgcauauaugcaguugaacucguuaacaucagaggauagcgccguguacuucuguaaaagaaguuauuacggacacuggggccaggguacuacccugacaguauccucugcuagcaccaaggggccguccguguuuccccuagcaccuugcucaaggaguacuagcgaaucuacagccgcucucggaugucuggucaaagacuauuucccagagcccgugaccguuuccuggaacucaggcgcccuuacgagcggcgugcauacuuuuccugcgguccugcagaguucuggguuguacucccucagcucggugguaaccguuccaucuuccucacugggaacaaagacuuacacaugcaauguggaucacaagcccaguaauacaaaagucgacaagcggguguguccuccaugcaaauguccggcacccaaccugcucgguggcccuagcguguucaucuuuccacccaagauuaaagaugucuuaaugaucucccugucuccuauaguuaccugcgugguaguggacgucagcgaggaugacccagaugugcaaaucucaugguucguuaauaacguggaaguccauacggcccagacucagacacaccgcgaggacuauaauaguacccuucgagugguauccgcuuugcccauucagcaccaagacuggaugagcgggaaggaauuuaaauguaagguuaacaauaaggaucugccggccccuaucgagcguacuauuucuaaacccaagggaucagugagagcaccacaggucuacgugcuaccucccccagaggaagagaugaccaaaaagcaggucacccucacgugcauggugaccgacuucaugcccgaagauaucuauguugaguggacaaacaauggcaaaacugaacugaacuacaagaauaccgagccugugcuugacagugaugguagcuauuuuauguacuccaagcugaggguagagaaaaagaacugggucgaacggaacucuuauucguguagcgugguucaugagggguugcacaaucaucacacaacuaaauccuucucacgc

SEQ ID NO: 23721 - RNA, 630 nt, Artificial Sequence
  derived and/or modified sequence opt3 from Satumomab_pendetide_LightChain
gacauccagaugacccaaagccccgccucccugucugugucagucggcgagacaguuacuauuacgugcagagcuagugaaaacauauacagcaaucucgcaugguaucagcagaagcaggggaaauccccucaacuucugguguacgccgcgaccaacuuggcugauggaguaccaucuagguucucggguucaggcagcgggacacaguauaguuuaaagaucaauucccugcagucugaggacuuuggaagcuacuauugucagcacuucuggggcacuccguacaccuuuggugggggaacacggcuagaaauuaaacgcgccgaugcagcccccaccguguucaucuuuccuccauccgacgagcaacucaagucaggcacugcuagugucgugugccugcuuaacaauuucuauccccgagaagcaaaaguucaguggaagguggauaacgcccugcagagcggcaauucucaggaguccgucacagagcaagacucaaaggauagcaccuacaguuugucuuccacgcucacucugagcaaagcugacuacgaaaagcauaaaguguaugccugugagguaacccaccaggggcugucgucuccuguuacaaaguccuuuaac

SEQ ID NO: 23722 - RNA, 1371 nt, Artificial Sequence
  derived and/or modified sequence opt3 from Secukinumab_HeavyChain1
gaggugcagcuggucgaaagcggcgggggacucguucaacccgguggcucccuuagacugucuugcgccgcuucaggguucaccuuuaguaacuacuggaugaauugggugaggcaggcaccuggaaagggcuuggaguggguagccgcgaucaaccaggacgguagcgaaaaauauuacgugggguccgucaagggacgguucacaauuucucgcgauaaugcuaaaaacucguuauaucugcagaugaauagccuacgaguggaggacacugccguuuacuauugugugcgugauuacuaugacauacucacggauuacuacauccacuauugguacuuugaccuguggggcagaggcacccuugucacagugucaagugcauccacuaaggggccaucuguauucccgcuggcccccagcuccaaaucaaccaguggagguacagcugcauugggcugccucguuaaggauuauuuuccugaaccagugaccgucagcuggaacucuggggcccugacuuccggagugcauacauuccccgcugugcugcaaucaagcggccucuacaguuuaucuuccgucguuaccgugccuagcucgucucuggguacgcagacuuauauuuguaauguaaaccacaagccauccaauaccaaaguggacaagagggucgagcccaaaucaugcgauaagacacauacuuguccuccaugcccggcccccgagcuuuugggagggccuaguguguuucuguucccacccaaaccuaaggacacccuaaugaucagccggacaccagaaguuaccuguguggucguggauguaucccacgaggaccccgaaguuaaguuuaacugguacguggauggcgucgaggugcauaaugcgaaaacgaagccgcgcgaggaacaguauaacucuacuuacagagucgugagcguucucacagugcugcaccaggacuggcuuaauggcaaagaguacaagugcaaaguaucaaacaaggcacugccugcccccauugagaaaaccaucaguaaggcuaaggggcaaccaagggaaccucaggucuauacuuugcccccaucccgggaagagaugaccaaaaaucaggugagccucacaugucugguuaagggauucuaccccucugacauagccguggagugggaaucaaacggucagccugagaacaauuauaaaacgaccccaccggucuuagauagugacggcagcuuuuuccuguacuccaagcucacaguggauaaaucucgcuggcaacaggggaacguauuuucgugcagcgugaugcacgaagcacuucauaaucacuauacucagaagucccugucauugagucccggaaag

SEQ ID NO: 23723 - RNA, 645 nt, Artificial Sequence
  derived and/or modified sequence opt3 from Secukinumab_LightChain1
gagaucgugcugacccagagccccggcacacucucccuuucuccuggggaaagagccacucugucaugcagggcuagucaaagcgucuccucuucguacuuggcaugguaucagcagaagccaggacaggccccgcgguuacugauuuacggugcgucaagccgcgcuacgggcauacccgaccgauucaguggguccggaucuggcaccgauuuuacacuaacuaucagccgucucgagccugaagacuucgccguuuauuacugucaacaguaugguuccucaccaugcaccuuugggcagggaacaagacuggagauuaaaaggaccguggcagcccccaguguauucaucuuuccuccaagcgaugaacagcuuaagucuggcacugcuuccguggucugucuguugaacaauuucuacccccgggaggcaaaagugcaauggaagguugacaacgcccuccagucaggcaauagccaggagagugugacagaacaggauucuaaagacuccaccuauagccugucgucuacgcugacucucuccaaggcugauuacgagaagcacaaagucuacgccugcgaagugacccaucaaggguuaucaaguccuguaacaaagagcuuuaaccgcggagagugu

SEQ ID NO: 23724 - RNA, 1335 nt, Artificial Sequence
  derived and/or modified sequence opt3 from Seribantumab_HeavyChain1
gaggugcaacugcucgaaagcggcgggggacuuguccaacccgguggcucccugagauugucuugcgccgcuucaggguucaccuuuagucacuacguuauggcaugggugaggcaggccccuggaaagggcuuagaguggguaagcuccaucucuucgucagguggguggacacuguaugcggacagcgugaaaggacgguucacuauuagucgcgauaacuccaagaauacgcuauaccuccagaugaacucucugcgagcugaagacaccgccgucuauuacuguacacguggccuuaaaauggcaacuauauuugauuauuggggccaggggacccuggugacaguuagcuccgccucaaccaagggaccaaguguguucccguuggcucccugcagcagaucuacuuccgagucaacagcagcccucgguugucuggucaaagacuacuuuccugaaccagugaccguaagcuggaauaguggcgcucugacgucugggguucauacuuuccccgccgugcuccaauccagcggauuauauucgcugucuuccgucgugaccgugccuucaaguaacuuuggcacacagacuuacacaugcaaugucgaucacaagccaagcaacacaaagguugacaaaaccguggagaggaaguguugcguagagugucccccuugcccagcgccgcccguggcagguccuuccgucuuccuuuuuccacccaaaccuaaggauacguugaugaucucucggacuccagaagugacauguguuguggucgacgugagccaugaggaucccgaaguacaguucaauugguacguugacgggguggagguccacaacgccaaaaccaagccgcgcgaggaacaguuuaauucaacuuucagaguggucagugugcugacaguugugcaucaagauuggcuaaacggaaaggaguauaaaugcaagguauccaauaaaggccucccugcucccauugaaaagaccaucagcaaaacgaagggccagccaagggagccucaggucuacacccugcccccaucucgggaagagaugaccaaaaaccaggugucacuuacuugucugguuaagggguuuuaucccagugacauugccguggagugggaaagcaauggacaaccugagaacaauuacaagaccacaccaccgauguuggauuccgacgguucuuucuuccucuauucgaaacugacugucgacaagagccgcuggcagcagggcaacguguuuuccugcucaguaaugcacgaagcauuacacaaccauuacacccagaaaagucugucucucagccccgggaag

SEQ ID NO: 23725 - RNA, 651 nt, Artificial Sequence
  derived and/or modified sequence opt3 from Seribantumab_LightChain1
cagagcgcccugacccaacccgcuuccgugucuggcucaccugggcagaguaucacaauuagcugcacuggaacguccucugacgucgguucguacaacguugugucaugguaucagcagcacccaggcaaggcaccgaaacucauaaucuacgagguaagccaaagacccagugggguguccaauagguucucuggaagcaaguccggcaacaccgccucacuuacaauuaguggucugcagacugaagaugaggcggacuauuacuguugcagcuaugcugggucuuccaucuuugucauuuucggaggcggcaccaaagugacaguuuuggggcagccuaaggccgcaccaucagugaccuuauuucccccuagcagugaagaacugcaggccaauaaagcuacucuagucugucucgugucugauuucuacccaggagcaguaacaguugccuggaaggcugacgguucccccgugaaggucggcguggaaaccacgaaaccuagcaagcaaucgaacaauaaauaugccgcgucuuccuaccugucacuuacuccagagcaguggaagagucaucggagcuacuccugccgcgugacccacgaggggucuacagucgagaaaacuguugcaccggccgaguguagc

SEQ ID NO: 23726 - RNA, 1353 nt, Artificial Sequence
  derived and/or modified sequence opt3 from Setoxaximab_HeavyChain1
gaggugcagcugcaacagcccggcccugaacucgagaagccaggggccagcgucaaacuuuccugcaaggcuucuggauacucauucaccgacuauaacaugaauuggguuaaacagaacaauggugaaagucuggaguggaucggcaagauugauccguacuaugggggacccagcuacaaccagaaauuuaaggacaaggcaacauugacuguggauaaauccucuucgacggccuauaugcaauuaaagucacugaccagcgaagacagugcgguauacuauuguacaagaggcgguaauagggauugguacuucgacguguggggagcugggacuacccuaacagucuccgccgaguuugcaucuaccaaaggcccuagcguguucccacucgcccccuccucaaagaguacuagcggcgggacagcugcacugggaugccuuguuaaagauuacuuuccugagccagugaccgucucuuggaacuccggugcccugacgucaggcgugcacacuuuccccgcuguauugcagagcagugggcucuauucucuguccagcguugugaccgucccuucgucuucccugggaacacagacuuacauauguaaugugaaccauaagccaucaaauaccaagguggacaaaaaggucgaaccgaaaaguugcgauaagacacacaccugucccccuugcccagcccccgagcucuuaggcgguccuagcguuuuucuguucccacccaaaccgaaggacacgcuuaugaucucccggacuccugaagugacauguguaguggucgaugugucucaugaggaccccgagguuaaauuuaacugguauguggauggggucgaagugcacaaugcgaagaccaagccacgcgaggaacaguacaacagcacuuaucgaguaguuucaguguugacaguccugcaucaagacuggcuaaauggaaaagaguacaagugcaaagugaguaacaaggcacucccugcccccauugagaaaaccaucuccaaggcuaagggccagccacgugaaccccaggucuauacgcugccuccaagcagagacgagcuuaccaaaaaucaggugucucugacauguuugguuaagggcuucuacccgucagauauugccguggaaugggagaguaacgggcaacccgaaaacaauuacaaaacuaccccuccaguacucgacagcgauggauccuuuuuccuguauucuaaguuaacagucgacaaaucgagguggcagcaggguaacguguuuagcugcuccguuaugcacgaggcacugcacaaucauuacacucaaaagucacucagucuuucucccggcaag

SEQ ID NO: 23727 - RNA, 660 nt, Artificial Sequence
  derived and/or modified sequence opt3 from Setoxaximab_LightChain1
gacaucgugcugagccagucccccucuucacucgucguuagugugggcgagaagguaaccaugagcugcaaauccucucaaucgcuucuguacucaagaaaccagaagaauuauuuggccugguaccagcagaaaccugggcaaagcccaaagguguuaauuuauugggcuaguacaagggaauccggagucccggaucggcugacugguucuggcagcgggacggacuucacccuaacaauauccucagugaaagcagaggaucucgccguuuacuauugucagcaguacuauaguuacccccugacuuuuggagcgggcaccaaacuugaacugaagcgcacaguggcugccccuagcgucuucaucuuuccacccucugacgagcaguugaaguccgguaccgcaucagugguaugccuccugaacaauuucuacccucgagaagccaagguucaauggaaaguggauaacgcucugcagagcgggaauagucaggagucugucacugagcaggacuccaaggauagcacauauucgcucucuuccaccuuaacgcugucaaaagcagacuacgaaaagcacaagguguaugccugugaggugacucaucaaggacuuaguagcccagucaccaaauccuuuaaccguggcgaaugc

SEQ ID NO: 23728 - RNA, 1338 nt, Artificial Sequence
  derived and/or modified sequence opt3 from Sifalimumab_HeavyChain1
caggugcaacugguccagagcggcgccgagguuaagaaacccggggcuuccgugaagguaucuugcaaagcaucaggauacaccuucacaaguuauagcaucuccugggugagacaggccccuggucagggccucgaauggaugggguggauuucugucuacaacggaaauacuaacuaugcgcaaaaguuucagggcagggugacgaugaccacagacacuucgaccucaacagcuuaccuugagcugcggagcuugcgcagugaugacaccgccguuuauuacugugcacgagauccaauagccgcugguuauugggggcagggaacuuuagugacagucuccucugcaagcaccaaaggcccguccguguucccccuggccccuucaaguaagagcacgucuggcgggacugcugcccuaggaugccucguaaaggacuacuuuccagaacccguuaccguguccuggaacucaggugcgcugacaagcggcguccacacuuucccugcagugcuucagaguucugggcuguacuccuugagcucgguggucaccguuccaucuuccucacucggaacacaaaccuauaucuguaaugugaaucauaaacccaguaacacgaagguagauaaaaagguggagccuaaaagcugcgacaagacucacacauguccaccgugccccgccccugaacugcugggcgguccauccgucuuucucuuucccccuaagccaaaagauaccuuaaugauuucucguacucccgaggugacauguguuguggucgacgugagccaugaggauccggaaguaaaguuuaauugguacguugacgggguggagguccacaacgcuaaaaccaagccuagagaggaacaguauaauucaacguacaggguggucagugugcugaccguucuucaucaggauugguugaacggaaaagaguauaagugcaaaguguccaauaaggcccugcccgcaccaaucgaaaagacaauuagcaaagcuaagggccagccucgggagccccaaguauacacucuaccacccucucgcgaagagaugaccaaaaaccaggucucacucacaugucuggugaagggcuucuauccuagugacaucgccguugaaugggagagcaaugggcagccagagaacaauuacaaaacuaccccgcccgugcuugauuccgacggaucuuucuuccuguacucgaaguugacagucgacaagagcagauggcaacaggguaacguguuuuccugcucaguaaugcacgaagcgcuccacaaccauuauacccagaaaagucugucuuuaagcccuggcaag

SEQ ID NO: 23729 - RNA, 645 nt, Artificial Sequence
  derived and/or modified sequence opt3 from Sifalimumab_LightChain1
gagaucgugcugacccagagccccggcacacucucccuuucuccuggggaaagagccacucugucaugcagggcuagucaaagcgucuccucuacguacuuggcaugguaucagcagaagccaggacaggccccgcgguuacugauuuacggugcgucgucacgcgcuaccggcauacccgaccgauucagcgggaguggauccggcacagauuuuacucuaaccaucucucgucucgagccugaagacuucgccguuuauuacugucaacaguaugguagcuccccaagaacauuugggcagggaaccaaaguggagauuaagaggacuguagcagcccccucaguguucaucuuuccuccaagugaugaacagcugaaaagcggcacagcuucugucgugugccuucugaacaauuucuacccccgggaggcaaagguucaauggaaaguggacaacgccuugcaguccggcaauucacaggagagcgucaccgaacaggauaguaaggacucuacguauucccucagcucgacucugacccugucuaaggcugauuacgagaaacacaagguguacgccugugaaguaacacaucaagggcucuccucaccuguuacuaaaaguuuuaaccgcggagagugc

SEQ ID NO: 23730 - RNA, 1347 nt, Artificial Sequence
  derived and/or modified sequence opt3 from Siltuximab_HeavyChain1
gaggugcagcuggucgaaagcggcgggaagcuccuuaaacccggagguucccugaaguugucuugcgccgcuucaggcuucaccuuuaguagcuucgcaauguccugguuuagacaaucuccugagaaaagguuagaauggguugccgagaucucgucagggggaagcuacacauauuacccagacacugugacgggccgguucaccauuagucgcgauaacgcgaagaauacacuguaucuagaaauguccucucuccgaagcgaggacacugcuauguacuauugugcccguggucuguggggguacuaugcacuugauuacuggggacagggcaccuccguaacagugucaagugccagcaccaaaggcccgucugucuuuccccuggcuccuuccucaaagagcacaagugggggaacugcagccuuggguugccucgugaaggacuacuucccagagcccguuaccgugucuuggaacuccggcgcucugacgagcgggguccacacuuuuccugccgugcugcagucgucuggacucuauuccuuaucaaguguaguuaccgugccaagcuccucucugggcacacagacuuacauauguaaugucaaccauaaacccagcaauaccaagguggauaaaaagguggaaccuaaaucaugcgacaagacacacaccuguccaccgugccccgcgccugagcuuuugggugggccaagugucuuccuguuucccccuaagccaaaagauacgcuaaugaucuccagaacucccgaaguuacaugugugguaguggacgucagccaugaggauccggaggugaaguucaacugguauguugacggaguggaaguccacaaugcaaaaaccaagccuagggaggaacaauacaacucuacuuaucgggugguaucaguucucacagugcugcaucaggauuggcuuaauggcaaagaguacaagugcaaagucaguaacaaggcccugcccgcuccaauugaaaagaccaucagcaaagccaagggccagccucgcgagccccagguguauacguugccacccuccagagacgagcucaccaaaaaucaagucucucugacauguuuagugaagggguuuuacccuucggauauugcaguugaaugggagagcaacggacagccagaaaauaacuacaaaacuaccccgcccgugcuggacuccgacgguucauucuuucucuauaguaaacuuacaguagauaagucuagguggcagcagggcaaugucuucagcugcuccgugaugcacgaggcucugcacaaccauuacacucaaaagucauugagccuaucuccugggaag

SEQ ID NO: 23731 - RNA, 639 nt, Artificial Sequence
  derived and/or modified sequence opt3 from Siltuximab_LightChain1
cagaucgugcugauucaaagccccgccauaauguccgcuucuccuggcgagaaggucaccaugacaugcucagcaaguagcuccguuucuuacauguauugguaccagcagaaaccagggucgucaccgagacuccuuaucuaugacacuagcaaccuggccaguggagugcccguaagguucuccgguucuggcagcgggacguccuacucauugaccauuagucggauggaagcggaggaugcugccacauauuacugucagcaauggagcggauauccuuacacuuuuggcggugggaccaaguuagaaaucaaacgcacaguggcagccccaucugucuucauuuuucccccuuccgacgagcagcugaagucaggaaccgcuagcgugguuugccuacucaauaacuucuacccacgagaagcaaaagugcaguggaaggucgauaaugcccugcagaguggcaacucucaagaguccgugacugagcaggacagcaaggauucgacauauucucuuuccucaacccugacguugaguaaagcugacuacgaaaagcacaaaguauaugccugugagguuacucaucagggccucagcucccccgugaccaagucuuuuaaucguggggaaugc

SEQ ID NO: 23732 - RNA, 1329 nt, Artificial Sequence
  derived and/or modified sequence opt3 from Simtuzumab_HeavyChain1
caggugcaacugguccagagcggcgccgagguuaagaaacccggggcuuccgugaagguaucuugcaaagcaucaggauacgccuucaccuauuaccucaucgaaugggugagacaggcgccuggucagggccuugaguggauuggggucauaaacccaggaaguggcgguacaaauuauaacgaaaaguuuaaagggagggcuacuaucacggccgacaagagcaccuccacagcauacauggagcugucuucguugcggucagaagauacugccguguauuucugugcucgcaauuggaugaacuuugacuacuggggacaaggcaccacaguuaccgugagcagugcauccacuaagggcccgucugucuuccccuuagccccuugcagccgauccacaucagagaguaccgcugcccuggggugucuagugaaagauuauuuuccagagcccguaacgguuagcuggaacucuggagcgcucacuuccggugugcacaccuucccugcaguccugcagucaagcggccuuuacagucugucuuccguggugacagucccaagcucgucuuuggggacuaagaccuacacaugcaauguugaccauaaacccuccaauaccaagguggauaaacguguagaaucaaaguauggaccuccauguccgcccugcccugccccagaguuucucggcggucccaguguguuccuguuuccuccaaagcccaaagacacgcugaugauuagcagaacuccggaagucacaugugugguuguggaugucucccaggaggacccugaggugcaguucaacugguacguagaugggguugaagugcacaaugcuaagaccaaacccagggaggaacaauuuaacucuacuuaucgggucgugagcguccucacaguguuacaucaggacuggcugaauggaaaggaguacaaaugcaagguuucaaacaaaggccuuccaaguuccaucgaaaagaccauuagcaaggccaaaggccagccucgcgagccccagguguauacguugccacccucucaagaggaaaugaccaagaaucagguaucacugacaugucuagucaaaggguucuacccuagugauaucgcaguggagugggaaagcaacggacagccagagaauaacuauaagacuaccccgcccguucucgacuccgaugguagcuuuuuccuguacucgagacuuacaguggacaaaucuagguggcaagaaggcaacgucuucuccugcucagugaugcacgaggcucugcauaaucacuacacucagaagaguuugucucucagccuggggaag

SEQ ID NO: 23733 - RNA, 657 nt, Artificial Sequence
  derived and/or modified sequence opt3 from Simtuzumab_LightChain1
gacaucgugaugacccagacaccccugagccucuccgucacuccuggccaaccagccucuauuucaugcagaaguagcaagucccuucugcacucuaacgggaauacguacuuguauugguucuuacagaaaccgggacagucgccccaguuucugauauacaggaugucaaaccuagcuagcgguguuccugaucgguucaguggcuccgggucuggaaccgacuuuacacucaagaucagccgcguggaggcagaagauguaggcguguauuacuguaugcaacaucuggaguauccauacacuuucggugggggaaccaaagucgaaauuaagcgaacaguggccgcgcccuccguuuuuaucuucccuccaucagacgagcagcuuaaaaguggcaccgcuagcguggucugccuguugaauaacuuuuauccccgugaagccaaggugcaguggaagguagauaaugcacuccagucuggcaacucccaagagucaguuacugagcaggacagcaaagauaguacauacucucuguccagcacccugacgcucucgaaggccgacuacgaaaaacacaagguguaugcuugugaggucacucaucagggguuaucuuccccugugaccaaaucauucaauagaggagaaugc

SEQ ID NO: 23734 - RNA, 1347 nt, Artificial Sequence
  derived and/or modified sequence opt3 from Sirukumab_HeavyChain1
gaggugcagcuggucgaaagcggcgggggacucguucaacccgguggcucccuuagacugucuugcgccgcuucaggguucaccuuuaguccuuucgcaaugagcugggugaggcaggccccaggaaagggcuuggaguggguagcgaaaaucuccccgggugggucuuggacauacuauucggacacugugacgggacgguuuaccauuucacgcgauaacgcuaagaauagcuuauaccugcagaugaacagucuacgagccgaagacacagcagucuauuacugugcccgucagcucuggggcuauuacgcucuggauauauggggccaagggacuaccgugacaguuuccucugcaagcaccaaaggacccuccguguucccucuugccccaucaaguaagagcacuucugguggcacagcugcccuggggugcuuggucaaagacuauuuucccgagccugugaccguauccuggaacucaggagcgcucacgagcggcguucacacuuucccagcagugcugcagaguucuggucuguacucccucagcucggucgugaccgugcccucuuccucauuagggacacagacuuacaucuguaaugucaaucauaagccuaguaacaccaagguugauaaaaagguggaaccaaaaagcugcgacaagacacacaccuguccgcccugcccugccccagagcugcuuggaggccccuccguauuuuuguucccuccaaaacccaaggauacgcugaugauuucuagaacuccggaggugacaugugucgugguugacgugagccaugaagauccugaggucaaguuuaauugguauguggacggcguagaaguucacaacgcuaaaaccaagcccagggaggagcaguacaauucaacuuaucggguggucagugugcuaacaguccuccaucaagauuggcugaacgggaaagaauacaagugcaaaguguccaauaaggcccuuccagcaccuaucgagaaaaccauuagcaaggcuaagggacagccccgcgaaccacagguuuauacgcugcccccuucuagagacgaguugaccaaaaaccaggugucacucacaugucugguaaaggguuucuacccaagugauaucgccgucgaaugggagagcaauggccaaccggagaacaauuauaaaacuacacccccuguguuagacuccgacgggagcuuuuuccuguacucgaagcucaccguugauaaaucuagguggcagcagggaaacguguuuuccugcucagucaugcacgaagcgcuucacaaccauuacacucaaaagagucugucuuugagcccaggcaag

SEQ ID NO: 23735 - RNA, 639 nt, Artificial Sequence
  derived and/or modified sequence opt3 from Sirukumab_LightChain1
gagaucgugcugacccagagccccgccacacucucccuuucuccuggcgaaagagcuacucugucaugcagugcaagcauuuccgucucuuacauguauugguaccaacagaagccagggcaggccccgagguuguuaauauaugacaugucgaaccuggcgucaggaauccccgcucgguucagcgguaguggcuccgggacggauuuuacccuaacaauuucuagccucgagccugaagacuucgccguuuacuauuguaugcagugguccggauacccauauacuuuuggcggugggaccaaaguggagaucaagcgcacaguagcagcccccucaguguucauuuuuccuccaagugaugaacaacugaaaagcggaaccgcuucugucgugugccuucugaauaacuucuacccccgagaggcaaagguucaguggaaaguggacaaugccuugcaguccggcaacucacaggagagcgucacugaacaagauaguaaggacucuacauacucccucagcucgacccugacgcugucuaaggcugauuaugagaaacacaagguguacgccugugaaguaacucaucagggccucuccucaccuguuaccaaaaguuuuaaucguggggagugc

SEQ ID NO: 23736 - RNA, 1338 nt, Artificial Sequence
  derived and/or modified sequence opt3 from Sofituzumab_vedotin_HeavyChain1
gaggugcagcuggucgaaagcggcgggggacucguucaacccgguggcucccuuagacugucuugcgccgcuucaggguacaguaucaccaacgacuaugcauggaauugggugaggcaggccccuggaaagggcuuggaguggguagguuacauuagcuauuccggguacacaacuuauaacccaucuuuaaaaucgcgguucacgauaucacgcgauaccagcaagaauacacuguaccuacagaugaacagucuccgagcggaagacacugcuguguauuacugugcccguuggaccuccggacuggauuacuggggccagggcacacuugucaccgugucuagcgcauccacuaaagggccgucaguuuuuccccuggccccuaguagcaagucuacauccggagguaccgcugcauugggcugccucgugaaagacuauuucccagagcccgucacggugucauggaauagcggggcccugacaaguggaguacacaccuuuccugcuguucugcaaucuuccggccucuacagcuuaucgucuguggucacagugccauccucaagucuggguacucagaccuauaucuguaacgugaaucauaagcccagcaacacaaaggucgauaaaaagguugaaccuaaauccugcgacaagacccacacguguccaccgugccccgccccugagcuuuugggagggccaucuguguuccuguuucccccuaaaccaaaggauacucuaaugauuagcagaacacccgagguaaccuguguggucguggacguuucacaugaagauccggaggugaaguucaauugguacgucgacggcguggaaguacacaacgcgaaaacuaagccuagggaggagcaguauaauaguacauaccggguuguguccguccucaccgugcugcaucaggauuggcuuaacggcaaagaauauaagugcaaagucagcaauaaggcacugcccgccccaaucgagaaaacgauuucuaaggcuaaggggcaaccucgcgaaccccagguguacaccuugccacccucaagagaggaaaugacuaaaaaccagguuagucucacuugucuggugaagggauuuuacccuagcgacaucgccguagagugggaguccaauggucagccagaaaacaacuauaaaaccacaccgcccgucuuagauucugacggcucguucuuucuguacagcaagcucacuguggacaaauccagguggcaacaggggaauguuuucucaugcagugugaugcacgaggcacuucacaaccauuauacccagaagucucugagcuuguccccuggaaag

SEQ ID NO: 23737 - RNA, 642 nt, Artificial Sequence
  derived and/or modified sequence opt3 from Sofituzumab_vedotin_LightChain1
gacauccagaugacccaaagccccuccucucugucagccagugugggcgauagagucacaauuacuugcaaggcuagcgaccucauacacaacuggcuugcaugguaccagcagaaaccugggaaggccccaaaacuguugaucuauggagcgacguccuuagagaccgguguuccgucuagguucucgggcucagggagcggaacagauuuuacucugaccauuaguucccuacagcccgaagacuucgcuacauacuauugucaacaguacuggaccacuccuuuuacauucggccaggguaccaagguggagaucaaacggacgguagccgcaccaucuguguuuauuuuucccccuagcgaugaacagcucaaguccgggacugccucagucgugugccugcuuaauaacuucuauccacgcgaggcuaagguucaauggaaaguggacaaugcacugcagaguggaaacagccaggaaucugucaccgagcaggauuccaaggacucaacauacagcuugaguucuacucucacccuguccaaagccgauuaugagaagcauaaaguguacgcuugugaaguaacacaccaaggccugagcucgcccguuaccaagucuuucaaucgaggcgagugc

SEQ ID NO: 23738 - RNA, 1323 nt, Artificial Sequence
  derived and/or modified sequence opt3 from Solanezumab_HeavyChain1
gaggugcagcuggucgaaagcggcgggggacucguucaacccgguggcucccuuagacugucuugcgcugcuucaggguucaccuuuaguagguacagcauguccugggugcggcaggcaccuggaaagggcuuggaguuaguagcccagaucaacucuguggguaauucgacauauuacccagacacugucaaagggcgcuucacgauuucacgagauaacgcgaagaauacccuguaucuacagaugaacagccuccgugcugaagacacagccguguacuauugugcaaguggagauuacuggggccaaggcacucugguuaccguguccucugccagcacaaaagggccguccgucuuuccccuugcuccuucaaguaagagcaccucuggagguacugcagcccugggcugcuuggugaaagacuauuucccagagcccguaacaguuuccuggaauagcggggcucucaccagcggagugcacacguuuccugccguccugcagaguucuggccuguacucccucagcucgguggugacugucccaucuuccucauuagguacccagacauacauauguaacguuaaucauaagcccaguaacacuaagguggauaaaaagguagaaccuaaaagcugcgacaagacccacacauguccaccgugccccgcgccugagcugcuugggggaccauccguguucuuguuucccccuaaaccaaaggauacccugaugaucucuagaacgcccgaggucacuugugugguuguggacgucagccaugaagauccggaggugaaguucaauugguauguagacggcguugaagugcacaacgcaaaaacaaagccuagggaggagcaguacaauucaaccuaucgggucgugaguguccuaacugugcuccaucaagauuggcugaacggcaaagaauacaagugcaaaguuuccaauaaggcccuucccgcuccaauugagaaaacaaucagcaaggccaaggggcagccucgcgaaccccagguguauacccugccacccucuagagacgaguugacgaaaaaccagguaucacucaccugucuggucaagggauuuuacccuagugauauugcaguggaaugggagagcaauggucaaccagagaacaacuauaaaacaacuccgcccguuuuagacuccgacggcucuuucuuucuguacucgaagcucaccguggauaaaucaagguggcagcaggggaaugucuucuccugcucagugaugcacgaagcccuucacaaccauuacacacaaaagagucugucuuugagcccugga

SEQ ID NO: 23739 - RNA, 1326 nt, Artificial Sequence
  derived and/or modified sequence opt3 from Solanezumab_HeavyChain
gaggugcagcuggucgaaagcggcgggggacucguucaacccgguggcucccuuagacugucuugcgcugcuucaggguucaccuuuaguagguacagcauguccugggugcggcaggcaccuggaaagggcuuggaguuaguagcccagaucaacucuguggguaauucgacauauuacccagacacugucaaagggcgcuucacgauuucacgagauaacgcgaagaauacccuguaucuacagaugaacagccuccgugcugaagacacagccguguacuauugugcaaguggagauuacuggggccaaggcacucugguuaccguguccucugccagcacaaaagggccguccgucuuuccccuugcuccuucaaguaagagcaccucuggagguacugcagcccugggcugcuuggugaaagacuauuucccagagcccguaacaguuuccuggaauagcggggcucucaccagcggagugcacacguuuccugccguccugcagaguucuggccuguacucccucagcucgguggugacugucccaucuuccucauuagguacccagacauacauauguaacguuaaucauaagcccaguaacacuaagguggauaaaaagguagaaccuaaaagcugcgacaagacccacacauguccaccgugccccgcgccugagcugcuugggggaccauccguguucuuguuucccccuaaaccaaaggauacccugaugaucucuagaacgcccgaggucacuugugugguuguggacgucagccaugaagauccggaggugaaguucaauugguauguagacggcguugaagugcacaacgcaaaaacaaagccuagggaggagcaguacaauucaaccuaucgggucgugaguguccuaacugugcuccaucaagauuggcugaacggcaaagaauacaagugcaaaguuuccaauaaggcccuucccgcuccaauugagaaaacaaucagcaaggccaaggggcagccucgcgaaccccagguguauacccugccacccucuagagacgaguugacgaaaaaccagguaucacucaccugucuggucaagggauuuuacccuagugauauugcaguggaaugggagagcaauggucaaccagagaacaacuauaaaacaacuccgcccguuuuagacuccgacggcucuuucuuucuguacucgaagcucaccguggauaaaucaagguggcagcaggggaaugucuucuccugcucagugaugcacgaagcccuucacaaccauuacacacaaaagagucugucuuugagcccuggaaag

SEQ ID NO: 23740 - RNA, 657 nt, Artificial Sequence
  derived and/or modified sequence opt3 from Solanezumab_LightChain1
gacguggucaugacccagagcccccugucccucccuguuacacuuggccaaccagccucuaucucaugcaggaguagccagucccugauuuacucugaugggaacgcuuauuugcacugguucuuacagaaaccgggacagucgcccaggcugcuaauauacaaagugucaaaucgguuuagcgguguaccugaccgcuucaguggcuccgggucuggaacugauuuuacgcucaagaucagccgaguggaggcagaagacgucggcguguauuacuguucccaaucaacccauguuccauggacauucggucaggggacuaaaguggagauuaagcguaccgucgccgcgcccaguguguuuaucuucccuccaagcgaugaacagcugaaaucuggaacagcuuccguaguuugccuucugaacaauuuuuaucccagagaggccaaggugcaguggaaggucgacaacgcauugcaaucaggcaauagccaggaaagugugaccgagcaggauucuaaagacuccacuuacagccucucgucuacacugacccuguccaaggccgauuaugagaaacacaagguguacgcuugugaagucacgcaucagggccucucaaguccuguuacuaagagcuucaacagaggggagugc

SEQ ID NO: 23741 - RNA, 1506 nt, Artificial Sequence
  derived and/or modified sequence opt3 from Solitomab_HeavyChain1
gagcuggugaugacccagagccccuccucucucacagucacugccggcgaaaagguuacgaugucaugcaaaaguagccaaucccuucugaacucugggaaucagaagaacuacuugaccugguaucagcagaaaccuggacaaccaccgaaguuacugaucuacugggcuucgacaagagagucaggugugcccgacagguucacuggcagcgggaguggaaccgauuuuacacuaaccauuuccucuguacaggcagaagaccucgccguguauuacugucagaaugauuauagcuacccucugacuuucggcgcggguacaaaacuugagauaaaagggggaggcggcuccgggggagguggcucagggggaggcgguagugaaguccagcuguuggagcaaagcggggcugagcucgugcggccaggaaccucuguuaagaucuccugcaaggccucaggcuaugcauuuacgaacuacuggcugggcugggugaagcagcgccccgggcacggacuggaauggauuggugacaucuucccuggcagcgggaauauucauuacaacgagaaauuuaagggaaaagccacucucaccgcugauaagaguucuuccacagcauauaugcaguuaagcucgcugacuuucgaagacucugccgucuacuuuugugcucgacuucguaauugggaugagccaauggacuauuggggccaggguaccacagugaccguauccucagggggcggaggcagugauguucaauuggugcagagcggggccgaggucaagaaacccggagcguccgugaaggugucuugcaaagcaagcgguuacacguucacuagauauacaaugcacugggucaggcaggccccuggccaagggcuggaauggaucggauacauaaacccaucacggggcuauaccaauuacgcugacaguguuaagggucgcuuuacuaucacaaccgauaaauccacgagcaccgccuacauggagcuaucuucacucagaagugaagacacagcaacuuauuacugugcuagguauuacgaugaccauuauugccuggacuacugggggcagggcaccacagugacuguaagcuccggagagggcaccucuacagggucgggagguagcggcggguccggaggcgccgaugacauugugcuuacccagucaccggcgacucugaguuugucucccggugaacgggccacgcucagcugucgcgcaucccagucagucagcuauaugaacugguaccaacagaagccugggaaagcuccaaagcgauggaucuacgauacaucuaagguggccuccggcguucccgcuagauucaguggaagcggcucugggaccgacuauucccugacuauuaauucauuagaggccgaggaugcagccaccuacuauugccagcaguggaguagcaacccucugacauuuggaggcgguaccaaaguggaaaucaagcaccaucaccaccaucac

SEQ ID NO: 23742 - RNA, 1506 nt, Artificial Sequence; identical to SEQ ID NO: 23741
  derived and/or modified sequence opt3 from Solitomab_SingleChain

SEQ ID NO: 23743 - RNA, 702 nt, Artificial Sequence
  derived and/or modified sequence opt3 from Sonepcizumab_LightChain_Precursor
augagcgugcccacccagguccugggccuccuucuguugugguuaacagacgccagaugcgagacuacgguuacccaauccccuucuuuccugucagcuagugugggggauaggguaacaaucacuuguauuaccacaaccgacauagaugacgauaugaacugguuucagcaggaaccaggaaaggcaccgaaacuacucaucagcgaggguaauauucugcggcccggcgugccuucccgcuucucuucgucaggguacggaacugacuuuacacuuaccaucagcaagcugcagccagaagauuucgccacguauuacugcuugcaaagugacaaccuccccuuuacuuucggccaggguaccaaacuggagauuaagcgaacagucgcggcuccuuccguguuuaucuucccacccucugaugaacagcugaaaagcgggacugccuccguugugugucucuuaaauaacuuuuauccucgugaggcaaagguccaguggaagguggacaaugcccugcaaucaggaaacagucaggagagcguaaccgaacaggauucuaaagacuccacauacucacuuagcaguaccuugacgcugucuaaggcugauuaugagaaacacaagguuuacgcaugcgaagugacucaucagggccuauccagcccagucacaaaaucguucaauagaggcgagugu

SEQ ID NO: 23744 - RNA, 1365 nt, Artificial Sequence
  derived and/or modified sequence opt3 from Sonepcizumab_gamma1-Chain_Precursor
auggaguggagcuggguguuccuguuuuuccucuccgucaccacaggcguucacucugaagugcagcuuguacaaucaggggccgaggugaagaaacccggagaaagucugaagaucagcugccaguccuuugguuacauuuucauagaccauacuauccacuggaugagacagaugccuggccagggguuggaguggaugggagcuauuucuccaaggcaugauaucacgaaauauaacgaaauguuucggggccaagucaccauuucggcagacaagucaagcaguacagccuacuuacagugguccucucugaaagcgagcgauacugcuauguauuucugugcccgcgguggguuuuacggauccaccaucugguucgacuuuuggggccagggcacaauggugaccguuucaagugcaagcacuaaggggccgucuguguucccccuagccccuuccucaaagagcacaaguggagguaccgcugcacucggcugccuggucaaagauuauuuuccagagcccgugacgguaucuuggaacuccggggcccuuacuagcggaguucacaccuucccugcugugcugcagucgucuggcuuguacucccucucaagugucgugacagugccaagcuccucucuggguacucaaaccuauauauguaaugucaaucauaagcccagcaacacaaaaguugacaagcgaguggccccugagcugcucgggggaccaucaguauuuuuauucccgcccaaaccuaaggauacccugaugaucagucguacgccagaagugacuugcgucgugguugacgugucccacgaggaucccgaagucaaguucaauugguacguggacggcguagagguucacaacgcgaaaacaaagccuagagaggaacaguacaauagcaccuauaggguggucucugugcuuacugucuugcaucaggauuggcugaacggcaaagaguacaaguguaaagugucaaauaaggcacuaccagcccccauugagaaaacaaucaguaaggcuaaggggcagccgcgggaaccucaaguuuauacccucccacccagccgcgaagagaugacgaaaaaccaggugucccugaccugccuuguaaagggauuuuacccuucugacauugccgucgagugggaaucgaauggucagcccgagaacaauuauaaaacaacuccacccgugcuggauagcgacggcuccuucuuuuuguacucaaagcucaccguugacaaaaguagauggcaacaggggaacguguucucuuguagcgucaugcacgaagcacugcauaaucacuauacacagaaguccuuaucacugagcccuggaaag

SEQ ID NO: 23745 - RNA, 1338 nt, Artificial Sequence
  derived and/or modified sequence opt3 from Stamulumab_HeavyChain1
gugcagcugguccaaagcggcgccgagguuaagaaacccggggcuuccgugaagguaucuugcaaagcaucaggauacaccuucacaaguuauuacaugcacugggugagacaggccccuggucagggccucgaauggauggggaucauuaacccaagcggaggcuccacuucuuaugcgcagaaguuucaagguagggucacgaugacccgggacacaucgacuucaaccguguacauggagcuuagcagucugcgcuccgaagauacagcuguuuauuacugugcccgagacgagaauuggggguucgauccguggggacagggcaccuuggugacugucucuagcgcauccacaaaaggccccucaguguuuccuuuagccccaaguagcaagucuaccuccgggggaacggcugcacuggguugccuaguaaaggacuauuuccccgaaccuguuacugugucauggaacagcggcgcccucaccagugggguccauacauuuccagcugugcugcagucuuccggacuuuacagccugucgucuguggucacuguucccuccucaaguuugggcacccagacauacauauguaaugugaaccacaaaccuagcaauaccaagguagauaaaaagguggagccaaaauccugcgacaagacgcauacuuguccgcccugcccugccccagagcuccugggugggcccucugucuuccuguuuccuccaaagcccaaagauacacucaugaucagccguaccccggaagugacuuguguuguggucgacgugucacacgaggauccugaaguaaaguucaacugguauguugacggaguggagguccauaaugcgaaaacaaagcccagagaggaacaauacaacaguaccuauaggguggucuccguguuaacgguucugcaccaggauuggcuuaauggcaaagaguacaagugcaaagugagcaacaaggcauugccagccccuauugaaaagaccaucucuaaagcuaagggccagccccgggagccacagguauauacacugcccccuucacgcgaagagaugacuaaaaaucaagucagucuaaccugucucgugaagggguuuuacccaagcgacauugccguugagugggaauccaacggacagccggagaauaacuauaaaacaacucccccugugcuggauucugacgguucguucuuucuuuacagcaagcugaccgucgacaaguccagauggcagcaaggcaauguguucucaugcaguguaaugcacgaagcauugcauaaccacuacacacagaaaucucucagccuguccccagggaag

SEQ ID NO: 23746 - RNA, 633 nt, Artificial Sequence
  derived and/or modified sequence opt3 from Stamulumab_LightChain1
agcuacgagcugacccagcccccuuccgugucugucucaccaggccaaacagccaguaucacuugcagcgggcacgcucucggagacaaguucguuuccugguaucagcagaaaccgggucagucucccgugcuuguaauuuacgaugacacgcaaagaccuucgggcauaccagaaagguuuucagggagcaacaguggaaauaccgcaacacugacuaucuccggcacccaggccauggaugaggcggacuauuacugucaggcuugggauucuagcuucguguuuggugggggaacaaaggucaccguguugggccagcccaaagccgcaccuuccguuacuuuauucccacccucaagugaggaacugcaagccaacaaggcuacccuagugugccucauuagcgacuuuuauccuggcgcagucacaguggccuggaaagcugauucuuccccaguaaaggccgggguugaaacgacuaccccgucaaagcagagcaauaacaaauacgcggcaaguucuuaucugucccuuacacccgagcaguggaaaagccaucggucguacucuugucaggugacucacgagggauccaccgucgaaaagacaguggccccuaccgagugcuca

SEQ ID NO: 23747 - RNA, 1356 nt, Artificial Sequence
  derived and/or modified sequence opt3 from Suptavumab_HeavyChain1
gaggugcagcuggucgaaagcggcggggaccucguucaacccggaagaucccuuaggcugucuugcguggcuucagguuucaccuuugaugacuacgcuaugcacuggguacggcaggcaccuggcaagggguuggagugggugaguggagucagcugguccggcucuacaguggguuaugccgauucgguuaaagggcgcuucacugugucacgagacaacgcgcaaaagagcuuauaccugcagaugaauagucuacgugcugaagauacggcccucuauuacugugucaaagacgcauauaaguuuaacuacuauuacuacggacuggauguguggggccaaggcaccacaguaacuguuuccucugccagcaccaaagggccauccguguucccgcuugcucccucaaguaagagcacaucuggagguaccgcagcccugggcugcuuggucaaggacuauuuuccugagccagugacuguguccuggaacucaggggcucucacaagcggaguccauaccuuccccgccguucugcagaguucuggccuguacucccucagcucggugguaacggugccuucuuccucauuagguacucagaccuauaucuguaaugucaaucacaaaccaaguaacacaaagguggauaaaaagguugaacccaaaagcugcgacaagacucauaccuguccuccaugcccggcgcccgagcugcuugggggaccuuccguguuuuuguucccacccaagccuaaagauacacugaugauuucuagaaccccagaggucacgugugugguaguugacgugagccacgaagaucccgaggucaaguuuaauugguacguggacggcgucgaagugcauaacgcaaaaacuaagccgagggaggagcaguauaauucaacauaccggguugugaguguacuaaccguccuccaccaagacuggcugaacggcaaagaauauaagugcaaaguguccaauaaggcccuuccugcucccauagagaagacuaucagcaaagccaaggggcagccacgcgaaccucagguuuacacacugcccccaucuagagaugaguugaccaaaaaccaggugucacucacgugucuggucaagggauucuaccccagugacauugcaguggaaugggagagcaauggucaaccugagaacaauuauaaaaccacaccaccgguauuagauuccgacggcagcuuuuuccuguacucgaagcucacuguggauaagucuagguggcagcaggggaacgucuuuuccugcucaguuaugcacgaagcccuucauaaccacuauacccagaaaagucugucuuugagccccgga

SEQ ID NO: 23748 - RNA, 642 nt, Artificial Sequence
  derived and/or modified sequence opt3 from Suptavumab_LightChain1
gagaucgugaugacccagagccccgccacacuguccgucucuccuggcgaaagggcuacucucucaugcagggcaagucaaacgauucuuagcaaccuggccugguacuugcagaagccagggcaggcgccgcgguuacugauauauggagcuuccacccgcgccacaggucuacccgcacgauucucuggcucggggucaggaacugaguuuacccucacaaucagcagucugcaguccgaagacuucgccguuuacuauugucaacaguacaauaacuggccucuuaccuuuggcggugggacuaaaguggagauuaagcguacaguagcugcaccaucuguguucaucuuucccccuagcgaugaacagcugaaauccggaaccgccucagucgugugcuugcucaauaacuucuauccaagagaggcuaagguucaguggaaaguggacaaugcccugcaaaguggcaacagccaggagucugucacggaacaggauuccaaggacucaacuuacagccugaguucuacccucacauuauccaaggcggauuaugagaaacacaagguguacgcaugugaaguaacucaucagggccugagcucgcccguuaccaaaucuuuuaauagaggggagugc

SEQ ID NO: 23749 - RNA, 1344 nt, Artificial Sequence
  derived and/or modified sequence opt3 from Suvizumab_HeavyChain1
caggugcaacugguccagagcggcgccgagguuaagaaacccggggcuuccgugaagguaucuugcaaagcaucaggauacaccuucacaaacaguuggaucgguugguuuagacaggccccuggccaggggcucgaauggauuggagacauauauccaggcgguggguacacuaauuauaacgagaucuucaagggaaaagcgacgaugaccgcugauacaagcacuaauaccgccuacauggaacuuuccucucugaggucggaggacacagcaguguauuacuguucacggggcauuccgggcuaugccauggauuacugggggcaaggaaccuuggucacugugagcagugcuuccacaaagggucccucuguuuuuccuuuagcaccaagcuccaagucaaccaguggcgggacggccgcucugggaugccuagugaaagacuacuuccccgaaccugucacugugagcuggaacucuggcgcccucaccuccgguguacacacauuuccagcgguucugcagucaagcgggcuuuauagucugucuuccguggucacugugcccagcucgucuuugggaacccagacauacaucuguaaugugaaccauaagccuuccaauaccaaagucgauaagaaaguugagccaaagucaugcgacaagacgcacacuuguccgcccugcccugcaccagagcuccugggcggccccaguguguuccuguuuccuccaaaacccaaggauacacucaugauuagccgcaccccggaaguaacuuguguggucguggacguuucccaugaggauccugaagugaaauucaacugguaugucgacgggguggagguacacaaugccaagacaaaaccccgagaggaacaguacaacucuaccuaucguguugugagcgucuuaacggugcugcaucaagauuggcuuaauggaaaggaguacaaaugcaaggucucaaacaaggcuuugccagccccuaucgagaaaaccauaaguaaggcaaaaggucagcccagagaaccacagguguauacacugcccccuuccagggacgaacuaacuaagaaucagguuagccucaccugucuggugaaaggcuuuuacccaucugauaucgcuguagagugggagucaaacgggcaaccggaaaauaacuacaagacaacucccccuguccuugacagugacggcagcuucuuucuguauuccaaguugaccguggauaaaucucgguggcagcagggaaacguuuucucgugcagcgugaugcacgaggcccuccacaaucauuacacacaaaagucccugucauuaaguccagguaaa

SEQ ID NO: 23750 - RNA, 660 nt, Artificial Sequence
  derived and/or modified sequence opt3 from Suvizumab_LightChain1
gacauccagaugacccaaagacccgauagccuguccgccucugugggcgacagggucacaaugucaugcaagaguagccagucccuccuuaacucuggggaucagaaaaauuaccugacuugguaucagcaaaagccuggacagccaccgaaauuguuaauuuacugggcuucgacgggugagucaggcguucccgaccgguucagcgggaguggauccggcaccgauuuuacauucacuauaucuagccugcagccugaagacaucgcaaccuauuacugucagaacgauuauuccuacccauggacauuuggucaagggaccaagguggagauuaaacgcacuguagccgcgcccucaguguucaucuuuccuccaagugacgaacagcuaaagagcggaacagcuucugucgugugccuccugaauaacuucuauccccgagaggccaagguucaguggaaaguggauaaugcacuucaguccggcaacucacaagaaagcgucaccgagcaggacaguaaggauucuacguacucccugagcucgacuuugacccucucuaaagccgacuacgagaagcacaaaguguaugcuugugaaguaacacaucagggccuguccucaccuguuacuaagaguuuuaaucguggggagugc

SEQ ID NO: 23751 - RNA, 1350 nt, Artificial Sequence
  derived and/or modified sequence opt3 from Tabalumab_HeavyChain1
caggugcaacugcagcaguggggcgccgggcuccuuaagcccagcgagacccuguccuugacaugcgcugucuacggagguucuuucucaggcuauuacuggaguuggaucagacagccuccagggaaaggauuagaauggauuggcgagauaaaccacagcgguuccacuaauuauaacccgucucugaagucgaggguuacgaucucaguggacaccagcaaaaaucaauuuagucuaaagcucuccucuguaacagcagccgauacugcgguguacuauugugcucggggguacuaugacauucugaccggauacuacuauuacuucgauuauuggggccagggcacacuugucaccgugagcuccgccucaacuaaagggcccaguguuuuuccucuggcaccaugcagccgcucuacauccgaaucaaccgccgcuuugggaugucucgugaaggacuacuuccccgagccugucacggugagcuggaacaguggugcacugacuucuggcguacauaccuuuccagccguucugcaguccagcgggcucuauucguuaucuuccguggucacagugcccucaaguagccugggaacuaagaccuacacaugcaauguggaucacaaaccuuccaacaccaaggucgacaaacgaguugaaucuaaguauggcccaccgugucccccuugcccagcucccgaguuccuuggugggccuagcguguuuuuguucccacccaaaccgaaggauacgcugaugaucucacguacuccugagguaacauguguggucguggacguuagucaggaagaucccgaggugcaauuuaauugguacgucgacggaguggaaguacauaacgccaagaccaaaccaagagaggagcaguucaauuccacuuacaggguugugagcguccuaacagugcuccaccaggauuggcugaacggcaaggaauauaaaugcaaggucucuaauaaaggccuuccuucaaguauugagaagaccaucagcaaagcgaaggggcagccccgggaaccacaaguguacacgcugcccccuucccaggaggaaaugaccaagaaccagguuucuuugacaugucucgugaaaggauuuuauccaucggacauagcaguagagugggagagcaauggucaaccggaaaacaauuacaagacuacacccccuguccuggauuccgacggcucauucuuuuuauauagucgccugaccguggacaaaucuagauggcaggaggggaacguuuucagcugcuccgugaugcaugaagcccuccacaaccacuacacucagaagucacuuagccugucuuugggaaaa

SEQ ID NO: 23752 - RNA, 642 nt, Artificial Sequence
  derived and/or modified sequence opt3 from Tabalumab_LightChain1
gagaucgugcugacccagagccccgccacacucucccuuucuccuggcgaaagagcuacucugucaugcagggcaagucaaagcgucucccgguacuuggccugguaucagcagaagccagggcaggcgccgcgcuuacugauuuacgacgcuucuaaccgagccacgggaauacccgcacguuucucggguucaggcagcgggaccgauaguacacuaacuaucuccucucucgagccugaagacuuugccguuuauuacugucaacagagaagcaauuggccaaggaccuucggacagggcacaaaaguggagauuaagcggaccguagcugcacccuccguguuuaucuucccuccaucagaugaacagcugaaaagugguacugccagcgucgugugccuucugaacaauuuuuauccccgcgaggcuaagguucaauggaaaguggacaacgccuugcagucuggaaauucccaggagucagucacagaacaggauagcaaggacaguaccuacucucucuccaacacgcugacucugagcaaggcggauuaugagaaacacaagguguacgcaugugaaguaacccaucaagggcucucgucuccuguuacaaaauccuucaauagaggcgagugc

SEQ ID NO: 23753 - RNA, 1332 nt, Artificial Sequence
  derived and/or modified sequence opt3 from Tacatuzuab_HeavyChain1
caggugcaacugcagcagagcggcgccgaggucaagaaacccggguccucuguuaaggugucaugcaaagcuaguggauacgcauucaccagcuauguaauccacugggugagacaggccccuggucaaggccucuacuggauuggguauauacauccauacaacggaggcacaaaguauaaugaaaaauuuaaggguaaggcgacuaucacggcugacgaguccaccaacacagccuacgaacuuucuucgcugaggucagaggauacugcauucuauuuuugugcccggagcgggggaggcgacccguucgcuuacuggggccaggggaguuuggucaccguguccucugcaagcacaaaaggacccuccguuuuuccuuuagccccaucaaguaagagcaccucugguggcacugcugcccuggggugccuagugaaagauuacuuccccgaaccugucacaguguccuggaacucaggagcgcucaccagcggcguacacacguuuccagcaguucugcagaguucuggucuuuauucccugagcucgguggucacugugcccucuuccucauuggggacccagacauacauuuguaaugugaaucauaagccuaguaacacuaaagucgacaagcgcguugagccaaagagcugcgauaaaacccacacauguccgcccugcccugccccagagcuccugggaggccccuccguguuccuguuuccuccaaagcccaaagacacccucaucucucgaacgccggaaguaacuuguguggucguggauguuagccaugaggacccugaagugaaguucaauugguaugucgauggcguggagguacacaacgcuaaaacaaagccccgugaggaacaauacaauucaaccuauagaguugugagugucuuaacugugcugcaccaggacuggcuuaacgggaaagaguacaagugcaaggucuccaauaaagccuugccagcaccuauugaaaagacaaucagcaaagcuaagggacagcccagggagccacagguguauacccugcccccuucucgggaagagacgaaaaaccaaguuucacuaaccugucucgugaaggguuuuuacccaagugauauagccguagagugggaaagcaauggccagccggagaacaauuacaagacaacucccccuguccuggacuccgaugggucuuucuuucuuuauucgaaacugaccguggacaagagccgcuggcagcaaggaaacguuuucuccugcucagugcaugaagcguugcacaaccauuacacacagaaaagucucucucugagcccaggcaag

SEQ ID NO: 23754 - RNA, 636 nt, Artificial Sequence
  derived and/or modified sequence opt3 from Tacatuzuab_LightChain1
gacauccagcugacccaaagccccuccucucucucagccagugugggcgauagagucacaauuacuugcaaggcuagccaggacauaaacaaauacaucgggugguaucagcagaagccuggaaaagcaccaaaacuucugcacuacacguccgccuuguuaccggguauucccucuagguucucgggcucagggagcggacgggauuauaccuuuacaaucaguucccugcaaccugaggacauugcgacuuacuauugucuacaguacgaugaccucuggaccuucggcggugggacaaagcugcagaucaagcgcaccguugcugccccaucuguguuuauauuucccccuagcgaugaacagcuuaaguccggaacugcaucaguagugugccuguugaauaacuucuauccacgagaggccaaaguccaauggaagguggacaaugcucuccagaguggcaacagccaggaaucuguuacagagcaggauuccaaagacucaaccuacagccugaguucuacgcugacucucuccaaggcagauuacgaaaaacauaagguguaugccugugaggucacccaccaaggcuuaagcucgcccgugacaaagucuuucaaucguggggagugc

SEQ ID NO: 23755 - RNA, 678 nt, Artificial Sequence
  derived and/or modified sequence opt3 from Tadocizumab_fab_fragment_HeavyChain
caggugcaacugguccagagcggcgccgagguuaagaaacccggguccucugugaagguaucaugcaaagcuaguggauacgcauucaccaacuaucucaucgaaugggugagacaggccccuggucagggccuugaguggauuggggucauauacccaggaagcggcgguacaaauuauaacgaaaaguuuaaagggagggugacucugacgguugacgaguccaccaauacagcguacauggaauugucuucguuacggucagaggauacugcuguguauuucugugcccgccgagacggaaacuacggcugguuugcauauuggggccaagggacccuggucacagugagcagugccuccaccaagggaccgucuguauucccccuagcuccuagcuccaagucaacuucugguggcacagcagcccucgggugccugguuaaagauuacuuuccagagcccgugaccgucagcuggaauaguggagcucuuacguccggcgugcacacuuucccugccgugcugcagucaagcgguuuguacagucucucuuccgucguuaccgugccaagcucgucucuggggacacagacuuauaucuguaacguaaaucauaagcccuccaacaccaaaguggacaagaaagucgaaccuaagucaugcgauaagacacac

SEQ ID NO: 23756 - RNA, 582 nt, Artificial Sequence
  derived and/or modified sequence opt3 from Tadocizumab_fab_fragment_LightChain
gacauccagaugacccaaacacccagcacucuguccgccucugugggcgauagagucacgauuucaugcagggcuagucaggacauaaacaauuaccucaacugguaucagcagaagccugggaaagcaccaaaacuucugaucuacuauaccagcacauugcacuccggaguuccgucucgguucucggguucaggcagcgggacugauuacaccuuaacaauuaguucccugcaacccgacgauuuugccaccuauuucugucagcagggaaauacucuaccuuggacauuuggccaggguaccaaaguggagguaaagcgcacgguggcggcuccaucugucuucaucuuucccccuagcgacgaacaacucaaauccgggacugccucagugguuugccugcuuaacaauuucuacgagagugugaccgaacaggauagcaaggacucuacauauucccugucaagcacuuugacccucaguaaggcagauuacgagaaacauaaggucuacgccugugaagugacacaccagggacugucuuccccaguaaccaagagcuuuaaccgaggcgagugc

SEQ ID NO: 23757 - RNA, 1359 nt, Artificial Sequence
  derived and/or modified sequence opt3 from Talizumab_HeavyChain1
caggugcaacugguccagagcggcgccgagguuaagaaacccggggcuuccgugaagguaucuugcaaagcaucaggauacaccuucaguauguauuggcucgaaugggugagacaggccccuggucacggccuugagugggucggggaaaucagcccaggaacauuuacuacgaacuacaaugagaaguucaaagcgagggcuaccuuuacagccgacacuuccaccaacacagcauauauggaacugucuucguugcggucagaggauaccgccguguacuauugugcucgcuucagccauuuuaguggcuccaauuacgacuauuucgauuacuggggucaggggacuuuaguuacagugucuagcgcauccaccaagggaccgucagucuuuccccuggccccuaguagcaagucuacguccggcggcacugcugcccuagggugccucgugaaagacuacuucccagagcccguaaccguuucauggaacagcggagcgcugacaaguggugugcacacuuuuccugcaguccuucaaucuuccggccuguauagcuugucgucuguggugaccgucccauccucaagucucgggacacagaccuacauuuguaauguuaaccauaagcccagcaauacgaaaguggauaagaaaguagaaccuaaguccugcgacaagacucacacauguccaccgugccccgccccugagcugcugggaggcccaucuguguuccucuuucccccuaaaccaaaggauaccuuaaugauaagccgaacucccgaagucacaugugugguuguggacgucucacaugaggauccggaggugaaauucaacugguauguagacgguguugaagugcacaaugcuaagaccaaaccucgugaggaacaguacaacaguacguauagagucguguccguccugaccgugcuucaccaggauugguugaaugggaaggaguacaaaugcaagguuagcaacaaggcccugcccgcaccaaucgagaaaacaauuucuaaggcuaaaggacaaccuagggaaccccagguguauacucuaccacccucacgggacgagcucaccaagaaucagguaagucugacaugucuugucaaaggcuuuuacccuagcgauaucgccguggaaugggaguccaacggccagccagaaaauaacuacaagacuaccccgcccguucuggacucugacgggucguucuucuuguauagcaagcucacaguggauaaaucccgcuggcaacagggaaacgucuuuucaugcagugugaugcaugaggcgcugcacaaucauuacacccagaagucuuuaagccuguccccugguaaa

SEQ ID NO: 23758 - RNA, 642 nt, Artificial Sequence
  derived and/or modified sequence opt3 from Talizumab_LightChain1
gacauccugcucacccagagccccggcacacuuucccugucuccuggggagagggccacuuugucaugcagggcuagucaaagcauuggaacgaacauacacugguaccagcagaagccaggucaggcaccgcgguuacugaucaaauaugccuccgaaucuauuucgggcauccccucacgcuucagcgggaguggauccggcaccgauuuuacacuaacuauuucucgacucgagccugaagacuucgcgauguacuauugucaacagagcgauuccuggccaaccacauuuggucaggggaccaagguggagaucaaacguacugucgcugcccccucaguuuucauauuuccuccaagugacgaacagcuuaagagcggaacagcaucugugguaugccugcugaauaacuucuaccccagagaggccaaagugcaauggaaggucgauaaugcuuugcaguccggcaacucacaggagagcgugaccgaacaggacaguaaggauucuacguauucccucagcucgacucugacccugucuaaagcagacuacgagaagcauaaaguuuaugccugugaagugacacaccaaggccucuccucaccugucacuaagaguuuuaauagaggggagugc

SEQ ID NO: 23759 - RNA, 1368 nt, Artificial Sequence
  derived and/or modified sequence opt3 from Tamtuvetmab_HeavyChain1
gaggugaagcugcucgaaagcggcgggggacuuguccagcccgguggcuccaugagacugucuugcgccgggucaggauucaccuuuacagacuucuacaugaacuggaucaggcaaccugcuggcaaagcaccagagugguuggguuuuauucgggauaaggccaaaggguauacuacggaauacaauccgaguguuaagggacgcuucaccauaagccgagacaacacacagaauauguuauaucugcagaugaacacucuacgugcggaggauaccgcuacauacuauugugccagagaaggccacaccgcagcccccuuugacuacuggggccaggggacucucgugacaguauccucugcuucgaccacggcaccuucaguguucccacuggcccccagcugcggaaguacuuccgguucuaccgucgcucuugccugucuggugagcggcuauuuuccugagccaguuacaguguccuggaacucagggaguuugacuagcggaguccauaccuuccccucugugcuccaauccucaggccuguacagccugaguucuaugguaacaguuccuuccucaagguggccaucggagaccuuuacgugcaauguggcgcacccggcaucuaaaacuaaggucgauaagcccgugccuaaacgggaaaauggucgcgugccaagacccccugacuguccaaagugccccgccccggagaugcucgggggaccuuccgucuucaucuuucccccaaaaccuaaggauacauuacugauugcuaggacccccgaaguuacuugugugguaguggaccuugauccagaggaccccgagguccagaucucaugguucguggauggcaaacagaugcagacagccaagacccaaccucgggaggaacaguuuaacggcacguaccgcguugugagugucuugccaauugggcaucaggacuggcugaagggaaaacaguuuaccugcaaggugaauaacaaagcacuaccgagccccaucgaacgaacaauauccaaggcuagaggucaagcccaccagccuucuguauauguucucccacccagcagggaggaacugagcaaaaauacugugagucuuaccugucugaucaaggauuucuucccuccagacauugacgucgaguggcaguccaacggccaacaggagcccgaaagcaaauaccggacaacuccgccucaguuggaugaggacgggucuuauuuccucuacucaaagcugaguguggauaagagccguuggcagcgcggagacaccuuuaucugcgcggucaugcaugaagccuuacacaaucacuauacacaaaaaucccugucucauucgccaggcaag

SEQ ID NO: 23760 - RNA, 639 nt, Artificial Sequence
  derived and/or modified sequence opt3 from Tamtuvetmab_LightChain1
gacaucaagaugacccagagccccuccuuccugucugccucagugggcgauagagucacacucaacugcaaagcuagucaaaauauugacaaguaccuuaacugguaucagcagaaacugggggagagcccuaaguuguuaauauacaauacuaacaaucugcagacgggaaucccauccagguuuucugguucgggcucagggaccgauuucacacuaacuauuagcagucuccaaccggaagacguugcaaccuauuuuugucugcagcacaucucccggccccgcacauucggaggcgguacccaucuuacugugcuggggcagccuaaagccucuccaagcguaacauuguuucccccuuccucagaggaacucggagcgaacaaggcuacccuggugugccugauuagugauuucuacccaagcggcgucacgguggccuggaaggcagacggcucucccaucacucaggggguugagaccacaaaaccuuccaagcaaucaaauaacaaauaugccgcuagcaguuaccucucuuuaacuccagauaaguggaaaucccacagcucguuuucuugucuggugacccaugaaggauccacagucgagaagaagguggcaccggccgagugcuca

SEQ ID NO: 23761 - RNA, 360 nt, Artificial Sequence
  derived and/or modified sequence opt3 from Tanezumab_HeavyChain
caggugcaacugcaggagagcggccccgggcucgucaagccuuccgaaacccuuucucugacaugcacuguuucaggauucaguuugaucgguuacgacuuaaacuggauucggcagccaccgggcaaagggcuggaguggauaggaaucauuuggggcgaugguacgaccgacuauaauagcgccgugaaguccaggguaacaaucucuaaagauacuucgaagaaccaguuuucacuaaaacucagcagugugaccgcugcagacacagccgucuacuauugugcgagagggggauacugguaugcuaccuccuacuauuucgauuacuggggccaaggcacucuggugacaguuucu

SEQ ID NO: 23762 - RNA, 327 nt, Artificial Sequence
  derived and/or modified sequence opt3 from Tanezumab_LightChain
gacauccagaugacccaaagccccuccucucugucagccagugugggcgauagagucacaauuacuugcagggcuagccaguccauaucuaacaaucucaacugguaccagcagaagccugggaaagcaccaaaacuucugaucuauuacacgucgcgguuccacucaggaguuccgagccgcuuuagugguuccggcucugggaccgacuucacauuuacuauuagcuccuugcaacccgaggauaucgccaccuauuacugucagcaggaacauacauuaccuuauaccuucggacagggcacuaagcuggagauuaagcgaaca

SEQ ID NO: 23763 - RNA, 1323 nt, Artificial Sequence
  derived and/or modified sequence opt3 from Tarextumab_HeavyChain1
gaggugcagcuggucgaaagcggcgggggacucguucaacccgguggcucccuuagacugucuugcgccgcuucaggguucaccuuuaguagcuccggaaugucuugggugaggcaggcaccuggcaaggguuuggaguggguaucggugaucgccucaagcgggaguaacacauacuaugcggacuccgucaaaggacgguucacuauuucucgcgauaauagcaagaacacguuauaccugcagaugaauagucuacgagcugaagacaccgccguguauuacugugcacguucaauauuuuauacaacuuggggccagggcacccucguuacagugaguagcgccucuaccaaagggccauccgucuucccgcuggcucccugcucaagaagcacuuccgagucuacagcagcccuuggaugucuggugaaggauuacuuuccugaaccaguaaccguuuccuggaacagcggugcuuugacgucgggcgugcacacuuuccccgccguccuccaaucuuccgggcuguauucacugaguagcguggugaccgucccuuccucuaauuuuggaacacagacuuauaccugcaacguugaccauaaaccaagcaauacaaagguggauaagaccguagagaggaaauguugcguggagugucccccuugcccagcgccgcccgucgcaggcccuucaguguuccucuuuccacccaagccuaaagacacguuaaugaucagucggacuccagaaguuacauguguggucguggauguaucccacgaggaccccgaaguucaguucaacugguacguggauggugucgaggugcauaaugccaagaccaaaccgcgcgaggaacaguuuaacagcacuuucagagucgugucuguucugacagugguacaccaagacuggcuuaaugggaaggaguacaagugcaaagucucaaacaagggauugccugcucccauugagaaaaccaucaguaagacgaaaggccagccaagggaaccucagguguacacccugcccccaagccgggaagagaugacaaagaaucagguuucccuaacuugucucgugaaaggcuuuuaucccucugauauugccgucgagugggaaucgaacgggcaaccugagaauaacuacaagaccacaccaccgaugcuggacagcgauggauccuucuuccuuuauucaaagcugacuguggacaaaagucgcuggcagcaggguaacguauuuucuugcagcgugaugcaugaagcauugcacaaucacuacacccaaaagucccucucacugagccccggcaaa

SEQ ID NO: 23764 - RNA, 645 nt, Artificial Sequence
  derived and/or modified sequence opt3 from Tarextumab_LightChain1
gacaucgugcugacccagagccccgccacacucucccuuucuccuggcgagagagcuacucugucaugcagggcaagucaaagcguccgguccaacuacuuggccugguaucagcagaagccagggcaggcgccgcgcuuacugauuuacggagcuucuucgcgagccacggguguucccgcacguuucucaggcagcgggaguggaaccgauuuuacacuaacuauauccucucucgaaccugaggacuucgccguguauuacugucaacaguauagcaauuuuccaaucaccuucggccaggguacaaaaguagaaauuaagagaaccguggcugcacccuccgucuuuaucuucccuccaucagaugagcagcugaaaagugggacugccagcgugguuugccuucugaacaauuuuuaccccagggaagcuaaggugcaauggaaagucgacaacgccuugcagucuggaaauucccaggagucagugacagagcaggauagcaaggacaguaccuauucucucuccagcacgcugacucugucgaaggcggauuacgaaaaacacaagguauacgcaugugagguuacccaucaaggccucucuuccccugugacaaaaucauucaaccggggcgaaugc

SEQ ID NO: 23765 - RNA, 363 nt, Artificial Sequence
  derived and/or modified sequence opt3 from Tefibazumab_HeavyChain1
caggugcaacugaaggagagcggccccgggcucgucaaaccuucccagacccuuucuaucacaugcacuauuucaggauucagucugagcagauacuccguucacugggugaggcagccaccggguaagggcuuggaaugguuagggaugauauggggaggcgguaacacggacuauaauucugcccugaaaucgcggcuaucaaucagcaaggauaacaguaaaaaucagguauuucucaagaugaacucccugaccgcugcagacacagccguguacuauugugcgcgcaagggggaguucuacuauggauacgauggcuuugucuauuggggccaagggacucuugugaccguuucuagc

SEQ ID NO: 23766 - RNA, 336 nt, Artificial Sequence
  derived and/or modified sequence opt3 from Tefibazumab_LightChain1
gacaucgugaugacccagagccccgauucccuggccgucucucucggcgagagaguuacaaugaacugcaagucaagucaaagcgugcuuuacuccucuaaucagaaaaacuaucuggcuugguaccagcagaagccugggcaaucgccaaaauuguuaauuuauugggcaucaacuagggaaagcggaguaccggaccgguucagugguuccggcucugggacggauuuuacccugacaauaagcuccgugcaggccgaggaccuagcggucuacuauugucaccaguaccucucaaguuauacuuucggaggcgguaccaagcuggaaaucaaa

SEQ ID NO: 23767 - RNA, 1368 nt, Artificial Sequence
  derived and/or modified sequence opt3 from Tenatumomab_HeavyChain1
gagauccagcugcaacagagcggccccgaacucgugaagccuggggccuccgucaaaguuucuugcaaggcuucaggauacgcauucaccaguuauaacauguacugggugaaacagagccacgguaagucccuugaguggauuggcuauauagacccauacaaugggguaacaucuuauaaccagaaauuuaagggaaaggccacucugacgguggauaaaucgucaagcaccgcguacaugcauuugaauaguuuaacauccgaagacucugcugucuauuacugugccagaggcggugggagcaucuacuaugcaauggauuacuggggacaaggcacuuccgugaccguuucaagugccaagacaaccccgcccagcguguauccucuggcuccaggcugcggggacacuacaggaucuuccgucacccuagguugucucgugaaaggcuacuuccccgagucaguaacgguuacuuggaacagcgggagucugucuuccagcgugcacaccuuuccugcacuucugcagucgggauuguauacaaugucuuccucagucacugugccaaguagcaccuggcccucccagacagugaccugcucugucgcccauccugcuagcucaacgacuguugauaagaaacucgaaccaaguggcccgauuuccacaaucaaucccuguccuccaugcaaggagugucacaagugccccgccccuaaccuggagggugggccaagcguguucauuuuucccccgaauaucaaagacguacugaugauaucucucaccccuaaggugacuugugucgugguugaugugucagaagacgaucccgacguccagaucaguugguucgugaacaauguagagguucauacagcgcaaacccagacgcacagggaagauuacaacagcaccauucggguggucuccacauuaccaauccagcaccaggacuggaugucuggaaaagaguuuaagugcaaagugaauaacaaggaucugccuucgcccauugagcgcacuaucagcaaaauaaagggccuuguccgagcaccacaaguguauauuuugcccccuccagccgaacagcugucccguaaggacguuucacuaaccugucucgugguaggcuucaauccgggggacaucagugucgaguggacaucuaacggacauacugaagagaauuacaaagauaccgcucccgugcuggacagcgaugguuccuacuuuauuuauucaaaacuuaacaugaaaacaagcaagugggaaaagaccgacucuuucuccugcaacguuagacacgagggccugaagaauuacuauuugaagaaaacuaucaguaggagcccugggaag

SEQ ID NO: 23768 - RNA, 657 nt, Artificial Sequence
  derived and/or modified sequence opt3 from Tenatumomab_LightChain1
gacaucgugaugacccaggccgcucccagcgucccuguuacaccaggcgaguccgugucuauuucaugcagaaguagcaagucccugcuccacucuaacgggaauacuuaccuuuauugguuccugcaaaggccgggacagucgccccaguuguuaauauaccggaugucaaaccuggcaagcgguguaccugaucgcuuuaguggcuccgggucuggaacggccuucacccuacgaaucagccguguggaagcggaggacgucggcguguauuacuguaugcagcaucucgaauauccacugacauuuggugcugggacuaaacuugagcugaagagagccgaugcagcccccaccguuuccauuuucccuccaucaagugaacaauugacaagcggaggcgcuucuguggucugcuuucucaauaacuucuaccccaaagacaucaaugugaaguggaaaauugauggcuccgagaggcagaacgggguacucaauucauggaccgaccaggauagcaaggacaguacuuauucuauguccagcacacugacccugacgaaggaugaguacgaacggcacaacucguacacuugugaggcaacccauaaaacaucuacuuccccuaucguuaagucauuuaaucgcaacgaaugc

SEQ ID NO: 23769 - RNA, 1356 nt, Artificial Sequence
  derived and/or modified sequence opt3 from Teneliximab_HeavyChain1
cagauccaacuggugcagagcggccccgagcucaagaaaccuggggaaaccgucagaauuuccugcaaggccucuggauacgcuuucacaacuacggguaugcaguggguucaggagaugccaggcaaagggcuuaaguggauaggauggaucaacacccacucaggcgugccgaaauauguagaagacuuuaaggguagguucgcauuuagucuggagacaagcgccaauacugcguacuugcaaauuuccaacuuaaagaaugaagauaccgcuacauauuucugugugcggucugggaacggaaauuacgaccuggccuauuuugcauacuggggccagggcacccuagucacugugucggccgcuucaacaaaagggcccagcguuuucccucucgcaccaaguuccaagucuaccagcggagguacggccgcucugggcugccuugugaaagauuauuuucccgagccugucacuguguccuggaacucaggggcccugaccaguggaguacauacauucccagcgguuuugcagagcucuggccucuacucccugucaagcguggucacugugcccaguucuucccuggguacccagacauacaucuguaaugugaaccacaagccuagcaauaccaaagucgacaagaagguugagccaaaaucgugcgauaagacgcauacuuguccgcccugcccugcaccagaacucuuagggggacccucuguguuucuguucccuccaaaacccaaggacacacuuaugauuucccgcaccccggagguaacuuguguggucguggauguuucacacgaagacccugaggugaaauuuaacugguaugucgauggcguggagguacauaaugccaagacaaaaccccgagaggaacaauacaacaguaccuaucguguugugagcgucuugacggugcugcaccaggacuggcuaaauggcaaggaauacaagugcaaagucuccaacaaggcucucccagccccuaucgagaaaaccauaucuaaggcaaaagggcagcccagagaaccacagguguauacacugcccccuagcagggaugagcuuacuaagaaucaaguuucacugaccuguuuggugaagggauucuacccaagugacaucgcuguagagugggaauccaacggucagccggagaacaauuauaaaacaacucccccuguccucgauagcgacggcucauuuuuccuguacucuaaguuaaccguggacaaaagucgguggcagcaagggaacguuuucagcugcuccgugaugcacgaagcccugcauaaucacuacacacagaagucucucucgcuuagcccaggaaaa

SEQ ID NO: 23770 - RNA, 642 nt, Artificial Sequence
  derived and/or modified sequence opt3 from Teneliximab_LightChain1
gacaucgugcugacgcagagccccgccacacucuccgucacuccuggcgauagaguuucucuuucaugcagggcuagucaaagcauuuccgacuaccugcacugguaucagcagaagucucaugagucgccacgguuguuaauaaaauacgcaucacacagcaucagugggauuccgucccgcuucucuggaagcgguuccggcucagauuuuacgcugaguaucaacagcguggaacccgaggacguagggauuuauuacugucagcauggacacucuuucccuuggaccuuuggcggugggacaaagcuagaaaucaaacgaacuguggccgcgccauccgucuucauauuucccccuucagaugagcaacucaagagcggaaccgcuagugugguuugccugcuuaauaacuucuauccacgugaagccaaagugcaguggaaggucgacaaugcacugcagucuggcaacucccaggagagcgugacagagcaagauucgaaggacucuaccuacuccuugucaaguacucucacacugagcaaagccgauuaugaaaagcauaaaguauacgcuugugagguuacccaccagggccuguccucucccgugaccaagagcuuuaauagaggggaaugc

SEQ ID NO: 23771 - RNA, 1347 nt, Artificial Sequence
  derived and/or modified sequence opt3 from Teplizumab_HeavyChain1
caggugcaacugguccagagcggcgggggaguugugcagcccgguagaucccucaggcuuucuugcaaggccucaggcuacaccuucacacgguauacuaugcacuggguacgccaggcuccugggaaaggacuggaguggaucggcuacauuaacccaagucgagguuauacgaauuacaaccaaaaggugaaagaccguuuuaccauaagcagagauaauuccaagaacacagcauucuugcagauggacucuuuaaggccggaagauacuggggucuauuuuugugcccgguacuaugacgaucauuacugccuggacuacuggggacagggcacccccgugacaguuucgucagcgagcaccaaaggcccuaguguguucccacuagcucccuccucuaagagcacuuccgggggaacagccgcacucgguugucuggucaaggauuauuuuccugagccagugaccguaucauggaauaguggcgcccuuacgagcgggguucacacuuuccccgcugugcugcagucuuccggauuguacucacucagcagugucgugaccgugccuucuuccagccugggcacacaaacuuauaucugcaacgucaaucauaaaccaucgaacaccaagguugacaaaaagguggaaccgaaaucuugugauaagacacacaccugucccccuugcccagcacccgaggccgcuggugggccuuccguauuucuguucccacccaagccgaaagacacgcucaugauuucacgcacuccugaagugacaugcgucgugguugaugugagucaugaggaccccgaggucaaguuuaauugguacguggauggaguagaaguucacaacgccaaaaccaagccaagagaggaacaguauaauagcacuuacaggguggucuccguguuaacaguccugcaccaggacuggcuuaacggcaaagaguauaaguguaaagugucuaauaaggcguugccugcacccaucgagaagaccauuagcaaagccaagggccagccacgggaaccccaaguuuacacgcugccuccaucacgcgacgagcuaaccaaaaaccaggugagucucacaugccugguaaagggguucuacccguccgauaucgcugucgaaugggagagcaauggacagcccgaaaacaacuauaaaacuaccccuccagugcuugacucugaugguucauuuuuccuguacaguaaguugacaguugacaagagccgauggcaacagggcaauguguuuuccuguucugucaugcaugaggcccuccacaaccauuauacucagaaaucgcugagcuuaucccccgggaag

SEQ ID NO: 23772 - RNA, 639 nt, Artificial Sequence
  derived and/or modified sequence opt3 from Teplizumab_LightChain1
gacauccagaugacccaaagccccuccucucugucagccagugugggcgauagagucacaauuacuugcagcgcuuccucuucgguuucauacaugaacugguaucagcagacgccugggaaggcaccaaaaagguggauauacgacaccagcaagcucgccaguggagugccgucccgguucucugguagcggcuccgggacagauuauacuuuuaccaucucaagucuucagcccgaggacauugcgacauacuauugucaacaguggagcucuaauccuuucaccuuuggacagggcacuaaacugcagaucacacgcaccguagcugccccauccguguucauuuuucccccuucagaugaacaauugaaguccgguacggcaagugucgugugcuuacugaacaauuucuacccacgagaggccaaaguucaguggaagguggacaacgcucuacagucugggaauagccaggaaagcgucacugagcaagauucgaaggacucuaccuauucccucucaaguacacugacucuuagcaaagcagauuacgaaaagcacaaaguguacgccugugagguaacccaucagggacuguccucucccguuacaaagagcuuuaaccguggcgagugc

SEQ ID NO: 23773 - RNA, 1344 nt, Artificial Sequence
  derived and/or modified sequence opt3 from Teprotumumab_HeavyChain1
cagguggagcuggucgaaagcggcgggggaguugugcaacccgguagaucccagaggcucucuugcgccgcuucaggcuucaccuuuaguagcuacgggaugcacuggguacggcaggcaccuggaaagggccuugaguggguggccaucauuugguucgacgguuccucuacauauuacgcggauucgguccgcgggcgauuuacuauaucacgugacaacagcaaaaauacgcuguauuugcagaugaacaguuuaagagcugaagauaccgccguguacuucugugcaagggagcugggacggcgcuauuuugaccuauggggcagaggcacacucguuuccgugucuagcgccuccacuaaggggccaucagucuucccgcuggcucccaguagcaaaucuaccuccggagguacagcagcccuuggcugccuggugaaggauuacuuuccugaaccaguaaccguuucauggaauagcggggcuuugacaaguggagugcauacuuuccccgccguccuccaaucuuccggccuguauagccugucgucuguggugaccgucccuuccucaagucucgguacgcagacuuacaucuguaacguuaaucacaaaccaagcaacaccaagguggacaagaaaguagagcccaaguccugcgauaaaacacauacuuguccuccaugcccggcgcccgaguuacuugggggaccuucuguguuucuguucccacccaagccuaaagacaccuugaugauuagcaggacaccagaagucaccugugugguuguggaugucucacacgaggaccccgaagugaaguuuaauugguacguagauggcguugaggugcauaacgcaaagacgaaaccgcgggaggaacaguauaauaguacuuaccgcgucguguccguccugacagugcuacaccaggacuggcucaacggcaaggaguauaaaugcaagguuagcaauaaagcccugccugcucccaucgaaaagaccauuucuaaagccaaggggcaaccacgagagccucagguguacacucuucccccaucaagagaugaacugacaaagaaccagguaaguuugaccugucucgucaaaggauucuaucccagcgacaucgcaguggagugggaguccaauggucagccugaaaacaauuacaagacgaccccaccgguucuggacucugauggcucguuuuucuuauauagcaaacugacaguggacaaguccagguggcaacaggggaacgucuucucaugcagugugaugcacgaggcucuccauaaccacuacacucagaaaucucuuagccugucccccggaaag

SEQ ID NO: 23774 - RNA, 645 nt, Artificial Sequence
  derived and/or modified sequence opt3 from Teprotumumab_LightChain1
gagaucgugcugacccagagccccgccacacucucccuuucuccuggcgaaagagcuacucugucaugcagggcaagucaaagcgucuccucuuacuuggccugguaucagcagaagccagggcaggcgccgcgguuacugauuuacgacgcuucgaaacgcgccacgggaauacccgcacgauucucagguagcggcagugggaccgauuuuacacuaacuaucuccucucucgagccugaagacuucgccguuuauuacugucaacagcguagcaaguggccacccuggaccuuuggacagggcacaaaaguggaguccaagagaaccguagcugcaccuucaguguucauuuuuccacccagugaugaacagcugaaaagcgguacugccucugucgugugccuucugaacaauuucuauccuagggaggcuaagguucaauggaagguggacaacgccuugcaguccggaaauucacaggagagcgucacagaacaggauaguaaagacucuaccuacucccucagcucgacgcugacucugucuaaggcggauuaugagaaacacaagguguacgcaugugaaguaacccaucaagggcucuccucaccaguuacaaaaaguuuuaaccggggcgagugc

SEQ ID NO: 23775 - RNA, 1338 nt, Artificial Sequence
  derived and/or modified sequence opt3 from Tesidolumab_HeavyChain1
gaggugcagcugguccaaagcggcgccgaaguuaagaaacccggguccucugugaagguaucaugcaaagcuaguggagguaccuucagcuccuacgcaaucucuugggugagacaggccccuggccaggggcucgaguggaugggaggcauugguccauuuuucgggacagcgaacuaugcucagaaguuucaaggaagggucacuauaacggccgacgaaucgaccucaacagcauacauggagcuuagcagucugcgguccgaagauacugccguguauuacugugcucgcgacaccccguauuucgauuacuggggccagggcacauugguuaccgugucuagcgcauccacuaaagggcccucagucuuuccuuuagccccaaguagcaagucuacauccggagguaccgcugcccugggcugccuagugaaggacuauuuccccgagccuguaacgguuucauggaauagcggggcgcucaccaguggagugcacacuuuuccagcaguccugcagucuuccggccuuuacagccugucgucuguggugacaguccccuccucaaguuuggguacucagaccuacaucuguaacguuaaucauaaaccuagcaacacaaagguggauaaacgaguagagccaaaguccugcgacaaaacccacacguguccgcccugcccugccccagaagcugccgggggacccucuguguuccucuuuccuccaaagcccaaggauacucugaugauuagccguacaccggaggucaccugugugguuguggacgucucacaugaagauccugaggugaaauucaauugguauguagacggcguugaggugcacaacgcaaagacuaaacccagagaggaacaauacaauaguacauauagggucguguccguccugaccgugcuccaucaggauugguuaaacggcaaggaauacaaaugcaagguuagcaauaaagcucugccagccccuaucgagaagacgauuucuaaggcgaaagggcagccccgggaaccacagguguauacccuucccccuucacgcgaggagaugacaaagaaccaaguaaguuugacuugucuggucaaaggauuuuacccaagcgacaucgccguggaaugggaguccaauggucagccggaaaacaauuauaagaccacacccccuguucuagauucugacggcucguucuuucucuacagcaaacugacuguggacaaguccagauggcagcaagggaacgucuucucaugcagugugaugcacgaggcacuucacaaucauuacacccagaagucucugagcuuguccccaggaaaa

SEQ ID NO: 23776 - RNA, 642 nt, Artificial Sequence
  derived and/or modified sequence opt3 from Tesidolumab_LightChain1
agcuacgagcugacccagccccucuccgugucugucgcccuuggccaaacagcuagaaucacuugcucaggggacaguauuccuaacuauuacguuuauugguaccagcagaagccaggacaggcaccggugcugguaauauaugaugacagcaauaggcccuccgguaucccugaacgguucucuggcucgaacucagggaauacggccaccuugacaauuagccgcgcgcaagcuggagaugaggccgacuacuauugucagaguuuugauuccucuuuaaacgcagaaguguucggcggugggacuaaacugaccguccuaggacagccaaaggccgcucccagcgugacacucuuuccuccauccucagaggaacugcaggcaaauaaagccacccuuguuugccugaucagugacuucuaccccggcgcugugacugucgccuggaaggcggauagcucuccugugaaagcaggcguagagacaaccacgccauccaagcaaucaaacaauaaguacgccgcuagcaguuauuugucucucacuccggagcaguggaaaucccaccgaagcuacucgugucagguuacccaugaagggucuacaguggagaagacugucgcccccaccgaaugcucc

SEQ ID NO: 23777 - RNA, 1344 nt, Artificial Sequence
  derived and/or modified sequence opt3 from Tezepelumab_HeavyChain1
cagaugcaacugguggagagcggcgggggagucguucagcccgguagaucccucaggcuuucuugcgccgcuucaggcuucaccuuucggacauacgggaugcacugggugcgccaggcaccuggaaagggccuggaauggguagccgugaucugguaugacgguaguaacaaacauuacgcggauagcgucaaggggcgauucacuauuacgcgugacaauuccaaaaacaccuugaauuuacagaugaacucucugagagcugaggauacagccguguauuacugugcaagggccccacaaugggagcuaguucacgaggcuuuugacauauggggacagggcacuauggugaccgucucgucagcaagcacaaagggcccgaguguguucccccucgccccuugcucccggucuaccagcgaauccacugcugcccuggggugucuuguaaaagauuauuuuccagagcccguuacagugucauggaauaguggagcgcugaccagcgguguccauacguucccugcaguguugcagucuuccggccucuacucacugagcaguguggucacuguuccaucuuccaacuuugggacccagacauauacuugcaauguggaccacaagcccagcaacaccaagguagauaaaacaguggagcgcaaguguugcgucgaauguccuccaugcccggcucccccuguggccggaccaucgguuuuccuguuucccccuaaaccaaaggacacccucaugaucucuagaacgcccgaggugacuugugucgugguagauguuucccaugaagacccggaggugcaauucaauugguacgucgauggcguggagguccacaacgccaaaacaaagccuagggaagaacaguuuaauucaaccuuccgggugguuaguguguuaacuguaguccaccaggacuggcugaacgguaaggaauacaaaugcaaggugagcaauaaagggcuucccgcaccaauugagaagacaaucuccaaaaccaagggacagccucgcgaaccccaaguuuauacguugccacccucucgagaggagaugaccaaaaaccaggugagccugacaugucuagucaagggcuuuuacccuucagauauugcuguggaaugggagaguaauggccagccagaaaacaacuauaagacuaccccgcccaugcucgacuccgacgggagcuucuuccuguacucuaaacuuacaguagauaagucaagauggcaacagggaaauguguuuaguugcagcguuaugcaugaggcccugcacaaccauuauacucagaaauccuugucucucucgccugguaag

SEQ ID NO: 23778 - RNA, 642 nt, Artificial Sequence
  derived and/or modified sequence opt3 from Tezepelumab_LightChain1
agcuacgugcugacccagcccccuuccgucucuguugccccaggccaaacagcuagaaucacuugcgggggaaacaaucucgguucaaagagugugcacugguaucagcagaaaccgggccaggcacccguacuuguggucuacgacgauagcgacaggccuuccuggauuccagagcgguucucugggucgaacucaggaaauacggccacccugacaauaagccgcggcgaagcgggugaugaggcugacuauuacugucaagugugggauaguuccucugaccauguuguguuugggggaggcacuaaguugaccgucuuaggccagcccaaagccgcaccuagcgugacacuguucccacccuccucagaagaacuacaggccaacaaggcuacccucguaugccugaucagugauuuuuauccuggggcaguuacuguggccuggaaagcugacagcucuccagucaaggccggaguggaaacaaccacgccguccaagcagucaaauaacaaauacgcggcaagcaguuaucuuucucugacucccgagcaauggaagucccaccgaagcuacucgugucaggugacccaugaggguucuacagucgagaaaacuguugccccuaccgagugcucc

SEQ ID NO: 23779 - RNA, 1338 nt, Artificial Sequence
  derived and/or modified sequence opt3 from ThioMAb-chMA79b-HC(A118C)_HeavyChain
gaggugcagcugcaacagagcggcgccgaacucaugaagcccggggcuuccgucaaaaucucuugcaaggcaaccggauacacauucucaaguuauuggauugaguggguuaaacagagaccuggucacggccuugaauggauaggggagauccugccaggaggcggugacacuaacuacaaugaaauuuuuaaggggaaagccacguucaccgcggauacaagcuccaacacugcuuauaugcaguugucuucguuaaccucagaggacagcgccguguacuauuguacaaggcggguaccgguguacuuugauuauuggggacaaggcaccagugucacuguguccucuugcagcacaaagggccccuccguuuucccucuggcaccaucaaguaagagcaccucugggggaacggccgcucuagguugucucgugaaagacuacuuucccgagccugucacuguguccuggaacucaggcgcacugaccagcgggguacauacauucccagccguucuucagaguucuggacuguacuccuugagcucgguggucacugugcccucuuccucacucggcacccagacauauaucugcaaugugaaucacaagccuaguaacaccaaagucgauaagaaaguugaaccaaagagcugugacaagacgcauacuugcccgcccuguccugcuccagagcugcugggugggcccuccguguuucucuucccuccaaaacccaaggauacauuaaugauuucucgcaccccggaaguaacuugcguggucguggacguuagccacgaggauccugaggugaaauuuaauugguacgucgacggaguggaaguacauaacgccaagacaaaaccccgagaggaacaguauaauucaaccuaccguguugugaguguccugacggugcuucaccaagauugguugaacggcaaggaguauaaauguaaggucuccaauaaggcgcugccagcaccuaucgagaaaaccauaagcaaggccaaaggccagcccagagaaccacagguguacacacuacccccuucuagggaggaaaugacuaagaaccagguuucacugaccugccucgugaaaggguucuauccaagugacaucgcuguagagugggaaagcaauggacaaccggagaacaauuacaagacaacucccccuguccuugauuccgacgguucguuuuuccuguacucuaaguugaccguggacaaaagccgguggcagcagggcaacguguuuuccuguucaguuaugcacgaagcccuccauaaccacuauacacaaaagagucugucuuuaagcccaggg

SEQ ID NO: 23780 - RNA, 1347 nt, Artificial Sequence
  derived and/or modified sequence opt3 from ThioMab-hu10A8.v1-HC(A118C)_HeavyChain
gaggugcagcuggucgaaagcggcgggggacucguucaacccgguggcucccuuagacugucuugcgccgcuucaggguucaccuuuaguagcuacgcaguguccuggguaaggcaggccccuggaaagggcuuggaguggguggcgacaaucucuucgggugggucauuaacuuucuaucuggacagcguccggggacgcuuuacgauuagucgagauaacuccaaaaauacccuauaccuccagaugaacucucugcgugcugaagacacagccguguauuacugugcaagaccaauaccggauuauuacgcccuugacuauuggggccagggcacucugguuaccgugagcuccugcucaacaaaggggcccagugucuucccuuuggcuccaagcucuaaauccaccucaggagguacugcagcccucggcugucuggugaaggauuacuuucccgagccuguaacaguuagcuggaauaguggggcucugaccucuggagugcacacguucccagccguccuccaauccagcggcuuauacucgcugucuuccguggugacuguccccucaaguagccuugguacccagacauauaucugcaacguuaaucauaaaccuuccaacacuaagguggacaagaaaguagaaccaaagucuugugauaaaacccacacaugcccgcccuguccugcgccagaguugcucgggggacccagcguguuucuauucccuccaaagcccaaagacacccucaugauuucaaggacgccggaggucacuugcgugguuguggaugucagucaugaagacccugaggugaaguuuaauugguacguagauggcguugaagugcacaacgcaaagacaaaaccccgggaggagcaguauaauuccaccuaccgcgucgugagcguccugacugugcuucaucaggacuggcugaacggcaaggaauauaaauguaagguuucuaauaaagccuugccagcuccuaucgagaagacaauuucaaaagccaaggggcaacccagagaaccacagguguacacccugcccccuaguagggaggaaaugacgaagaaccagguaagccugaccugcuuagucaaaggauucuauccauccgauaucgcaguggagugggagucuaauggucagccggaaaacaauuacaagacaacucccccuguucuggacucggacggcagcuuuuuccucuacuccaaacuuaccguggauaagucacgguggcaacaggggaacgucuuuaguuguucugugaugcacgaggcucugcacaaccauuauacacagaaauccuugagccuaucaccaggaaag

SEQ ID NO: 23781 - RNA, 1347 nt, Artificial Sequence
  derived and/or modified sequence opt3 from ThioMab-hu10A8.v1-HC(V205C)_HeavyChain
gaggugcagcuggucgaaagcggcgggggacucguucaacccgguggcucccuuagacugucuugcgccgcuucaggguucaccuuuaguagcuacgcaguguccuggguaaggcaggccccuggaaagggcuuggaguggguggcgacaaucucuucgggugggucauuaacuuucuaucuggacagcguccggggacgcuuuacgauuagucgagauaacuccaaaaauacccuauaccuccagaugaacucucugcgugcugaagacacagccguguauuacugugcaagaccaauaccggauuauuacgcccuugacuauuggggccagggcacucugguuaccgugagcuccgcuucaacaaaggggcccagugucuucccuuuggcaccaagcucuaaauccaccucaggagguacugccgcucucggcugccuggugaaggauuacuuucccgagccuguaacaguuagcuggaauaguggggcccugaccucuggagugcacacguucccagcgguccuccaauccagcggcuuauacucgcugucuuccguggugacuguccccucaaguagccuugguacccagacauauaucuguaacguuaaucauaaaccuuccaacacuaagguggacaagaaaguagaaccaaagucuugcgauaaaacccacacauguccgcccugcccugcaccagaguugcucgggggacccagcguguuucuauucccuccaaagcccaaagacacccucaugauuucaaggacgccggaggucacuugugugguuguggaugucagucaugaagacccugaggugaaguuuaauugguacguagauggcguugaagugcacaacgccaagacaaaaccccgggaggagcaguauaauuccaccuaccgcgucgugagcguccugacugugcuucaucaggacuggcugaacggcaaggaauauaaaugcaagguuucuaauaaggcuuugccagccccuaucgagaaaacaauuucaaaagcaaaggggcaacccagagaaccacagguguacacccugcccccuaguagggaggaaaugacgaagaaccagguaagccugaccuguuuagucaaaggauucuauccauccgauaucgcuguggagugggagucuaauggucagccggaaaacaauuacaagacaacucccccuguucuggacucggacggcagcuuuuuccucuacuccaaacuuaccguggauaagucacgguggcaacaggggaacgucuuuaguugcucugugaugcacgaggcccugcacaaccauuauacacagaaauccuugagccuaucaccaggaaag

SEQ ID NO: 23782 - RNA, 642 nt, Artificial Sequence
  derived and/or modified sequence opt3 from ThioMab-hu10A8.v1-LC(A118C)_LightChain
gacauccagaugacccaaagccccuccucucugucagccagugugggcgauagagucacaauuacuugcaaggcuagccaggacguuuccacggcaguggccugguaccagcagaaaccugggaaggcgccaaaacuccuuauauauucugcuucguacagguauaccggaguaccgucacgguucagcgguaguggcuccgggacagauuuuacucugaccaucucuagcuugcaacccgaggacuucgccacauacuauugucagcagcacuuuuccucaccucgcaccuucggacagggcacuaagguggaaauuaaacgaacagucgcagccccaaguguguuuaucuuucccccuagcgaugagcaauuaaagucugguaccgcuuccguugugugccugcuaaacaauuucuacccacgugaagcaaagguccaguggaaaguggacaacgcccuccagucagggaauagccaggagaguguaacggaacaagauucuaaggacuccacuuauagccugucgucuacccuuacacuguccaaagcugauuacgagaagcauaaaguuuacgccugugaggugacucaccagggauugucaagucccgucaccaagagcuucaacagaggcgaaugc

SEQ ID NO: 23783 - RNA, 642 nt, Artificial Sequence
  derived and/or modified sequence opt3 from ThioMab-hu10A8.v1-LC(V205C)_LightChain
gacauccagaugacccaaagccccuccucucugucagccagugugggcgauagagucacaauuacuugcaaggcuagccaggacguuuccacggcaguggccugguaccagcagaaaccugggaaggcgccaaaacuccuuauauauucugcuucguacagguauaccggaguaccgucacgguucagcgguaguggcuccgggacagauuuuacucugaccaucucuagcuugcaacccgaggacuucgccacauacuauugucagcagcacuuuuccucaccucgcaccuucggacagggcacuaagguggaaauuaaacgaacagucgcagccccaaguguguuuaucuuucccccuagcgaugagcaauuaaagucugguaccgcuuccguugugugccugcuaaacaauuucuacccacgugaagcaaagguccaguggaaaguggacaacgcccuccagucagggaauagccaggagaguguaacggaacaagauucuaaggacuccacuuauagccugucgucuacccuuacacuguccaaagcugauuacgagaagcauaaaguuuacgccugugaggugacucaccagggauugucaagucccugcaccaagagcuucaacagaggcgaaugu

SEQ ID NO: 23784 - RNA, 1338 nt, Artificial Sequence
  derived and/or modified sequence opt3 from ThioMAb-huMA79b.v17-HC(A118C)_HeavyChain
gaggugcagcuggucgaaagcggcgggggacucguucaacccgguggcucccuuagacugucuugcgccgcuucaggguacaccuucaguagcuauuggaucgagugggugaggcaggcaccuggaaagggcuuggaauggauuggugagauauuaccagggggaggcgacacaaacuacaaugaaaucuuuaaaggccgggccacuuucuccgcggauacgucuaagaacaccgcuuaucugcagaugaauagucuacgcgccgaggacacagcaguauacuauuguacucgacgugugccggucuacuuugauuauugggggcagggaacccucgugacaguuucaagcugcaguaccaaaggucccuccguguucccucuggccccaucuagcaaguccacuucaggcgggacagcugcacuuggaugucuggucaaagacuacuuucccgagccugugaccguaaguuggaacagcggcgccuugacgucugguguucacacuuucccagcugugcuccaauccucagggcuguacagccugaguucugucgugaccgugcccuccagcucgcucggaacacagacuuauauuugcaaugucaaccauaagccuucuaauaccaagguugauaaaaagguggaaccaaaauccugugacaagacacauaccugcccgcccuguccugccccagaguuacugggcggccccucaguauuucuuuucccuccaaaacccaaggauacguugaugaucaguagaacuccggaagugacaugcgucgugguugacgugagccacgaggauccugaggucaaguuuaacugguacguggacgggguagaaguucacaaugcgaaaaccaagcccagggaggaacaguauaacuccacuuaccggguggucucugugcugacaguccuacaucaggauuggcucaauggaaaagaguauaaguguaaagugagcaacaaggcacugccagccccuauugaaaagaccaucucaaaggcuaagggucaaccccgcgagccacagguuuacacgcuucccccuaguagagaggaaaugaccaaaaaucaggugucccugacaugcuugguaaagggcuucuauccaagcgacauagccgucgagugggaaucuaacgggcagccggagaauaacuacaaaacuacacccccugugcucgauucagacggaucguuuuuccuguacagcaaguuaaccguugacaaauccagguggcaacagggcaacguguuuucuuguucggucaugcacgaagcacugcacaaucauuauacucagaaaagccucucccuuucaccaggu

SEQ ID NO: 23785 - RNA, 654 nt, Artificial Sequence
  derived and/or modified sequence opt3 from ThioMAb-huMA79b.v17-HC(A118C)_LightChain
gacauccagcugacccaaagccccuccucucucucagccagugugggcgauagagucacaauuacuugcaaggcuagccaguccguugacuacgauggggacucuuuccuuaacugguaucagcagaaaccuggaaaggcaccaaaacuguugauauacgccgcgucgaauuuagagucaggugugccgagcagguuuaguggcuccgggucuggaacggauuucacccugacaaucagcucccuacaacccgaagacuuugcuacuuauuacugucagcagucaaacgaggauccucucaccuucggccaggguacaaagguagaaauuaaacggaccguggccgcaccaagugucuuuaucuuucccccuagcgacgagcaacugaagucugggacugccuccgugguuugccuucugaauaacuucuauccacgcgaagcuaaggugcaguggaaagucgauaaugcauugcagucaggaaacagccaggagagugugacagagcaagacucuaaggauuccaccuacagccucucgucuacgcugacucuguccaaagccgacuaugaaaagcacaaaguauacgcuugugagguuacccaucagggccucucaagucccgugacaaagagcuucaaucgaggcgaaugc

SEQ ID NO: 23786 - RNA, 1338 nt, Artificial Sequence
  derived and/or modified sequence opt3 from ThioMAb-huMA79b.v18-HC(A118C)_HeavyChain
gaggugcagcuggucgaaagcggcgggggacucguucaacccgguggcucccuuagacugucuugcgccgcuucaggguacaccuucaguagcuauuggaucgagugggugaggcaggcaccuggaaagggcuuggaauggauuggugagauauuaccagggggaggcgacacaaacuacaaugaaaucuuuaaaggccgggccacuuucuccgcggauacgucuaagaacaccgcuuaucugcagaugaacucgcuacgcgccgaggacacagcaguauacuauuguacucgacgugugccgauuagacucgauuacugggggcagggaacccuggucacagugucaagcugcaguaccaaaggucccuccguuuuuccucuugccccaucuagcaaguccacuucaggcgggacagcugcacugggauguuuggugaaagacuauuuccccgagccugucaccgugaguuggaauagcggcgcccucacgucugguguacacacuuuuccagcuguucugcaauccucagggcuguacagccucaguucuguggucaccgugcccuccagcucguuaggaacacagacuuacaucugcaaugugaaccauaagccuucuaauaccaaggucgauaaaaagguugaaccaaaauccugugacaagacacauaccugcccgcccuguccugccccagagcugcuuggcggccccucaguguucuuguuuccuccaaaacccaaggauacgcugaugauuaguaggacuccggaaguaacaugcguggucguggacguuagccacgaggauccugaggugaaguucaacugguaugucgacgggguggaaguacacaaugcgaaaaccaagccccgggaggaacaguacaacuccacuuaucgcguugugucuguccuaacagugcuccaucaggauuggcugaauggaaaagaguacaaguguaaagucagcaacaaggcacuuccagccccuaucgaaaagaccauaucaaaggcuaagggucaacccagagagccacagguguauacgcugcccccuaguagggaggaaaugaccaaaaaucagguuuccuugacaugccucgugaagggcuuuuacccaagcgacaucgccguagagugggaaucuaacgggcagccggagaauaacuauaaaacuacacccccuguccuggauucagacggaaguuucuuuuuauacagcaagcugaccguggacaaaucccgguggcaacagggcaacguuuucucuuguucggugaugcacgaagcacuccacaaucauuacacucagaaaagccuuucccugucaccaggu

SEQ ID NO: 23787 - RNA, 654 nt, Artificial Sequence; identical to SEQ ID NO: 23631
  derived and/or modified sequence opt3 from ThioMAb-huMA79b.v28-HC(A118C)_LightChain

SEQ ID NO: 23788 - RNA, 654 nt, Artificial Sequence
  derived and/or modified sequence opt3 from ThioMAb-huMA79b.v28-LC(V205C)_LightChain
gacaucgugcugacccagagccccgccucccucgcugucucucuuggccaaagagcaacaauuucaugcaaggccagucagagcguugauuacgacggggauuccuuccugaacugguaucagcagaaaccuggacaaccaccgaaguuguuuauauacgcggcuucuaauuuagagucggguauccccgccagguucucaggcagcgggaguggaacugacuuuacgcugaacauucacccuguggaagaggaagaugcagccaccuauuacugucagcaguccaaugaggacccacuaacauucggcgcugguacugaacucgagcugaaacggaccguagcagcccccucuguguuuaucuucccuccaagcgaugagcagcuuaaguccgggacagcuucagucgugugccuguugaacaauuuuuauccccgcgaagccaaaguucaauggaagguggacaacgcgcuccagaguggaaauagccaggagucugucaccgaacaggauuccaaggacucaacuuacagccugaguucuacacugacccucuccaaagcagauuaugagaagcauaaaguguacgccugugagguaacgcaccaaggcuuaagcucgccuugcacuaagucuuucaaccgaggcgaaugu

SEQ ID NO: 23789 - RNA, 1332 nt, Artificial Sequence
  derived and/or modified sequence opt3 from Ticiliuab_HeavyChain1
caggugcaacuggucgagagcggcgggggaguugugcagcccgguagaucccucaggcuuucuugcgccgcuucaggcuucaccuuuaguagcuacgggcacuggguacggcaggcaccuggaaagggccuggaauggguggccgucaucugguaugacgguuccaacaaauacuaugcggauucugugaaggggcgcuucacaauuucgcgagacaauagcaaaaacacuuuguacuuacagaauagccugcgugcugaggauacggccguuuauuacugugcaagagacccaaggggagccacccuauauuacuacuauuacggcgauguguggggccaagggacaacugucaccgugaguuccgcuucuacaaagggaccgagcguauuuccccucgcaccuugcucccggucaaccagugaaagcacugccgcucuggguugucuuguuaaagacuauuucccagagcccgugacagucucuuggaacuccggcgcccugaccucaggggugcauacguuuccugcgguguugcagagcaguggacucuacucucuguccagcgucguuacugugccaucgucuaauuucggcacccagacauauacuugcaacguagaucacaagcccuccaauaccaagguggacaaaacagucgaacgcaaguguugcguggaguguccuccaugcccggcacccccuguugccgguccaucaguguuucuguuucccccuaaaccaaaggauacccucauaaguagaacgcccgaggucacuugugugguaguugacgugagccaugaagauccggagguccaguuuaacugguacguggacggggucgaagugcacaaugcuaaaacaaagccuagggaggagcaauucaacuccaccuuucggguugugucuguauuaacugucgugcaucaggauuggcugaauggaaaggaauauaaaugcaagguuagcaacaaaggccuucccgccccaaucgagaagacaauuucaaaaaccaagggccagccucgcgaaccccagguguacacguugccacccagucgagaggaaaccaaaaaucaagucucccugacaugucuagugaagggguucuacccuagcgacaucgcaguagagugggagucuaacggacagccagaaaauaacuauaagacuaccccgccccucgacucagaugguaguuucuuccuguacagcaaacuuacaguggacaaguccagauggcagcaaggcaacguuuucucuugcucgguccacgaggcucugcacaaucauuauacucagaaaucauugucccucucaccugggaag

SEQ ID NO: 23790 - RNA, 639 nt, Artificial Sequence
  derived and/or modified sequence opt3 from Ticiliuab_LightChain1
gacauccagacccaaagccccuccucucugucagccagugugggcgauagagucacaauuacuugcagggcuagccaguccauaaacucuuaccucgacugguaucagcagaagccugggaaagcaccaaaacuucugaucuacgccgcgucgucauugcaaagcggaguuccgagucgguucuccgguucuggcagcgggacggauuuuaccuuaacaauuuccucacugcagcccgaggacuucgcuacuuauuacugucagcaguauuacaguaccccuuuuacauucggaccaggcaccaagguggaaaucaagcgcacuguagccgcacccagcguguuuauuuucccuccaucugaugagcaacuaaaauccgguacagccucagucgugugccuccugaauaacuuuuauccccgagaagcuaagguucaguggaagguggacaaugcacuucagagcgggaacagucaggagucugucaccgaacaagauuccaaagacagcacguacucgcugucuuccacuuugacccucucaaaggccgauuacgagaaacacaagguguaugcuugugagguaacacaucagggacugaguagcccuguuacuaaauccuucaaucguggcgaaugc

SEQ ID NO: 23791 - RNA, 1347 nt, Artificial Sequence
  derived and/or modified sequence opt3 from Tigatuzumab_HeavyChain1
gaggugcagcuggucgaaagcggcgggggacucguucaacccgguggcucccuuagacugucuugcgccgcuucaggguucaccuuuaguagcuacgugauguccuggguaaggcaggcaccuggaaagggcuuggaguggguggccacaaucucuucgggugggucauauacuuacuauccagacagcgucaaaggacgguucacgauuagucgcgauaacgcgaagaauaccuuauaccugcagaugaacucccuacgagcugaagacacagccguguauuacugugcacguagaggcgauucuaugauaacuaccgacuauuggggccaggggacacucguuaccgugagcuccgccucaacuaaaggaccgagugucuuuccccuggcuccuagcucuaaguccacaucagguggcaccgcagcccuugggugccuggugaaagauuacuucccagagcccguaacgguuagcuggaauaguggagcuuugacuucuggcgugcacaccuuuccugccguccuccaauccagcggucuguacucgcugucuuccguggugacagucccaucaaguagccucgggacucagaccuauaucuguaacguuaaucauaagcccuccaacacaaagguggacaaaaggguagaaccuaagucuugcgauaaaacccacacguguccaccgugccccgcgccugaguuacugggaggcccaagcguguuccuuuuucccccuaagccaaaagacacuuugaugauuucacggacacccgaggucaccugugugguuguggaugucagucaugaagacccggaggugaaguucaauugguacguagauggcguugaagugcacaacgcaaagacuaaaccucgcgaggagcaguauaauuccacauacagagucgugagcguccugaccgugcuacaucaggacuggcucaacgggaaggaauauaaaugcaagguuucuaauaaagcccugcccgcuccaaucgagaagacgauuucaaaagccaagggacaaccuagggaaccccagguguacacccuuccacccagucgggaggaaaugacaaagaaccagguaagccugacuuguuuggucaaagguuuuuauccuuccgauaucgcaguggagugggagucuaauggccagccagaaaacaauuacaagaccacaccgcccguucucgacucggacgggagcuucuuucuguacuccaaauuaacuguggauaagucacgcuggcaacagggaaacgucuucaguugcucugugaugcacgaggcucugcacaaccauuauacccagaaaagccucucccuuucaccuggcaag

SEQ ID NO: 23792 - RNA, 1347 nt, Artificial Sequence; identical to SEQ ID NO: 23791
  derived and/or modified sequence opt3 from Tigatuzumab_HeavyChain

SEQ ID NO: 23793 - RNA, 639 nt, Artificial Sequence
  derived and/or modified sequence opt3 from Tigatuzumab_LightChain1
gacauccagaugacccaaagccccuccucucugucagccagugugggcgauagagucacaauuacuugcaaggcuagccaggacguugggacggcaguggccugguaccagcagaaaccuggaaaggcgccaaaacuccuuauauauugggcuuccaccaggcacacagguguaccgucucgguucucgggcucagggagcggaacugauuuuacccugacaaucaguuccuugcaacccgaggacuucgccaccuacuauugucagcaguacucuagcuaucgcacuuuuggccaggguacaaagguggaaauuaaacgaaccgucgcagccccuuccguguucaucuuuccacccucagaugagcaauuaaagagugggacggcuagcguugugugccugcuaaacaauuucuacccucgugaagcaaagguccaguggaaaguggacaacgcccuccagucuggaaauucccaggagucaguaacugaacaagauagcaaggacaguaccuauucucuguccagcacacuuacucugucgaaagcugauuacgagaagcauaaaguuuacgccugugaggugacccaccagggcuugucuuccccagucacaaagucauuuaacagaggcgaaugc

SEQ ID NO: 23794 - RNA, 639 nt, Artificial Sequence; identical to SEQ ID NO: 23793
  derived and/or modified sequence opt3 from Tigatuzumab_LightChain

SEQ ID NO: 23795 - RNA, 1338 nt, Artificial Sequence
  derived and/or modified sequence opt3 from Tildrakizumab_HeavyChain1
caggugcaacugguccagagcggcgccgagguuaagaaacccggggcuuccgugaagguaucuugcaaagcaucaggauacaucuucauuaccuauuggaugacaugggugagacaggccccuggucagggccucgaauggauggggcaaauauuuccagcgaguggaagcgcugacuacaacgagaaguucgaaggcagggucacuaugacgaccgauacauccacuucuaccgccuauauggagcuucggucgcugcgcucagacgauacagcaguguacuauugugcccgaggugggggaggcuuugcuuacuggggccaggggaccuugguuacugugagcagugcauccacaaaaggaccgucugucuuccccuuagccccuagcuccaagucaaccagugguggcacggcugcccuggggugccuagugaaggacuauuuuccagaacccguaacuguuagcuggaacucuggagcgcucaccuccggcgugcacacauucccugcaguccugcagucaagcggucuuuacagucugucuuccguggugacugucccaagcucgucuuuggggacccagacauacaucuguaauguuaaucauaaacccuccaacaccaagguggauaaaaagguagagccuaaaucaugcgacaagacgcacacuuguccaccgugccccgccccugagcuccugggaggcccaaguguguuucuguuucccccuaagccaaaagauacacucaugauuagccguacccccgaagucacuugugugguuguggacgucucccaugaggauccggaagugaaguucaauugguauguagacggcguugaggugcacaacgcuaaaacaaagccuagagaggaacaauacaauucuaccuauagggucgugagcgucuuaacggugcugcaucaggauuggcuuaacgggaaagaguacaagugcaaaguuucaaauaaggccuugcccgcaccaaucgaaaagaccauuaguaaagcuaagggacagccucgggagccccagguguauacacugccacccucccgcgacgaacuaacuaaaaaccaaguaagccucaccugucuggucaaggguuucuacccuucugauaucgccguggagugggagucaaauggccagccagaaaacaauuauaaaacaacuccgcccguucuugacagugacgggagcuuuuuccuguacuccaaguugaccguggauaagucuagauggcagcaaggaaacgucuuuucgugcagcgugaugcacgaggcgcuccacaaucauuacacacagaaaucccugucauuaaguccuggcaag

SEQ ID NO: 23796 - RNA, 642 nt, Artificial Sequence
  derived and/or modified sequence opt3 from Tildrakizumab_LightChain1
gacauccagaugacccaaagccccuccucucugucagccagugugggcgauagagucacaauuacuugcaggacgagcgagaacauauacuccuaucucgcuugguaccagcagaagccugggaaagcaccaaaacuucugaucuauaaugccaagaccuuggcggaaggaguuccgucucgguucucggguucaggcagcgggacagacuuuacuuuaaccauuaguucccugcagcccgaggauuucgcuacauacuauugucaacaccauuacggaaucccuuuuaccuucggccaggguacuaagguggaaauuaaacgcacaguagccgcaccaucuguguuuaucuuucccccuagcgacgagcagcuaaaguccgggaccgccucagucgugugccuccugaacaauuucuauccacgagaagcuaagguucaguggaaaguggauaacgcacuucaaaguggaaauagccaggagucugucacggagcaggacuccaaggauucaacuuacagccugaguucuaccuugacacucuccaaagccgacuacgaaaagcacaaaguguaugcuugugagguaacucaucagggccugagcucgcccguuaccaagucuuucaaccguggcgaaugc

SEQ ID NO: 23797 - RNA, 1344 nt, Artificial Sequence
  derived and/or modified sequence opt3 from Tisotumab_vedotin_HeavyChain1
gaggugcagcugcucgaaagcggcgggggacuuguccaacccgguggcucccugagauugucuugcgccgcuucaggguucaccuuuaguaacuacgcaaugagcuggguuaggcaggccccuggaaagggcuuagaguggguguccucuaucucggguucaggggacuauacauacuauacugauagcguaaaaggacgguucacgauuagucgcgacaauuccaagaacacccuguaccuacagaugaauagccuccgagcggaagauacagcuguguauuacugugcccguucuccauggggcuauuaccuggacuccuggggccaggggacucuugucaccgugucaagugcaagcacaaaaggaccgucuguuuuuccccuggccccuuccucaaagagcaccagugguggcacugcugcauuggggugccucgugaaagauuacuucccagagcccgucacagugucuuggaacuccggagcccugaccagcggcguacacacguuuccugcuguucugcaaucgucuggucucuauuccuuaucaaguguggucacugugccaagcuccucucuggggacccagacauacauauguaaugugaaccauaagcccagcaauacuaaggucgacaaaagaguugaaccuaagucaugcgauaaaacccacacauguccaccgugccccgccccugagcuuuugggaggcccaaguguguuccuguuucccccuaagccaaaagacacccuaaugaucuccaggacgcccgagguaacuuguguggucguggauguuagccaugaagacccggaggugaaguucaacugguaugucgauggcguggaaguacacaaugcgaagacaaaaccucgggaggagcaguacaacucuaccuaucgcguugugucaguccucacugugcugcaucaggacuggcuuaaugggaaggaauacaaaugcaaggucaguaacaaagcacugcccgccccaauugagaagacaaucagcaaagcuaagggacaaccuagagaaccccagguguauaccuugccacccuccagggaggaaaugacgaagaaucagguuucucucaccugucuggugaaagguuuuuacccuucggauauugccguagagugggagagcaacggccagccagaaaauaacuacaagacaacuccgcccgucuuagacuccgacgggucauucuuucuguauaguaaacucaccguggauaagucucgguggcaacagggaaacguuuucagcugcuccgugaugcacgaggcacuucacaaucauuacacacagaaaucacugagcuugucuccuggcaag

SEQ ID NO: 23798 - RNA, 642 nt, Artificial Sequence
  derived and/or modified sequence opt3 from Tisotumab_vedotin_LightChain1
gacauccagaugacccaaagcccucccucccugucugccucagcuggcgauagagugacaauuacuugcagggcaagucaggggauaagcucccggcucgccugguaccagcagaagccagagaaagcgccgaagucucuuaucuaugcugccucgucacugcaaagcggaguccccagucgcuucuccgguucuggcagcgggacggacuuuaccuugacaauuuccucauuacagccugaagauuucgcaacuuacuauugucagcaguacaacaguuauccauacaccuuuggacaaggcacaaaacuggagaucaagcgaaccguugccgcucccagcguguucauuuuuccuccaucugacgaacagcuaaaauccgguacugcaucaguagugugccuccugaauaacuucuauccccgugaggccaagguccaguggaagguggauaaugcccuucagagcgggaacagucaagaaucuguuacagagcaggacuccaaagauagcaccuacucgcugucuuccacguugacucucucaaaggcugacuacgagaaacacaagguguaugcgugugaagucacccaucagggacugaguagcccugugacaaaauccuuuaauagaggcgagugc

SEQ ID NO: 23799 - RNA, 1341 nt, Artificial Sequence
  derived and/or modified sequence opt3 from Tocilizumab_HeavyChain1
gugcagcugcaagagagcggccccgggcucgucagaccuucccagacccuuucucugacaugcacuguuucaggauacaguaucacgagcgaccacgccugguccugggugaggcagccaccgggucggggcuuggaauggauuggguauauaucuuacucgggaaucaccacauauaaccccucauuaaaaagccgcguaacuaugcugcgagauaccaguaaaaaucaguucucccuacgucucucuagcgugacagcugcagacaccgccgucuacuauugugcgagaucccuggcuaggacuacagccauggauuacuggggccaagguucacuugugaccguuaguagcgcaucuacgaaggggccuuccguguuuccacuggcccccucaagcaaaaguacuucuggaggcaccgcugcauugggcugccucgucaaggacuauuucccugagccagugacaguauccuggaacagcggggcccugacuucgggaguucauaccuuucccgcugugcugcagucuuccggucucuacucauuaaguagcgucgugacagugccuuccucuagccugggcacccagacguacauuuguaaugucaaccacaaaccaucaaauacuaagguugauaagaaaguggaaccgaagaguugcgacaaaacacauaccugucccccuugcccagcccccgagcuuuugggagggccuuccguauuccuguuuccacccaagccgaaagauacucuaaugaucagccggacaccugaagugaccugugucgugguugacgugucucacgaggaucccgaggucaaguucaacugguauguggacggcguagaaguucauaaugcgaagacgaaaccacgcgaggaacaguacaacucaaccuauagaguggucagugugcucacaguccugcaccaagauuggcuuaaugguaaggaguacaaaugcaaggugagcaacaaagcacugccugcccccauugagaagacuaucuccaaagcuaaggggcagccaagggaaccccagguuuauaccuugccuccaucucgggacgagcucacaaagaaucaggugucgcugacuuguuuaguaaaaggauuuuacccgagcgauauagccgucgaaugggaguccaacggccaacccgaaaauaacuauaagaccacaccuccagugcuggacucagacggcaguuucuuucucuacucuaaacuuaccguugauaagagccgcuggcagcaggggaauguguucuccugcucagucaugcacgaggcacugcauaaccacuacacucaaaagagcuugucucuaucccccgga

SEQ ID NO: 23800 - RNA, 642 nt, Artificial Sequence
  derived and/or modified sequence opt3 from Tocilizumab_LightChain1
gacauccagaugacccaaagccccuccucucugucagccagugugggcgauagagucacaauuacuugcagggcuagccaggacauauccucuuaccucaacugguaucagcagaagccugggaaagcaccaaaacuucugaucuacuauacgucgcgguugcacucaggaguuccgagccgcuucagugguuccggcucugggaccgauuuuacauucacuauuagcuccuuacaacccgaggacaucgccaccuacuauugucagcagggaaauacacugccuuacaccuuuggccaggguacuaagguggaaauuaagcgaacaguagcggcuccaucaguguucaucuuucccccuagugaugagcaacuaaaaagcgggaccgccucugucgugugccuccugaacaauuucuauccacgugaagcaaagguucaguggaagguggacaacgcccuucaguccggaaauucacaggagagcgucacggaacaagauaguaaagacucuacuuacucccugagcucgaccuugacacucucuaaggcugauuacgagaaacauaagguguaugcaugugagguaacucaccagggccuguccucacccguuaccaaaaguuuuaacagaggcgaaugc

SEQ ID NO: 23801 - RNA, 1353 nt, Artificial Sequence
  derived and/or modified sequence opt3 from Tosatoxumab_HeavyChain1
gaagugcagaugguccaaagcggcgccgaaguuaagaaacccggggagccucugaagaucuccugcaaaggaucugguuacaaguucggcacccacuggauugggugggugagacagaggccaggaaaaggccucgaauggauggguauaauccauccggcugacucagagacaaaguauagucccagcuuucaggggcagguauccuucucugcagauaagucgucaaacacugccuaccuucacuggagcacgcugcgggcgagugacaccgcuauguauuacugugcccgccgauccggaucuagcuccugguaugcauuggauuuuuggggccaaggcacaauggugacugucucaagugccagcaccaaagggccuucuguguucccauuagcucccuccucaaagagcacaaguggagguaccgcagcccugggcugccuaguuaaagacuacuuuccugaaccagugacugucucuuggaacuccggggcucucacaagcggagugcauaccuuccccgccguacugcagucgucuggccuuuauucccugucaaguguugugacggucccuagcuccucuuuggguacucagaccuacauuuguaaugugaaucacaagccaagcaacacaaaaguggauaagcgugucgagccgaagucaugcgacaaaacucauaccugucccccuugcccagcgcccgagcuccucgggggaccuaguguuuuucuguucccacccaagccgaaagauacacugaugaucuccagaaccccugaagugacguguguaguggucgacgugagccacgaggaucccgaaguuaaguuuaauugguacguggacggcgucgaggugcacaacgcaaaaacuaagccaagggaggaacaguauaauucuacauaccggguaguuucaguguuaaccguccugcaucaagauuggcuuaacggcaaagaguauaagugcaaggugaguaauaaagccuugccugcucccauugaaaagacuaucagcaaagccaaggggcagccacgcgagccccaggucuacacacugccuccauccagagaagagaugaccaaaaaccaggugucucuaacgugucucguuaagggauucuauccgucggacauagcaguggagugggaaagcaauggucaacccgagaacaauuacaagaccacaccuccaguacuggauuccgacggcucauuuuuccuuuauaguaaacugacugucgacaagucuagguggcagcaggggaacguguuuagcugcuccguuaugcacgaggcuuugcauaaucacuacacccaaaaaucacucagccugucucccggaaag

SEQ ID NO: 23802 - RNA, 651 nt, Artificial Sequence
  derived and/or modified sequence opt3 from Tosatoxumab_LightChain1
cagagcgugcugacccaaucccccucugccucaggcacaccugggcagagagucacuaucaguugcagcggagguuccucuaacauuggcucgaauacgguuaacugguaccagcaguucccaggggcugcaccgaagcuccuuauauauaccaauaaccaaaggcccucaggagugccugaccgguuuagcggcaguaaauccgguacaucugccagccuggcgaucuccggguugcagucagaggaugaagcugacuacuauugugccacuugggaugacaguuuaaauggacuguacguauucggcaccggcacaaaggugaccguccuagggcagccaaaagcaaaccccacugugacacucuuuccuccaagcucugaggaacugcaggccaauaaggcuacccuuguuugccugauuuccgauuucuaucccggagcagugacggucgccuggaaagcugacgguucaccugugaaggccggcguagagacuaccaagccaagcaaacaaaguaacaauaaguacgcggcaucuuccuauuugagccucacaccggaacaguggaaaucgcaccgcucuuacuccugucagguuacucaugaggggucaaccguggagaagacagucgcccccaccgaaugcagu

SEQ ID NO: 23803 - RNA, 1341 nt, Artificial Sequence
  derived and/or modified sequence opt3 from Tositumomab_HeavyChain
caggccuaccugcaacagagcggcgcugagcucgugagacccggggcauccgucaagaugucuugcaaagccucaggauauaccuucacaaguuacaacaugcacuggguuaagcagacuccuaggcagggucuugaauggaucggcgcgauuuauccagggaauggagacacgagcuacaaccaaaaauuuaagggcaaagcuacccugacaguggauaaguccucuucgacugccuauaugcaguugagcucauuaaccagugaggacuccgcaguauacuucugugcccggguggucuauuacucuaauagcuacugguauuuugaugugugggguacagggaccacuguuacaguguccggaccgucagucuucccccuggcuccuaguagcaagucuaccuccggcggcacggcagcccuagggugccucgugaaagacuacuuuccagaacccguaacuguuucauggaacagcggagcucugaccaguggugugcauacauucccugccguccuucagucuuccggccuguauagcuugucgucuguggugacugucccauccucaagucucgggacccagacauacauauguaauguuaaccacaagcccagcaauaccaaaguggauaagaaagcggagccuaaguccugcgacaagacgcauacuuguccaccgugccccgcaccugaacugcugggaggcccaucuguauuucucuuucccccuaaaccaaaggauacauuaaugaucagccgcacccccgaggugacuugugucgugguugacgugucacacgaggauccggaagucaaauucaacugguauguggacgguguagagguucauaaugccaagacaaaaccucgagaagaacaauacaacaguaccuaucguguggucuccgugcugacgguccuucaccaggauugguugaaugggaaggaguacaaaugcaaggugagcaacaaggcucugcccgccccaauugagaaaaccaucucuaaggcaaaaggacagccuagagagccccagguuuacacacuaccacccucaagggacgaacucacuaagaaucaagugagucugaccugucuuguaaaaggcuucuauccuagcgauauugcugucgagugggaauccaacggccagccagagaauaacuacaagacaacuccgcccgugcuggacucugacgggucguuuuucuuguauagcaagcucaccguugauaaaucccgguggcagcaaggaaacguguuuucaugcagugucaugcacgaggcccugcauaaucacuacacacagaagucuuuaagccuguccccugguaaa

SEQ ID NO: 23804 - RNA, 630 nt, Artificial Sequence
  derived and/or modified sequence opt3 from Tositumomab_LightChain
cagaucgugcugagccaaucccccgccauucucucugcuucaccuggcgagaaggucaccaugacaugcagagcaaguagcuccguuucuuacaugcacugguaucagcagaaaccagggucgucaccgaagcccuggauauacgccccuagcaaccuugcgaguggagugccagcuagguucuccgguucuggcagcgggacuuccuauucacugacgaucagucggguagaagccgaggacgcagccaccuacuauugucagcaauggagcuuuaaucccccuacauucggagcuggcacuaaauuggaauuaaagcgcaccguggcagccccaucugucuuuauuuuucccccuuccgaugagcagcugaaaucagguacagcuagcgugguuugccuacucaacaauuucuacccacgagaagccaaggugcaguggaaggucgacaacgcgcugcagaguggaaauucucaagaguccgugaccgagcaggauagcaaagacucgacuuauucucuuuccucaacacugaccuugaguaaggcagauuacgaaaaacauaagguauacgccugugagguuacgcaccaggggcucagcuccccggugacuaaaucuuucaaccgu

SEQ ID NO: 23805 - RNA, 1338 nt, Artificial Sequence
  derived and/or modified sequence opt3 from Tovetumab_HeavyChain1
caggugcaacuggucgagagcggcgggggacucguuaagcccgguggcucccuuagacugucuugcgccgcuucaggguucaccuuuagugacuacuauaugaacuggaucaggcaggcaccuggaaaaggcuuggaaugggugagcuacauuuccucuucggguucaauaaucuauuacgccgauagcguaaaggggcgguucacaauuagucgcgacaaugcgaaaaacuccuuauaucugcagaugaauagucuacgagcugaggauacugccguguacuauugugcacgugaaggaagaaucgccgcuaggggcauggacgucuggggccaggggacgaccgugacaguuagcuccgcaucaacuaagggaccaaguguguuuccgcucgcccccugcagccggucuaccuccgagucaacagcugcccuggguugucuugucaaagauuacuucccugaaccagugaccguaagcuggaacaguggcgcgcugacuucugggguucacacauuucccgcaguguugcaauccagcggacucuacucgcugucuuccgucgugaccgugccuucaaguaauuucggcacgcagacuuauaccugcaacgucgaccauaagccaagcaauacaaagguugauaaaacuguggagcgcaaguguugcguagagugucccccuugcccagccccgcccguggcugguccuuccgucuuucuguucccacccaaaccuaaggacacccucaugauuucuagaacaccagaagugaccuguguuguggucgaugugagccacgaggaccccgaaguacaguuuaacugguacguugaugggguggagguccauaaugccaaaacgaagccgagggaggaacaguucaacucaacuuuucggguggucaguguguuaacaguugugcaccaagacuggcugaauggaaaggaguauaaaugcaagguauccaacaaaggccuuccugcacccaucgaaaagaccauaagcaaaacuaagggccagccacgcgagccucaggucuacacauugcccccaucucgagaagagaugaccaaaaaucaggugucacugacgugucuaguuaagggguucuaucccagugauaucgcuguggagugggaaagcaacggacaaccugagaauaacuacaagaccacaccaccgaugcucgacuccgacgguucguuuuuccuguauucuaaacuuacugucgauaagagcagauggcagcagggcaacguguucuccugcucaguaaugcaugaagcccugcacaaucacuacacccaaaaaucuuugucucucagccccgggaag

SEQ ID NO: 23806 - RNA, 645 nt, Artificial Sequence
  derived and/or modified sequence opt3 from Tovetumab_LightChain1
gacauccagaugacccaaagccccuccucucugucagccagugugggcgauagagucagcauuacaugcaggccuucccagucuuucucgcgguacauaaacugguaucagcagaagccagggaaagcuccgaagcuccuuauccacgcagccucaagccugguuggaggugugcccagucgcuuuuccggcucugggagcggaacugacuucacguugaccauuuccucauuacaaccugaggauuuugcgacauacuauugucagcagacuuacaguaauccacccaucaccuucggccaggguacacgacuggaaaugaaacguaccguagcugccccuagcguguuuauuuucccacccucugacgagcaacuaaaguccgggacugcaucagucgugugccuccugaacaauuuuuauccuagagaagccaaaguucaguggaagguggauaacgcacuucagagcggaaauagucaggagucugucacagaacaagacuccaaggauagcaccuacucgcugucuuccacguugacucucucaaaagcugacuaugagaagcauaaaguguacgccugugagguaacccaccagggccugaguagcccaguuacaaaguccuucaacaggggcgaaugc

SEQ ID NO: 23807 - RNA, 1347 nt, Artificial Sequence
  derived and/or modified sequence opt3 from Tralokinumab_HeavyChain1
caggugcaacugguccagagcggcgccgagguuaagaaacccggggcuuccgugaagguaucuugcaaagcaucaggauacaccuucacaaacuauggucucaguugggugagacaggccccuggccaggggcuugaauggaugggauggaucagcgcgaauaacggcgacacuaauuacggucaagaguuucaggggagggucacgaugaccacagauacuuccaccucuacagcuuauauggaacugcggucguugcgcucagacgauaccgccguguacuauugugcacgagacagcaguuccucuugggcccguugguucuuugauuuauggggaagaggcacucugguuacagugagcuccgcuucaaccaagggcccaagugucuucccgcuagcacccugcagcaggucuacguccgagucaacugccgcucucgggugucuggugaaagacuacuuuccugaaccaguaaccguuagcuggaacaguggagcccuuacaucuggugugcacacuuuccccgcgguccugcaguccagcggcuuguauucgcucucuuccguggugaccgucccuucaaguagccuggggacaaagaccuacacgugcaauguugaucauaagccauccaacacuaaaguggacaagcggguagagucuaaauacggacccccuuguccaagcugcccggcacccgaguuucugggcgguccuucaguguuccucuuuccacccaagccuaaagauacauuaaugauuagucgcaccccagaagucacuugugugguuguggacgucucccaggaggaucccgaagugcaauucaauugguauguagacgggguugaggugcacaacgccaagacaaagccgagagaggaacaguuuaauagcaccuacagggucgugucuguccugacggugcuucaucaggauugguugaacggaaaagaguauaagugcaaaguuucaaauaagggccugccuaguagcauagagaaaaccaucuccaaggcuaaaggccagccccgggaaccacaaguguacacacuaccucccucucaggaagagaugacuaagaaccagguaucgcucaccugucuggucaagggguucuauccaagcgacauugccguggagugggaauccaauggacaacccgagaacaauuacaaaacaacuccuccaguucuugacucagaugguaguuucuuucuguauucucgcuugaccguggacaagagccgauggcaggaaggcaacgucuucuccugcucagugaugcacgaggcacuccauaaccacuacacacagaaaagccugucuuuaucccuggggaag

SEQ ID NO: 23808 - RNA, 642 nt, Artificial Sequence
  derived and/or modified sequence opt3 from Tralokinumab_LightChain1
agcuacgugcugacccagcccccuuccgucucuguugccccaggcaagacagcuagaaucacuugcgggggaaacauuauagguucaaaacucgugcacugguaucaacagaagccgggccaggcacccguacuugugaucuacgacgauggggacaggccuaguggcauuccagagcgguucagcggauccaauucugguaacacggccacccugacaaucucgcgcgucgaagcgggggaugaggcugacuauuacugucaggugugggauacuggaucagaccccguuguguuuggcggcgggaccaaauugacagucuuaggacaaccuaaggccgcaccaagcgugacccuguuucccccuaguuccgaggaacuacaggccaauaaagcuacucucguaugccugauuucugauuucuauccaggugcaguuacaguggccuggaaggcugacagcuccccggucaaggccggcguggaaaccacgacucccucaaaacagaguaacaauaaguacgcggcaagcucuuaucuuucccugaccccugagcaguggaaaucacaucgaagcuacaguugucaagugacacacgaggggucuacugucgaaaagaccguugccccaacagagugcucc

SEQ ID NO: 23809 - RNA, 1332 nt, Artificial Sequence
  derived and/or modified sequence opt3 from Trastuzuab_HeavyChain1
gaggugcagcuggucgaaagcggcgggggacucguucaacccgguggcucccuuagacugucuugcgccgcuucaggguucaacaucaaggacaccuacauucacugggugaggcaggcaccuggaaaaggcuuggaguggguagcccggauauauccaacaaaugguuacacucgcuaugcggauagugugaaggggcgauuuacgaucagcgcugacaccuccaaaaacacagccuacuuacagaauagccugcgugcagaagauacugccgucuauuacuguucgagauggggaggcgacggcuucuaugcugauuacugggggcagggaacccuagugacaguuucaagcgcaaguaccaaggguccguccguguuuccccucgccccuucuagcaaauccacuucaggcgggacagcugcccugggaugccuugucaaggacuacuucccagagcccgugaccguaaguuggaacagcggcgcgcugacgucugguguucauacuuuuccugcaguguugcaauccucagggcucuauagccugaguucugucgugaccgugccauccagcucgcugggaacacagacuuacauuuguaaugucaaccacaagcccucuaauaccaaaguugauaagaaaguggaaccuaaguccugcgacaaaacacauaccuguccaccgugccccgccccugagcucuuaggcggcccaucaguauuccuguuucccccuaagccaaaggauacgcuuaucaguaggacucccgaggugacaugugucgugguugacgugagccacgaagauccggaggucaaauucaacugguauguggacgggguagaaguucauaaugcuaagaccaaaccucgggaggagcaguacaacuccacuuaucgcguggucucuguguugacaguccugcaccaggauuggcuaaauggaaaggaauacaaaugcaaggugagcaacaaagcccuccccgcaccaauugagaagaccaucucaaaggcuaaaggucaaccuagagaaccccagguuuauacgcugccacccaguagggaggaaaccaagaaucaggugucccuuacaugucugguaaaaggcuuuuacccuagcgacauagccgucgagugggagucuaacgggcagccagaaaauaacuacaagacuaccccgcccguguuggacucagauggaaguuucuuucucuauagcaaacugacaguugacaagucccgguggcaacagggcaacguguucucuugcucgguccacgaggcguuacauaaucacuacacucagaagucucugucccucucaccuggu

SEQ ID NO: 23810 - RNA, 639 nt, Artificial Sequence
  derived and/or modified sequence opt3 from Trastuzuab_LightChain1
gacauccagacccaaagccccuccucucugucagccagugugggcgauagagucacaauuacuugcagggcuagccaggacguuaacacggcaguggccugguaccagcagaagccugggaaagcgccaaagcuccuuauauauuccgcuucuuuccuguacucgggaguaccgucacgguuuagcgguagucgcuccggcaccgauuucacauugacuaucucuagcuuacaacccgaggacuuugccaccuauuacugucagcagcacuauacaaccccuccaacuuucgggcagggaacaaaaguggaaauuaagcgaaccgucgcagcccccuccguguuuaucuucccuccaucagaugagcaacugaaaaguggcacggcuagcguugugugccuacucaauaacuuuuacccccgugaagcaaagguccaguggaagguggacaaugcccugcagucugguaacucccaggagucaguaacugaacaagauagcaaagacaguaccuauucucuuuccagcacacugacuuugucgaaggcugauuacgagaaacauaagguuuacgccugugaggugacccaccaggggcucucuuccccugucacaaaaucauucaauagaggagaaugc

SEQ ID NO: 23811 - RNA, 1347 nt, Artificial Sequence
  derived and/or modified sequence opt3 from Trastuzumab_emtansine_HeavyChain1
gaggugcagcuggucgaaagcggcgggggacucguucaacccgguggcucccuuagacugucuugcgccgcuucaggguucaacaucaaggacaccuacauucacugggugaggcaggcaccuggaaaaggcuuggaguggguagcccggauauauccaacaaaugguuacacucgcuaugcggauagugugaaggggcgauuuacgaucagcgcugacaccuccaaaaacacagccuacuuacagaugaauagccugcgugcagaagauacugccgucuauuacuguucgagauggggaggcgacggcuucuaugcuauggauuacugggggcagggaacccuagugacaguuucaagcgcaaguaccaaggguccguccguguuuccccucgccccuucuagcaaauccacuucaggcgggacagcugcccugggaugccuugucaaggacuacuucccagagcccgugaccguaaguuggaacagcggcgcgcugacgucugguguucauacuuuuccugcaguguugcaauccucagggcucuauagccugaguucugucgugaccgugccauccagcucgcugggaacacagacuuacauuuguaaugucaaccacaagcccucuaauaccaaaguugauaagaaaguggaaccuaaguccugcgacaaaacacauaccuguccaccgugccccgccccugagcucuuaggcggcccaucaguauuccuguuucccccuaagccaaaggauacgcuuaugaucaguaggacucccgaggugacaugugucgugguugacgugagccacgaagauccggaggucaaauucaacugguauguggacgggguagaaguucauaaugcuaagaccaaaccucgggaggagcaguacaacuccacuuaucgcguggucucuguguugacaguccugcaccaggauuggcuaaauggaaaggaauacaaaugcaaggugagcaacaaagcccuccccgcaccaauugagaagaccaucucaaaggcuaaaggucaaccuagagaaccccagguuuauacgcugccacccaguagggaggaaaugaccaagaaucaggugucccuuacaugucugguaaaaggcuuuuacccuagcgacauagccgucgagugggagucuaacgggcagccagaaaauaacuacaagacuaccccgcccguguuggacucagauggaaguuucuuucucuauagcaaacugacaguugacaagucccgguggcaacagggcaacguguucucuugcucggucaugcacgaggcguuacauaaucacuacacucagaagucucugucccucucaccuggu

SEQ ID NO: 23812 - RNA, 642 nt, Artificial Sequence; identical to SEQ ID NO: 23668
  derived and/or modified sequence opt3 from Trastuzumab_emtansine_LightChain1

SEQ ID NO: 23813 - RNA, 1347 nt, Artificial Sequence; identical to SEQ ID NO: 23811
  derived and/or modified sequence opt3 from Trastuzumab_HeavyChain1

SEQ ID NO: 23814 - RNA, 1353 nt, Artificial Sequence
  derived and/or modified sequence opt3 from Trastuzumab_HeavyChain
gaggugcagcuggucgaaagcggcgggggacucguucaacccgguggcucccuuagacugucuugcgccgcuucaggguucaacaucaaggacaccuacauucacugggugaggcaggcaccuggaaaaggcuuggaguggguagcccggauauauccaacaaaugguuacacucgcuaugcggauagugugaaggggcgauuuacgaucagcgcugacaccuccaaaaacacagccuacuuacagaugaauagccugcgugcagaagauacugccgucuauuacuguucgagauggggaggcgacggcuucuaugcuauggauuacugggggcagggaacccuagugacaguuucaagcgcaaguaccaaggguccguccguguuuccccucgccccuucuagcaaauccacuucaggcgggacagcugcccugggaugccuugucaaggacuacuucccagagcccgugaccguaaguuggaacagcggcgcgcugacgucugguguucauacuuuuccugcaguguugcaauccucagggcucuauagccugaguucugucgugaccgugccauccagcucgcugggaacacagacuuacauuuguaaugucaaccacaagcccucuaauaccaaaguugauaagaaaguggaaccuccaaaguccugcgacaaaacacauaccuguccgcccugcccugccccagagcucuuaggcggccccucaguauuccuguuuccuccaaagcccaaggauacgcuuaugaucaguaggacuccggaggugacaugugucgugguugacgugagccacgaagauccugaggucaaauucaacugguauguggacgggguagaaguucauaaugcuaagaccaaaccccgggaggagcaguacaacuccacuuaucgcguggucucuguguugacaguccugcaccaggauuggcuaaauggaaaggaauacaaaugcaaggugagcaacaaagcccucccagcaccuauugagaagaccaucucaaaggcuaaaggucaacccagagaaccacagguuuauacgcugcccccuaguagggacgagcuuaccaagaaucaggugucccugacauguuugguaaaaggcuuuuacccaagcgacauagccgucgaaugggagucuaacgggcagccggagaauaacuacaagacuacacccccugugcucgauucagacggaaguuucuuucuguauagcaaauuaaccguugauaagucccgguggcaacagggcaacguguucucuugcucggucaugcacgaagcgcugcauaaucacuacacucagaagucucucucccuuucaccagguaaa

SEQ ID NO: 23815 - RNA, 660 nt, Artificial Sequence
  derived and/or modified sequence opt3 from Trastuzumab_HeavyChain_variant_1n8z_B
gaggugcagcuggucgaaagcggcgggggacucguucaacccgguggcucccuuagacugucuugcgccgcuucaggguucaacaucaaggacaccuacauucacugggugaggcaggcaccuggaaaaggcuuggaguggguagcccggauauauccaacaaaugguuacacucgcuaugcggauagugugaaggggcgauuuacgaucagcgcugacaccuccaaaaacacagccuacuuacagaugaacucucugcgugcagaagauacugccgucuauuacuguucgagauggggaggcgacggcuucuaugcuauggauuacugggggcagggaacccuagugacaguuucaagcgcaaguaccaaggguccguccguguuuccccucgccccuucuagcaaauccacuucaggcgggacagcugcccugggaugccuugucaaggacuacuucccagagcccgugaccguaaguuggaauagcggcgcgcugacgucugguguucauacuuuuccugcaguguugcaauccucagggcucuauagccugaguucugucgugaccgugccauccagcucgcugggaacacagacuuacauuuguaaugucaaccacaagcccucuaauaccaaaguugauaagaaaguggaaccu

SEQ ID NO: 23816 - RNA, 45 nt, Artificial Sequence
  derived and/or modified sequence opt3 from Trastuzumab_HeavyChain_variant_7637_H
gagcccaagagcugcgacaaaacccacacauguccuccaugcccg

SEQ ID NO: 23817 - RNA, 642 nt, Artificial Sequence; identical to SEQ ID NO: 23668
  derived and/or modified sequence opt3 from Trastuzumab_LightChain1

SEQ ID NO: 23818 - RNA, 642 nt, Artificial Sequence; identical to SEQ ID NO: 23668
  derived and/or modified sequence opt3 from Trastuzumab_LightChain_variant_1n8z_A

SEQ ID NO: 23819 - RNA, 642 nt, Artificial Sequence; identical to SEQ ID NO: 23668
  derived and/or modified sequence opt3 from Trastuzumab_LightChain_variant_7637_L

SEQ ID NO: 23820 - RNA, 1344 nt, Artificial Sequence
  derived and/or modified sequence opt3 from TRC-105_HeavyChain1
gaggugaagcuggaagagagcggcgggggacucguccagcccgguggcuccaugaaacuuucuugcgccgcuucaggguucaccuuuagugacgcauggauggauuggguuagacaaagcccugaaaagggacuggaguggguggccgaaaucagguccaaagcgucuaaccacgcuacauacuaugccgagucgguaaagggccgguucacuauuucacgcgacgauagcaaaaguuccguguacuugcagaugaauagcuuacgagcagaggacacggguauauauuacuguacccguuggagaagguuuuucgauucuugggggcagggaacaacucugaccgucuccucagccaguacaaagggcccaagcguguuuccgcuagcucccucuuccaagucaaccagcggcgggacugcagcccucggaugccugguuaaagacuauuucccugaaccagugacagucaguuggaacucuggugcucuuaccuccggcgugcauacguuucccgccguacugcagagcucgggguuguacucucucuccucaguugugacugucccuaguagcucccugggaacccaaacauauaucuguaaugugaaccacaagccaucuaauacuaaaguggauaagaaagucgagcccaagagcugcgacaagacccauacauguccuccaugcccggcgcccgaacugcucggcgguccuucaguuuucuuauuuccacccaaaccuaaggauacccugaugauuagucggacgccagaggugacuuguguaguggucgacgugucccacgaggaucccgaaguuaaauucaacugguacguggacggggucgaggugcauaaugcaaagacaaaaccgcgcgaggaacaguacaacagcaccuauagaguaguuucugugcuuacugucuugcaccaggauuggcugaauggaaaggaauacaaaugcaaggugucaaacaaggcccuaccugcucccaucgagaaaacaauuaguaaggccaaaggccagccaagggagccucaagucuauaccuuacccccaagccgggacgaacugacgaagaaucaggugucccuuaccugucugguuaaaggcuuuuaccccucugacaucgcaguggagugggaaucgaacgggcagccugagaauaacuauaagacaacuccaccgguauuggauagcgacggauccuucuuucucuacucaaagcugaccgucgauaaaagucgcuggcagcaagguaauguguucucuugcagcguuaugcacgaagcucuccauaaccacuauacacagaagucccugucacucagccccggcaaa

SEQ ID NO: 23821 - RNA, 639 nt, Artificial Sequence
  derived and/or modified sequence opt3 from TRC-105_LightChain1
cagaucgugcugagccaaucccccgccauucucucugcuucaccuggcgagaaggucaccaugacaugcagagcaaguagcuccguuucuuacaugcacugguaucagcagaaaccagggucgucaccgaagcccuggauauacgccacuagcaaccuugcgaguggagugccuguaagguucuccgguucuggcagcgggacguccuauucacugaccaucagucggguggaagcugaggacgccgcaacauacuauugucagcaauggagcucuaauccauugacuuuuggagccggcaccaaauuagaacugaagcgcacagucgcugcacccuccguguucauuuuuccuccaucagaugagcagcuaaaaagcgguaccgccaguguugugugccuccugaacaauuucuacccccgagaagcuaagguccaguggaagguggacaacgcccuucagucugggaauagccaagagagcguaacugagcaggauucgaaagacucuacauauucccugucaaguaccuugacgcucagcaaggcggauuacgaaaaacauaagguuuacgcaugugaggugacucaccagggacuguccucuccugucaccaaauccuuuaaccguggcgaaugc

SEQ ID NO: 23822 - RNA, 1362 nt, Artificial Sequence
  derived and/or modified sequence opt3 from Tregalizumab_HeavyChain1
gaggaacagcugguggagagcggcgggggacucgucaagcccgguggcucccuuagacugucuugcgccgcuucaggguucaguuuuagcgacuguaggauguacugguugcggcaagcaccuggaaaaggcuuagaauggaucgguguuauuuccgugaagucugagaacuauggggccaauuacgcggaaucgguacgcggacgauucaccauaucacgugaugacagcaaaaacacaguguaucugcagaugaauagucuaaagacugaggauacggcugucuacuauugcuccgccucuuacuauagauacgacgugggcgcaugguuugccuacuggggccaggggacccucguuacagugagcuccgcuucaacuaaaggaccaagugucuucccgcuggcacccagcucuaaguccaccucagguggcacagccgcucuugggugucuggugaaggauuauuuuccugagccaguaaccguuagcuggaacaguggagccuugacuucuggcgugcacacauuccccgcgguccuccaguccagcggucuguacucgcugucuuccguggugaccgucccuucaaguagccucgggacgcaaacuuauaucugcaauguuaaccauaaaccauccaauaccaagguggacaaaaagguagaacccaaaucuugugauaagacacacacuugcccuccauguccggcacccgaguuacugggaggcccuagcguguuucuuuucccacccaagccuaaagacaccuugaugauuucaaggacaccagaaguaaccugcgugguuguggaugucagucaugaggaccccgaggugaaguuuaacugguacguagauggcguugaagugcacaaugccaaaacgaagccgcgggaggaacaguauaacuccacuuaccgcgucgugagcguccugacagugcuacaucaggacuggcucaaugggaaagaguauaaguguaaaguuucuaacaaggcucugccugcccccaucgaaaagaccauuucaaaagcaaagggacagccaagagagccucaaguguacacucuucccccaaguagggaugagcugaccaaaaaucaggucagcuugacaugccucgucaaggguuucuaccccuccgacaucgcuguggaaugggagucuaacggccagccugaaaauaacuauaaaacgaccccaccgguucuggacucggaugggagcuuuuucuuauacuccaagcugacaguggacaagucacgguggcagcaaggaaacgucuuuaguuguucugugaugcacgaggcccuccacaaucauuauacucagaaaagccuuucccugucacccggcaag

SEQ ID NO: 23823 - RNA, 654 nt, Artificial Sequence
  derived and/or modified sequence opt3 from Tregalizumab_LightChain1
gacaucgugaugacccagagccccgauucccuggccgucucucucggcgagagagcuacaauuaacugcagggcaucaaagaguguuagcacuuccggguacucuuauauauacugguaucaacagaaaccuggacagccaccgaaacuucugaucuacuuggccucgauuuuagaaucaggugugcccgaccgguucagcggcaguggguccggaacggauuuuacccugacaaucucuagccuacaggcggaggacguagcuguguauuacugucaacacucccgcgaacucccuuggacuuucggccaggguaccaaggucgagauuaagcgaacaguggccgcaccaucaguuuuuaucuuucccccuagugaugaacagcugaaaagcgggaccgccucuguggucugccuucugaauaacuucuauccacgugaggcuaaggugcaguggaagguagacaaugcauugcaauccggaaacucacaggagagcguuacugaacaggauaguaaagacucuacauacucccucagcucgacccugacgcugucuaaggccgauuacgagaaacauaagguguaugcuugugaagucacucaccagggccucuccucacccgugaccaaaaguuucaauagaggcgagugc

SEQ ID NO: 23824 - RNA, 1353 nt, Artificial Sequence
  derived and/or modified sequence opt3 from Tremelimumab_HeavyChain1
caggugcaacuggucgagagcggcgggggaguugugcagcccgguagaucccucaggcuuucuugcgccgcuucaggcuucaccuuuaguagcuacgggaugcacuggguacggcaggcaccuggaaagggccuggaauggguggccgucaucugguaugacgguuccaacaaauacuaugcggauucugugaaggggcgcuucacaauuucgcgagacaauagcaaaaacacuuuguacuuacagaugaauagccugcgugcugaggauacggccguuuauuacugugcaagagacccaaggggagccacccuauauuacuacuauuacggcauggauguguggggccaagggacaacugucaccgugaguuccgcuucuacaaagggaccgagcguauuuccccucgcaccuugcucccggucaaccagugaaagcacugccgcucuggguugucuuguuaaagacuauuucccagagcccgugacagucucuuggaacuccggcgcccugaccucaggggugcauacguuuccugcgguguugcagagcaguggacucuacucucuguccagcgucguuacugugccaucgucuaauuucggcacccagacauauacuugcaacguagaucacaagcccuccaauaccaagguggacaaaacagucgaacgcaaguguugcguggaguguccuccaugcccggcacccccuguugccgguccaucaguguuucuguuucccccuaaaccaaaggauacccucaugauaaguagaacgcccgaggucacuugugugguaguugacgugagccaugaagauccggagguccaguuuaacugguacguggacggggucgaagugcacaaugcuaaaacaaagccuagggaggagcaauucaacuccaccuuucggguugugucuguauuaacugucgugcaucaggauuggcugaauggaaaggaauauaaaugcaagguuagcaacaaaggccuucccgccccaaucgagaagacaauuucaaaaaccaagggccagccucgcgaaccccagguguacacguugccacccagucgagaggaaaugaccaaaaaucaagucucccugacaugucuagugaagggguucuacccuagcgacaucgcaguagagugggagucuaacggacagccagaaaauaacuauaagacuaccccgcccaugcucgacucagaugguaguuucuuccuguacagcaaacuuacaguggacaaguccagauggcagcaaggcaacguuuucucuugcucggucaugcacgaggcucugcacaaucauuauacucagaaaucauugucccucucaccugggaag

SEQ ID NO: 23825 - RNA, 642 nt, Artificial Sequence
  derived and/or modified sequence opt3 from Tremelimumab_LightChain1
gacauccagaugacccaaagccccuccucucugucagccagugugggcgauagagucacaauuacuugcagggcuagccaguccauaaacucuuaccucgacugguaucagcagaagccugggaaagcaccaaaacuucugaucuacgccgcgucgucauugcaaagcggaguuccgagucgguucuccgguucuggcagcgggacggauuuuaccuuaacaauuuccucacugcagcccgaggacuucgcuacuuauuacugucagcaguauuacaguaccccuuuuacauucggaccaggcaccaagguggaaaucaagcgcacuguagccgcacccagcguguuuauuuucccuccaucugaugagcaacuaaaauccgguacagccucagucgugugccuccugaauaacuuuuauccccgagaagcuaagguucaguggaagguggacaaugcacuucagagcgggaacagucaggagucugucaccgaacaagauuccaaagacagcacguacucgcugucuuccacuuugacccucucaaaggccgauuacgagaaacacaagguguaugcuugugagguaacacaucagggacugaguagcccuguuacuaaauccuucaaucguggcgaaugc

SEQ ID NO: 23826 - RNA, 1341 nt, Artificial Sequence
  derived and/or modified sequence opt3 from Trevogrumab_HeavyChain1
gaggugcagguccuggaaagcggcggggaccucguucaacccggagguucccuuagacugucuugcgccgcuucaggcuucaccuuuagugcauacgccaugacaugggugaggcaggcgccugggaagggauuggaguggguaagcgcuaucuccggcucuggugggucggccuauuacgcagauucagugaaaggacgguucacuauuagccgcgacaacaguaagaauacggucuauuuacagaugaacucccugcgagccgaagauaccgcuguguacuauugugcaaaagacggcgccuggaagaugucuggccuagauguuugggggcagggaacaacugugauagucagcuccgcuucaaccaaagguccaaguguguuuccgcucgcccccugcagccguucuacauccgagucaaccgcggcacugggcugucuuguaaaggacuacuucccugaaccaguuacugugagcuggaauaguggggcccugacaucuggaguccacaccuuucccgcuguguugcaauccagcggccucuauucgcugucuuccguggucacgguuccuucaaguagccuggguacuaagaccuacacaugcaacguggaucauaaaccauccaauacuaagguagacaaaagaguggagucuaaguacgggcccccuuguccaccgugccccgccccugaguuccucggaggcccaagcgucuuuuuauuucccccuaaaccaaaggauacccugaugaucucaaggacacccgaagugaccuguguuguggucgacgugagucaggaggauccggaaguacaguucaacugguauguugacggcguggagguccacaaugcaaagacgaaaccucgggaggaacaguucaacuccacuuaccgcguggucagcgugcuuacaguuuugcaucaagauuggcugaaugggaaggaguauaaaugcaaggugucuaacaaaggacuacccucaaguauugaaaagaccaucagcaaagcuaagggucagccaagagagccucagguauacacucugcccccaucccaggaagagaugacaaagaaucaagucucucucaccugucuugugaaaggcuuuuaucccucggacauugccguugagugggaaagcaacgggcagccugagaauaacuacaagacgaccccaccggugcuggacuccgauggaucauucuuuuuguauaguaggcucacagucgacaaaucucgguggcaggaaggcaauguguucagcugcuccguaaugcacgaggcgcugcauaaccacuacacucaaaagucauuaagccugucucucgguaaa

SEQ ID NO: 23827 - RNA, 642 nt, Artificial Sequence
  derived and/or modified sequence opt3 from Trevogrumab_LightChain1
gacauccagaugacccaaagccccgccucccugucugcuucagugggcgauagagucacaauuacuugcagggcaagucaggacauaagcgauuaccucgccugguaucagcagaagccugggaaaaucccacggcuucugauuuacacgaccuccacauugcaaucuggaguuccgucgcgcuuccgagguucaggcagcgggacugacuuuaccuuaacaaucaguucccugcagcccgaggauguggcgaccuauuacugucagaaguaugacucugcuccucuaacuuucggaggcgguacaaaaguagaaauuaagcguaccguggccgcaccaagcgucuuuaucuuucccccuuccgaugagcagcucaaaucagggacggccagugugguuugccugcuuaacaauuucuacccaagagaagcuaaggugcaauggaaggucgacaacgcacugcagagcggaaauucucaggaguccgugacugaacaggauucaaaagacagcaccuauaguuugucuuccacacucacucugagcaaggccgauuacgagaaacacaagguauacgcuugugagguuacccaucaaggccugucgucucccgugacaaaauccuucaacaggggcgaaugc

SEQ ID NO: 23828 - RNA, 1737 nt, Artificial Sequence
  derived and/or modified sequence opt3 from Tucotuzumab_celmoleukin_HeavyChain1
cagauccaacuggugcagagcggcgccgaagucaagaaacccggggaaaccguuaagauuuccugcaaggcuucuggauacacauucacuaacuaugguaugaauugggugaaacagacgccuggcaaagggcucaaguggaugggauggauaaacaccuacacaggcgagccaacuuaugcagacgauuuuaaggguagauucgccuuuucacuugaaaccaguacaagcaccgcguuccugcagaucaauaacuugagguccgaggacacugcuacauacuuuuguguacgguucauuucuaaaggggauuauuggggacaaggcaccucggugacggucucaagcgccaguacuaagggcccguccguguuucccuuagcaccuucuagcaaauccaccucagggggaacagccgcucuggguugccuaguuaaggacuacuucccagaacccgugacugucaguuggaauagcggcgcacucaccucuggggugcacacauuuccugccguacugcaguccucaggacuuuauagccugaguucuguugugaccgucccauccagcucguugggcacgcagacuuacaucuguaacgugaaucauaaacccucuaacacaaagguggauaagcgcgucgagccuaaauccugcgacaagacccacacuuguccaccgugccccgcuccugagcuccugggugggccaucaguuuuccuguuucccccuaaaccaaaggauacacucaugauuagucgaacccccgaagugacguguguaguggucgacgugagccaugaggauccggaaguuaaauucaauugguacguggacggagucgaggugcacaacgccaagaccaaaccucgugaggaacaguauaauuccacauacagaguaguuucuguguuaacuguccugcaucaagauuggcuuaacggcaaggaguauaagugcaaagugagcaauaaggcguugcccgcaccaaucgagaaaaccauaucaaaggccaaaggccagccuagggaaccccaggucuacacacugccacccagucgggaagagaugacuaagaaccaggugucccuaaccugucucguuaagggguuuuauccuagcgacaucgcuguggagugggaaucuaauggacaaccagagaacaacuacaaaacaaccccgcccguacuggauucagacgguaguuucuuccuuuauagcaagcugacugucgacaaaucccgcuggcagcagggcaauguguuuucuugcucgguuaugcacgaagccuugcacaaccauuacacgcaaaagagccucucccugucaccugggaaagcaccaacaaguucuagcaccaagaagacucaguuacagcuggagcaccuccuucuggauuugcagaugauucuaaauggaaucaacaauuacaaaaaccccaagcugaccagaaugcucacauucaaauuuuauaugccuaagaaagcuaccgaacugaagcaucuucaaugucuggaggaggaauugaagccacucgaggaagugcugaauuuagcccaguccaaaaacuuccaccugaggccccgggaccuaauuucaaauaucaacgucauagugcucgagcugaagggcagcgaaacuacauuuaugugcgaguacgcggaugagacggccaccauuguagaguuccuuaaucgcuggaucacuuuuugccagucuauuaucuccacauugacc

SEQ ID NO: 23829 - RNA, 639 nt, Artificial Sequence
  derived and/or modified sequence opt3 from Tucotuzumab_celmoleukin_LightChain1
gagaucgugcugacccagagccccgccacacucucccuuucuccuggcgaaagagucacucugacgugcucagcuaguagcuccguuucuuacauguugugguaucaacagaagccagggucgucaccgaaacccuggauuuucgacaccagcaacuuagcaaguggauuuccugccagguucuccgguucuggcagcgggacauccuacucacugauaaucaguagcauggaggcggaagaugcugccacuuauuacugucaccagcggucuggauauccauacaccuuuggcggugggacaaagcuagagauuaaacgcaccguggcagcccccuccguauucaucuuuccuccaucagacgaacagcucaagagcggaacugcuaguguggucugccugcuuaauaacuucuauccccgagaggcaaaagugcaauggaagguugauaaugcccugcagucuggcaacucccaggagagcgugacagaacaggacucgaaggauucuaccuacuccuugucaaguacgcucacucugagcaaagcugacuacgagaagcauaaagucuaugccugugaagugacccaccaaggccuguccucuccuguaacaaagagcuuuaaucguggggagugc

SEQ ID NO: 23830 - RNA, 1344 nt, Artificial Sequence
  derived and/or modified sequence opt3 from Ublituximab_HeavyChain1
caggccuaccugcaacagagcggcgcugagcucgugagacccggggcauccgucaagaugucuugcaaagccucaggauauaccuucacaaguuacaacaugcacuggguuaagcagacuccuaggcagggucuugaauggaucggcgggauuuauccaggaaauggcgacacgagcuacaaccaaaaauuuaaggguaaagcgacccugacaguggggaaguccucuucgacugcuuauaugcaguugagcagcuuaaccagugaggauuccgccguauacuucugugcacgguaugacuacaauuacgccauggauuauuggggacagggcacaucugugaccgucagcuccgcuucaacuaagggcccgaguguguuuccccuggcaccuagcucuaaauccacaucagggggaaccgccgcucuagguugccucguuaaggacuacuucccagaacccgugacggucagcuggaacaguggcgcccugacuucuggggugcauaccuuuccugcgguacuucaguccagcggacuguauucguugucuuccguugugacagucccaucaaguagccucggcacucaaaccuacauauguaaugugaaccacaaacccuccaauacaaagguggauaaaaaggucgagccuaagucuugcgacaaaacccauacguguccaccgugccccgcaccugaacugcugggugggccaagcguuuuccucuuucccccuaagccaaaagauacuuuaaugaucucacgcacacccgaggugaccuguguaguggucgacgugagucacgaggauccggaaguuaaguucaacugguauguggacggagucgaggugcauaaugccaaaacuaagccucgagaggaacaguacaacuccacauaucguguaguuagcgugcugaccguccuucaccaggauugguugaauggcaaagaguacaagugcaaggugucuaacaaagcucugcccgccccaauugaaaagacgaucucaaaagcaaagggccagccuagagagccccaagucuacacccuaccacccaguagggacgaacucacuaaaaaucaggugagccugacaugucuuguuaagggguuuuauccuuccgauauugcuguggagugggaaucuaacggacagccagagaauaacuacaagaccacaccgcccguacuggacucggacgguagcuucuuuuuguauuccaaacucacugucgauaagucacgguggcaacagggcaacguguucaguugcucuguuaugcacgaggcccugcauaaucacuacacccagaaaucauuaucccugucaccugggaag

SEQ ID NO: 23831 - RNA, 639 nt, Artificial Sequence
  derived and/or modified sequence opt3 from Ublituximab_LightChain1
cagaucgugcugagccaaucccccgccauucucucugcuucaccuggcgagaaggucaccaugacaugcagagcaaguagcuccguuucuuacaugcacugguaucagcagaaaccagggucgucaccgaagcccuggauauacgccacuagcaaccuugcgaguggagugccugcuagguucuccgguucuggcagcgggacguccuauucauuuaccaucagucggguagaagccgaggacgcagccacauacuauugucagcaauggacuuucaauccacccaccuuuggaggcgguacacgccuggaaauuaaacgaaccguggcugcaccuagcgucuucaucuuuccacccucugaugagcaguugaaguccgggacugccucagugguuugcuuacugaacaauuucuacccucgugaagcuaaagugcaguggaaggucgacaacgcccuacagagcggaaauagucaagagucugugacagagcaggauuccaaggacagcaccuauucgcucucuuccacgcugacucuuucaaaagcggauuacgaaaagcauaaaguauacgcaugugagguuacccaccagggccugaguagcccagugacaaaguccuuuaacagaggcgaaugc

SEQ ID NO: 23832 - RNA, 1353 nt, Artificial Sequence
  derived and/or modified sequence opt3 from Ulocuplumab_HeavyChain1
gaggugcagcuggucgaaagcggcgggggacucguucaacccgguggcucccuuagacugucuugcgccgcugcaggguucaccuuuucaaguuacagcaugaacugggugaggcaggccccuggaaagggcuuggaguggguauccuauaucucuucgcggucacgcacaauuuacuaugcggacagcgugaaaggucgauucacuauaagucgugauaaugcuaagaacuccuuauaccugcagaugaacucucuaagagacgaagauacggccgucuauuacugugcaagggacuaugggggacagccaccguacuacuauuacuauggcauggauguguggggccaagggaccacaguuacugugagcuccgccucaaccaaaggacccagugucuuuccucucgcuccaugcagccggucuacauccgagucaaccgcagcccuggguugucuugugaaggacuacuuccccgaaccuguaacuguuagcuggaauaguggcgcucugacaucuggggugcacaccuuuccagccgucuugcaguccagcggacucuauucgcugucuuccguggugacgguccccucaaguagccugggcacuaaaaccuacacaugcaauguugaucauaagccuuccaacacuaagguggacaaacgcguagagucuaaguaugguccaccgugucccccuugcccagcgcccgaguuccucgggggaccuagcguguuuuuauucccacccaaaccgaaggauacccugaugaucucaagaacaccugaagucaccugugugguuguggacgucagucaggaggaucccgaagugcaguuuaauugguacguagacggcguugaggugcacaacgcaaaaacgaagccaagggaggaacaauucaauuccacuuaccgggucgugagcguccuuacaguguugcaucaggauuggcugaacggcaaggaguauaaaugcaagguuucuaauaaagggcuaccuucaaguauugaaaagaccaucagcaaagccaagggacagccccgcgagccacagguguacacucugcccccuucccaagaagagaugaccaaaaaccagguaucucucaccugucuugucaaggguuuuuauccaucggacauugcuguggagugggaaagcaauggccagccggagaacaauuacaagacgacacccccuguucuggacuccgaugggucauucuuuuuguauagucgacucacaguggacaaaucuagauggcaagaaggaaacgucuucagcugcuccgugaugcacgaggcccugcauaaccacuacacucagaagucauuaagccugucucucggc

SEQ ID NO: 23833 - RNA, 642 nt, Artificial Sequence
  derived and/or modified sequence opt3 from Ulocuplumab_LightChain1
gacauccagaugacccaaagccccuccucucugucagccagugugggcgauagagucacaauuacuugcagggcuagccaggggauauccucuuggcucgcaugguaccagcagaagccugagaaagccccaaagucgcuuaucuaugcggcuucaagccugcaaaguggaguuccgucccgguucucugguagcggcuccgggacggacuuuaccuugacaauuucaaguuuacagcccgaagauuucgugacuuacuauugucagcaguacaacagcuauccucgcaccuuuggacaaggcacaaaaguagagaucaagcgaaccguggccgcaccaucugucuucauuuuucccccuuccgacgaacagcugaaaucagguacugccagcgugguuugccuacucaauaacuucuacccacgugaggcuaaggugcaguggaaggucgauaaugcacugcagagugggaacucucaagaauccgugacagagcaggacagcaaagauucgaccuauucucuuuccucaacgcugacuuugaguaaggccgacuacgagaaacacaagguauacgcuugugaaguuacccaucagggacucagcucccccgugacaaaaucuuuuaauagaggcgagugc

SEQ ID NO: 23834 - RNA, 1344 nt, Artificial Sequence
  derived and/or modified sequence opt3 from Urelumab_HeavyChain1
caggugcaacugcagcaguggggcgccgggcuccuuaagcccagcgagacccuguccuugacaugcgcugucuacggagguucuuucucaggcuauuacuggaguuggaucagacagagcccugaaaaaggguuagaguggauuggagaaauaaaccacggcgguuauguuacuuacaauccaucccuggagucuagggugacgaucucgguagacaccucaaagaaccaauuuagccuaaaacucaguuccgugacagcagccgauacugcggucuauuacugugcucgggacuaugggccgggaaauuacgauugguacuucgaccuguggggccgcggcacccuugugacaguuucuagcgccuccaccaaggggcccucaguguuuccucuggcaccaugcagucgaagcacuucugaauccacagccgcuuugggaugucucgucaaagauuauuuccccgagccugugaccguaucauggaacagcggugcacugacgaguggcguucauacuuuuccagccgugcugcagucuuccgggcucuacagcuuaucgucugucgugaccgugcccuccucaagucugggaacaaagacuuauaccugcaaugucgaccacaagccuagcaacacaaaaguugauaagcguguggaguccaaauacggcccaccgugucccccuugcccagcucccgaguuccuuggugggccuucuguauuuuuguucccacccaagccgaaagacacccugaugauuagcagaacgccugaggugacuugugucgugguugaugugucacaggaagaccccgagguccaguuuaauugguauguggauggaguagagguucauaacgccaagacaaagccaagggaagaacaauucaauaguaccuaccggguggucuccgugcuaacuguccuccaccaggacuggcugaacggcaaagaauauaagugcaaagugagcaauaagggccuuccuucuucaaucgagaaaacaauuaguaaggcgaaagggcagccccgcgaaccacagguuuacacccugcccccuagccaagaggagaugacgaagaaccagguguccuugaccugucucguaaagggauuuuacccaucugauaucgcagucgaaugggagucgaauggucagccggaaaacaauuauaaaacaacucccccugugcuggacagcgacggcuccuucuuuuuauacucaagacugaccguugauaagaguagguggcaagaggggaacguguucucuugcagcgucaugcaugaagcccuccacaaccacuauacacagaaaucccuuucacugagcuugggaaag

SEQ ID NO: 23835 - RNA, 648 nt, Artificial Sequence
  derived and/or modified sequence opt3 from Urelumab_LightChain1
gagaucgugcugacccagagccccgccacacucucccuuucuccuggcgaaagagcuacucugucaugcagggcaagucaaagcgucuccucuuacuuggccugguaucagcagaagccagggcaggcgccgcgguuacugauuuacgacgcuucgaaccgcgccacgggaauacccgcacgauucucagguagcggcagugggaccgauuuuacacuaacuaucuccucucucgagccugaagacuucgccguuuauuacugucaacagcguagcaauuggccacccgcucugaccuuuugcggaggcacaaaaguggagauuaagagaaccguagcagccccuuccguguucaucuuuccacccucagaugaacagcuuaaaagugguacugcuagcgucgugugucuguugaacaauuucuauccuagggaggccaagguucaguggaaaguggacaacgcgcuccaaucuggaaauucccaggagucagucacagaacaggauagcaaggacaguaccuacucucuguccagcacgcugacucucucgaaggcagauuaugagaaacacaagguguacgccugcgaaguaacccaucagggguuaucuuccccaguuacaaaaucauuuaaccggggcgagugu

SEQ ID NO: 23836 - RNA, 1347 nt, Artificial Sequence
  derived and/or modified sequence opt3 from Urtoxazumab_HeavyChain1
gaggugcagcuggucgaaagcggcgggggacucguucaacccgguggcucccuuagacugucuugcgccgcuucaggguucaccuuuaguagcuacggaauguccugggugaggcaggcaccuggcaaggguuuggaguggguagccacaaucucuacugggggaucguauacguacuauccagacucagugaaaggccgguucaccauuagccgcgauaacgcgaagaauacauuauaccugcagaugaacagucuacgagcugaagacacugccgucuauuacugugcacguagaggcgaugccugggggaaucucgacuauuggggacaggguacccuggugacaguuuccucugcuagcaccaaaggcccguccguguuuccccuugcaccuucaaguaagagcacuucugggggaacagccgcucugggcugcuuggucaaagauuacuucccagagcccgugaccguauccuggaacucaggugcccucacgagcgggguucacacuuuuccugcggugcugcaaaguucuggacuguacucccucagcucggucgugaccgugccaucuuccucauuaggcacacagacuuauauauguaaugucaaccauaagcccaguaauaccaagguugacaaaaagguggaaccuaaaagcugcgauaagacacacaccuguccaccgugccccgcaccugagcugcuuggcgggccauccguauucuuguuucccccuaaaccaaaggacacgcugaugaucucuaggacucccgaggugacaugugucgugguugaugugagccaugaagacccggaggucaaguucaacugguacguggauggaguagaaguucacaaugccaaaaccaagccucgggaggagcaguauaacucaacuuaccgcguggucagugugcuaacaguccuccaucaggacuggcugaaugguaaagaauauaagugcaaaguguccaacaaggcccuucccgcuccaauugagaaaaccaucagcaaggcaaagggccaaccuagagaaccccagguuuacacgcugccacccucuagggaugaguugaccaaaaaucaggugucacucacaugucugguaaagggguuuuauccuagugacauugcugucgaaugggagagcaacggacagccagagaauaacuacaaaacuaccccgcccguguuagacuccgauggcucuuucuuucuguacucgaagcucacaguugacaaaagccgguggcaacaggguaacguguucuccugcucagucaugcacgaagcccuucacaaucauuauacucagaagagucugucuuugagcccugggaag

SEQ ID NO: 23837 - RNA, 642 nt, Artificial Sequence
  derived and/or modified sequence opt3 from Urtoxazumab_LightChain1
gagaucgugcugacccagagccccgccacacucuccgucucuccuggcgaaagagcuacucuuucaugcagggcaagucaaacgauuagcaacaaucugcacugguaccagcagaagccagggcaggccccgcgguuguuaauaaaauccgcgucucaaucgaucucagguauucccgcucgcuucagcggaaguggcuccgggaccgacuuuacacugacuaucucuagccuagaguccgaagauuucgccguuuauuacugucagcagucauauaguuggccucucaccuuuggacagggcacaaagguggagauuaaacgaaccguagcagccccaagcguguucaucuuucccccuucugacgaacaacugaaguccgguacugcuucagucgugugccuucugaacaauuucuacccacgugaggcaaaaguucaguggaagguggauaacgccuugcagagcgggaauagucaggagucugucacagaacaagacuccaaggauagcaccuauucgcucucuuccacgcugacucugucaaaagcugacuacgagaagcauaaaguguaugccugugaaguaacccaccagggacucaguagccccguuacaaaguccuuuaacagaggcgagugc

SEQ ID NO: 23838 - RNA, 1347 nt, Artificial Sequence
  derived and/or modified sequence opt3 from Ustekinumab_HeavyChain1
gaggugcagcugguccagagcggcgccgaaguuaagaaacccggggagucccucaagaucucuugcaaaggaucagguuacaguuucaccacauauuggcuuggcugggugagacagaugccugggaagggacuggacuggauuggcauaaugagcccaguagauuccgacaucagguacucuccgucguuucagggucaggugacuaugucagucgauaaaagcauuacgaccgcuuauuugcaauggaacaguuuaaaggcauccgacacagccauguacuauugugcgcggcgccgacccgggcagggauacuucgauuuuuggggccagggcacucuggugaccguuucuagcuccucaacaaaggggccuaguguguucccacuagcucccagcucuaaauccaccucaggagguacugccgcacucggcugccuggucaaggacuauuuuccugaaccagugacaguaagcuggaauaguggggcccuuaccucuggaguucacacguuccccgcugugcugcaguccagcggcuuguacucgcucucuuccgucgugacugugccuucaaguagccuggguacccaaacauacaucuguaacgucaaucauaaaccauccaacacuaagguugauaaacguguggagccgaagucuugcgacaagacccacacaugucccccuugcccagcacccgaacugcucgggggaccuagcguauuuuuauucccacccaaaccgaaggauacccugaugauuucaagaacgccugaggugacuugugucgugguugacgugagucaugaggaucccgaagucaaauuuaauugguauguggacggcguagagguucacaacgccaagacaaaaccaagggaagaacaguacaauuccaccuaucggguggucagcgugcuuacugucuugcaucaggauuggcugaacggcaaggaguacaaaugcaaggugucuaauaaggcucuaccugcccccaucgagaaaacaauaucaaaggcgaaagggcagccacgcgagccccaaguuuauacccucccuccaaguagagacgaacugacgaagaaccaggugagccuuaccugucugguaaaaggauucuacccguccgacaucgcagucgagugggaaucuaauggucagcccgagaacaauuauaagacaacuccuccaguguuggauucggacggcagcuuuuuccucuacuccaagcugaccguugauaaaucaagguggcaacaggggaacguguuuaguugcucugucaugcacgaggccuuacacaaucauuacacacaaaagagccugucccucucacccggaaaa

SEQ ID NO: 23839 - RNA, 642 nt, Artificial Sequence
  derived and/or modified sequence opt3 from Ustekinumab_LightChain1
gacauccagaugacccaaagccccuccucucugucagccagugugggcgauagagucacaauuacuugcagggcuagccaggggauauccucuuggcucgcaugguaccagcagaagccugagaaagccccaaagucgcuuaucuaugcggcuucaagccugcaaaguggaguuccgucccgguucucugguagcggcuccgggacggacuuuaccuugacaauuucaaguuuacagcccgaagauuucgccacuuacuauugucagcaguacaacaucuauccuuacaccuuuggacaaggcacaaaacuggagauuaagcgcaccguggcagccccaagcguauucaucuuucccccuucugacgaacagcuaaaauccgguacugcuucaguggucugccuccugaauaacuucuauccacgagaggcaaaggugcaguggaagguugauaaugcccuucagagcgggaacagucaagaaucugugacagagcaggacuccaaagauagcaccuacucgcugucuuccacguugacucucucaaaggcugacuacgagaaacacaaggucuaugccugugaagugacccaucagggacugaguagccccguaacaaaauccuuuaaucguggcgagugc

SEQ ID NO: 23840 - RNA, 1341 nt, Artificial Sequence
  derived and/or modified sequence opt3 from Vadastuximab_talirine_HeavyChain1
caggugcaacugguccagagcggcgccgagguuaagaaacccggggcuuccgugaagguaucuugcaaagcaucaggauacaccuucacaaacuaugacaucaauugggugagacaggccccuggucagggccucgaauggauuggguggauauacccaggagauggcaguacuaaguauaacgagaaauuuaaggcgaaggcuacgcuuaccgccgacacaagcacuuccaccgcauacauggaacugaggucuuugcggucggaugacacagccgucuauuacugugcuucagguuaugaggaugcaauggacuacugggggcaaggaaccacugugacaguuagcagugccuccaccaaaggcccgucuguguuccccuuagcuccuagcuccaagucaacgaguggcgggacugccgcgcugggaugccuagucaaagauuacuuuccagaacccgugaccguaagcuggaacucuggugcacucacauccggcguucacacuuucccugccgugcugcagucaagcgggcuuuauagucugucuuccgucgugaccgugccaagcucgucuuugggaacacagaccuacaucuguaaugucaaucauaagcccuccaacacgaaaguugacaagaagguggagccuaaaucaugcgauaagacucacacauguccaccgugccccgcuccugagcuccugggcgguccauguguauuucuguuucccccuaaaccaaaggacacccucaugauuagucgcacucccgaagugacaugcgucgugguugaugugagccaugaggacccggaagucaaauuuaauugguauguggaugggguagagguucacaacgccaagaccaaaccucgagaggaacaguacaauuccacguaucguguggucucuguguuaaccguccugcaucaagacuggcuuaacggaaaggaguacaaguguaaagugagcaauaaggcauugcccgcuccaaucgagaaaacaauuucaaaggccaaaggccagccuagagaaccccagguuuauacucugccacccaguagggacgaacuaaccaagaaccaggugucccucacaugccugguaaagggcuucuacccuagcgauaucgcggucgagugggagucuaaugggcaaccagaaaacaauuacaaaacuaccccgcccgugcuugacucagauggaaguuucuuccuguauagcaaguugacaguugacaaaucccgguggcagcaggguaacguguuuucuuguucggucaugcacgaggcccuccacaaccauuacacccaaaagagccuguccuuaucaccuggcaaa

SEQ ID NO: 23841 - RNA, 642 nt, Artificial Sequence
  derived and/or modified sequence opt3 from Vadastuximab_talirine_LightChain1
gacauccagaugacccaaagccccuccucucugucagccagugugggcgauagagucacaauuaacugcaaggcuagccaggacauaaauuccuaccucucuugguuccagcagaaaccugggaaggcaccaaaaacucuuaucuauagggccaaccggcugguugauggagugccgucgcgcuuuucagguagcggcagugggcaagacuacacguugaccauuuccucuuuacagcccgaggauuucgcgacauauuacugucugcaguaugacgaauuuccucuaacuuucggaggcgguaccaagguagagaucaaacgaacaguggcugccccaagcgucuuuauuuuucccccuuccgaugaacagcucaagucagggaccgcaagugugguuugccugcuuaauaacuucuacccacgugaggccaaggugcaauggaaagucgacaaugcucugcagagcggaaacucucaggaauccgugacugagcaggauucaaaggacagcacauauaguuugucuuccacccucacgcugagcaaagcagauuacgagaagcacaaaguauacgccugugaaguuacucaucaaggccugucgucucccgugaccaaguccuucaauagaggcgagugc

SEQ ID NO: 23842 - RNA, 1362 nt, Artificial Sequence
  derived and/or modified sequence opt3 from Vandortuzumab_vedotin_HeavyChain1
gaggugcagcuggucgaaagcggcgggggacucguucaacccgguggcucccuuagacugucuugcgccgugucaggguacaguaucaccagcgacuaugcuuggaacuggguaaggcaggcaccuggaaagggcuuggaguggguggguuacauuuccaauucugggucgacaucauauaacccgagcuuaaaaagucgguucacuauaucccgcgauacgucuaagaauacccuguaccuacagaugaacagccuccgagccgaagacacagcggucuauuacugugcucgugagagaaauuaugauuacgacgauuacuauuacgccauggacuauuggggacagggcacucuggugaccguuuccucagcaaguacaaaaggcccaagcguguuuccccuugccccuucuuccaagucaaccagcgggggaacugcugcacuggguugcuuggucaaagauuacuucccagaacccgugacaguaaguuggaacucuggcgcccucaccuccgggguucacacguuuccugcugugcugcaaagcucgggacuguauucucucuccucagucgugacugugccaaguagcuccuuaggcacccagacauacaucuguaaugucaaccauaagcccucuaauacuaagguugacaaaaagguggagccuaaaagcugcgauaagacccacacauguccaccgugccccgccccugagcugcuuggugggccaucaguauucuuguuucccccuaaaccaaaggacacccugaugauuaguaggacgcccgaagugacuugugucgugguugaugugucccaugaggacccggaagucaaguucaacugguauguggauggaguagagguucacaaugcgaaaacaaagccucgggaggaacaguacaacagcaccuaccgcguggucucugugcuaacuguccuccaucaggacuggcugaauggcaaagaguauaagugcaaagugucaaacaaggcacuucccgccccaaucgagaaaacaauuaguaaggcuaagggccaaccuagagaaccccagguuuacacccugccacccagcagggaagagaugacgaaaaaucagguguccuugaccugucucguaaagggguuuuauccuucugacaucgccgucgagugggaaucgaacggacagccagagaacaauuacaaaacaacuccgcccgugcuggauagcgacgguuccuucuuuuuauauucaaagcugaccguugauaaaagucgguggcaacagggcaacguguucucuugcagcgucaugcacgaagcacuccacaaucauuacacacagaagucccuuucacugagcccugggaag

SEQ ID NO: 23843 - RNA, 660 nt, Artificial Sequence
  derived and/or modified sequence opt3 from Vandortuzumab_vedotin_LightChain1
gacauccagaugacccaaagccccuccucucugucagccagugugggcgauagagucacaauuacuugcaagagcucccagucucuccuuuacaggucgaaccagaaaaauuaucuggcuugguaccagcaaaagccugggaaagcaccaaaguuguuaauauauugggccucaacgcgggagagcggaguuccgagucgcuucuccgguucuggcagcgggaccgacuuuacacugacuaucuccucacuacagcccgaagauuucgcgaccuacuauugucagcaguacuauaacuacccucgaacauuuggacaaggcaccaaaguggagauuaagcguacuguagcugccccaaguguguucaucuuucccccuagcgacgaacagcucaagucugguacagcauccgucgugugccugcuuaauaacuucuacccaagagaggccaaaguucaguggaagguggauaaugcucugcagucagggaacagccaagaaagugucaccgagcaggacucuaaagauuccacguauagcuugucgucuacucucacccuguccaaggcagacuacgagaaacacaagguguaugccugugaaguaacacaucagggacugucaagucccguuacuaagagcuuuaauaggggcgagugc

SEQ ID NO: 23844 - RNA, 1329 nt, Artificial Sequence
  derived and/or modified sequence opt3 from Vantictumab_HeavyChain1
gaggugcaacuggucgaaagcggcgggggacucguucaacccgguggcucccuuagacugucuugcgccgcuucaggguucaccuuuagucacuacacauugagcugggugaggcaggcaccuggaaagggcuuagaguggguauccgugaucucuggugacgggucguauacuuacuaugccgauucagucaaaggacgguucacgauuagcagugacaacuccaagaauacccuguaccuacagaugaacucucuccgcgcggaagauacagcuguguauuacugugcccgaaauuuuauaaaauauguuuucgcaaacuggggccagggcacucuggugaccgucagcuccgccucaacaaaggggccaaguguguuuccgcuugcucccugcagccguucuaccuccgagucaacugcagcccugggauguuugguaaaagacuacuucccugaaccaguuacagugagcuggaauaguggugcucucaccucuggcguccauacguuucccgccgugcugcaauccagcgggcuguacucgcucucuuccguggucacuguuccuucaaguaacuucggaacccagacauauacuugcaauguggaucacaagccaagcaacaccaagguagacaaaacaguggagagaaaguguugcgucgagugucccccuugcccagcgccgcccguggcaggcccuuccguguuuuuauucccacccaaaccuaaggauacccugaugaucucuaggacgccagaaguuacuugugucgugguagacguuagccaugaggaucccgaagugcaguuuaauugguacgucgacgguguggagguccacaacgccaaaacaaagccgcgggaggaacaguucaauucaaccuuucgcgugguuagugugcuuacuguaguccaucaagauugguugaacgggaaggaguauaaaugcaagguguccaauaaaggacugccugcucccauugaaaagacaaucagcaaaaccaagggccagccaagagagccucagguuuacacgcuacccccaucuagggaagagaugaccaaaaaccaggugucacucacaugucuggucaagggcuucuaucccagugacauugccguggagugggaaagcaaugggcaaccugagaacaacuacaagacuaccccaccgaugcuugauuccgacggaucuuucuuucuguauucgaaauugacaguagacaagagccgguggcagcaggguaauguguucuccugcucaguuaugcacgaagcacuccacaaccauuacacucagaaaagucugucuuuaagccccggc

SEQ ID NO: 23845 - RNA, 639 nt, Artificial Sequence
  derived and/or modified sequence opt3 from Vantictumab_LightChain1
gacaucgagcugacccagcccccuagcguguccgucgccccaggccaaacagcuagaauuucuugcucaggggauaacauaggaaguuucuacguucacugguaucagcagaagccgggucaggcacccgugcucguaaucuacgacaaaagcaauaggccuuccggcauuccagaacgguuuucugggucgaacucaggaaauacugccacgcuuaccaucagcggcacacaagcggaggaugaagcugacuauuacugucagaguuaugccaacacucuguccuugguguucggugggggaaccaaguuaacaguccugggccagcccaaagcagccccuucugugacccuauuuccacccagcuccgaggaacuccaggcuaauaaggcaacucugguuugccuuauuucagauuucuacccuggcgccgugacagucgcuuggaaagccgacaguagcccagugaaggcggggguagagaccacgacuccgucuaagcaauccaacaauaaauaugcagccucaagcuaccugaguuugacccccgagcaguggaagucucaucgcuccuacagcugucagguuacacacgaaggaucgacuguggagaaaaccgucgcuccuacagaaugcucu

SEQ ID NO: 23846 - RNA, 1389 nt, Artificial Sequence
  derived and/or modified sequence opt3 from Vanucizumab_HeavyChain1
caggugcaacugguccagagcggcgccgagguuaagaaacccggggcuuccgugaagguaucuugcaaagcaucaggauacaccuucacagguuauuacaugcacugggugagacaggccccuggccaggggcucgaauggaugggauggaucaacccaaauaguggcgguacuaacuaugcgcaaaaguuucaggggagggucacgaugacccgggacacaagcauuuccacugcuuacauggagcuuucucgccugcgaucggaugacaccgccguguauuacugugcacguucaccgaaucccuauuacuacgauagcaguggauauuacuauccuggcgccuucgacauauggggccaggggacaaugguuaccguguccucugcuagcgucgcagccccauccguguuuaucuuucccccuucagaugaacaguugaaaaguggaacugcuagcguaguuugcuuacugaacaauuucuacccaagagaggccaaggugcaauggaaggucgacaacgcgcuacagucugguaauucccaggaaucagugacagagcaggauagcaaagacaguaccuauucucucuccagcacgcugacucuuucgaaggcagauuacgagaaacauaagguguaugccugugaagucacccaccaaggccugucuucccccguuacaaaaucauucaacaggggagagugcgacaagacucauaccuguccuccaugcccggcucccgaauugcucgggggcccuaguguguuucuguucccacccaagccuaaagauacacugaugauuagccggaccccagagguaacguguguggucguggacguuucccacgaggaucccgaagugaaguuuaauugguacgucgacgguguggagguacauaacgccaaaacuaagccgcgcgaggaacaguacaauucuacauauagaguugugagcguccucaccguguuacaccaggacuggcugaacgggaaagaauacaagugcaaagucucaaauaaggcacuuccugcucccaucgagaagacuauuaguaaagccaagggacaaccaagggagccucagguguguacauugcccccaucccgggaugaacugaccaaaaaccagguuagccuaucuugcgcggugaagggcuucuaucccucagacaucgccguagagugggaaaguaauggccagccugagaacaacuacaaaacgaccccaccgguccucgauagcgacggguccuuuuuccuggugucuaaacuuacaguugauaagucgcgcuggcaacagggaaauguguuuagcuguuccgucaugcacgaagcacugcauaaccacuauacucagaagucauugagucucucucccgguaag

SEQ ID NO: 23847 - RNA, 1359 nt, Artificial Sequence
  derived and/or modified sequence opt3 from Vanucizumab_HeavyChain2
gaggugcagcuggucgaaagcggcgggggacucguucaacccgguggcucccuuagacugucuugcgccgcuucaggguacaccuucacaaacuauggaaugaauugggugaggcaggcaccuggcaaggguuuggaguggguaggguggaucaacacuuacacgggagaaccaaccuaugccgcggacuuuaaacggcgcuucacauuuaguuuagauacuagcaaguccaccgcuuaccugcagaugaauagccuacgagccgaggacacagcaguguauuacugugccaaauauccgcacuacuacggcucgucacauugguauuucgaugucuggggccaggggacccucgugacuguuagcagugcuuccacaaagggacccucuguguuuccucuggcaccaagcuccaaaucaaccagugguggcacggccgcucuugggugccuggucaaggacuacuuccccgaaccugugacuguaagcuggaacucuggagccuugaccuccggcguucacacauuuccagcggugcuccaaucaagcggucuguauagucugucuuccgucgugacugugcccagcucgucucucgggacccagacauacauuuguaaugucaaccauaagccuuccaauaccaaaguugauaagaaaguggagccaaagucaugcgacaaaacgcacacuuguccgcccugcccugcaccagaguuacugggaggccccaguguauuccuuuuuccuccaaagcccaaggauacauugaugauaagccguaccccggaagugacuugugucgugguugacgugucccaugaggauccugaagucaaauucaacugguauguggacggcguagagguucacaaugccaagacaaaacccagagaggaacaguacaacucuaccuauaggguggucagcgugcugacgguccuacaccaggauuggcucaaugggaaggaguacaaaugcaaggugucaaacaaagcucugccagccccuaucgaaaagaccauuaguaaggcaaaaggacaaccccgggagccacagguuuacacacuucccccuugucgcgacgaacugacuaagaaucagguguccuuguggugccucguaaaagguuuuuauccaagcgauaucgcugucgagugggagucuaacggccagccggaaaauaacuacaagaccacacccccugugcuggacucagacgggaguuucuuuuuauauagcaaacugacuguugauaaguccagauggcaacagggaaacguguucucuuguucggucaugcaugaggcccuccacaaucauuacacccagaagucucuuucccugucaccaggcaaa

SEQ ID NO: 23848 - RNA, 639 nt, Artificial Sequence
  derived and/or modified sequence opt3 from Vanucizumab_LightChain1
cagcccggccugacccaaccuccaagcguguccgucgccccggggcagacagcuagaaucacuugcggagguaacaauauuggcucuaagucaguucacugguaccagcagaaacccgggcaagcaccugugcucguaguguaugacgauagugacaggccaagcggaauacccgagcgguucuccggcucuaacucggguaauacggccacccuuacaaucucacgcgucgaagcgggggaugaggcugacuacuauugucaggugugggauagcaguuccgaccauuacguuuuuggaacuggcaccaaggugacaguccugucuagcgccuccaccaaaggcccuucaguguucccauuggcacccaguagcaagucuacuuccgggggaacagccgcuuuagguugccugguaaaagauuauuuuccugaaccaguuaccgugucauggaacagcggcgcacuaacgagugggguccacacuuucccggccgugcuccagucuuccggacuguacagccuuucgucuguggucaccguucccuccucaagucugggcacacagacuuauauuuguaaugugaaccauaagccuagcaauaccaagguagacaaaaagguggagccaaaauccugc

SEQ ID NO: 23849 - RNA, 642 nt, Artificial Sequence; identical to SEQ ID NO: 23010
  derived and/or modified sequence opt3 from Vanucizumab_LightChain2

SEQ ID NO: 23850 - RNA, 1356 nt, Artificial Sequence
  derived and/or modified sequence opt3 from Varlilumab_HeavyChain1
caggugcaacuggucgagagcggcgggggaguugugcagcccgguagaucccucaggcuuucuugcgccgcuucaggcuucaccuuuaguagcuacgacaugcacuggguacggcaggcaccugggaagggacuggaauggguggccgucaucugguaugauggcuccaacaaauacuaugcggacucugugaagggucgcuucacaauuucgcgagauaauucaaagaacacuuuguacuuacagaugaauagccugcgugcugaggacacggccguuuauuacugugcaagagggaguggaaacuggggcuuuuucgauuauuggggccaagggacccuagugacagucuccucugccagcacuaaaggaccauccguguuuccgcucgcucccucaaguaaaagcaccucugguggcacagcagcccuggggugccuuguaaaggacuacuucccugaaccaguuaccguguccuggaacucaggagcucugacuagcggcguccauacauuucccgccguguugcagaguucuggucucuacucccugagcucgguggucaccguuccuucuuccucacuggggacgcagacuuauauauguaaugugaaucacaagccaaguaacaccaaaguagauaagaaaguggagcccaagagcugcgacaaaacacauacuuguccuccaugcccggcgcccgaacucuuaggaggcccuuccgucuuccuguuuccacccaagccuaaggauacccuuaugaucucuaggacaccagaggugaccuguguuguggucgacgugagccacgaggaucccgaaguaaaauucaauugguacguugacggcguggagguccauaacgcaaagacgaaaccgcgggaggaacaguauaauucaacuuaccgcguggucaguguguugacaguucugcaccaagauuggcuaaacgggaaggaguauaaaugcaagguguccaauaaagcccucccugcucccauugaaaagaccaucagcaaggccaaaggacagccaagagagccucagguauacacucugcccccaucuagggacgaacuuacaaagaaccaggucucacugaccuguuuggugaaagguuuuuaucccagugacauugcaguugagugggaaagcaauggccaaccugagaacaacuacaagacgaccccaccggugcucgauuccgacgggucuuucuuucuguacucgaaauuaacagucgauaagagccgguggcagcagggaaauguguucuccugcucaguaaugcacgaggcucugcauaaccacuauacucaaaagagucucucucuuagccccggcaaagguuccuca

SEQ ID NO: 23851 - RNA, 642 nt, Artificial Sequence
  derived and/or modified sequence opt3 from Varlilumab_LightChain1
gacauccagaugacccaaagccccuccucucugucagccagugugggcgauagagucacaauuacuugcagggcuagccaggggauaucccgguggcucgcaugguaccagcagaaaccugagaaagccccaaagucucuuaucuaugcggcuucgucacugcaaagcggaguuccgagucgcuucuccgguucuggcagcgggacggacuuuaccuugacaauuuccucauuacagcccgaagauuucgccacuuacuauugucagcaguacaacaccuauccucgaacauuuggacaaggcaccaaaguggagaucaagcguacuguagcagccccaaguguguucauuuuucccccuagcgacgaacagcugaaaucugguacagcuuccgucgugugccuacucaauaacuucuacccaagagaggcaaagguucaguggaagguggauaaugcccugcagucagggaacagccaagaaagugucaccgagcaggacucuaaagauuccacguauagccuuucgucuacucugaccuuguccaaggcugacuacgagaaacacaagguguacgccugugaaguaacacaucagggacucucaagucccguuacuaagagcuuuaauaggggcgagugc

SEQ ID NO: 23852 - RNA, 1338 nt, Artificial Sequence
  derived and/or modified sequence opt3 from Vatelizumab_HeavyChain1
caggugcaacugcaggagagcggccccgggcucgucaagccuuccgaaacccuuucucugacaugcacuguuucaggauucaguuugacgaacuacgguauccacuggauuagacagccaccgggcaaaggguuagaguggcugggagugauaugggccaggggcuuuaccaauuauaacagcgcucuaaugucccggcucacaaucucuaaggacaauucgaaaaaccagguaucacugaaacuuagcagugugacugcagccgauaccgcggucuacuauugugcucgcgccaaugacgguguguacuaugcaauggauuacugggggcaaggaacacugguuaccguguccucugccagcacuaagggccccuccgucuucccuuuggcuccaugcucacgaaguacaagcgaaucuaccgcagcccucggcugucuggugaaggacuauuuucccgagccuguaacgguuuccuggaacucaggggcucugacuagcggagugcauaccuucccagccguccuccagaguucugguuuauacucccugagcucgguggugacaguccccucuuccucacuuggcacuaagaccuacacaugcaauguugaucacaaaccuaguaacaccaagguggacaaacguguagaaagcaaguaugggccaccgugucccuccugcccugcgccagaguuuuugggaggccccucuguguuccuguuuccuccaaaacccaaggauacgcuaaugauuagcagaacuccggaggucacaugugugguuguggacgucucacaggaagauccugaggugcaguucaauugguacguagacgguguugaagugcauaacgcaaagaccaaacccagggaggagcaauuuaauaguacuuaucgggucguguccguccucacagugcugcaccaggauuggcuuaacgggaaggaauacaaaugcaagguuagcaauaaaggacugccaucuucaaucgagaagaccauuaguaaagccaagggccagccucgcgaaccccagguguauacguugccacccagccaagaggaaaugaccaagaaccagguaucccucacaugucuggucaaaggcuucuacccuucugacaucgcuguggagugggagucgaaugggcagccagaaaacaacuauaagacuaccccgcccguuuuagauagcgacggauccuuuuuccuguacucaagacucacaguggacaaaaguagguggcaagaggguaaugucuuuucuugcagcgugaugcaugaagcccuucacaaccacuacacucagaagucccugucauugagccuaggcaaa

SEQ ID NO: 23853 - RNA, 639 nt, Artificial Sequence
  derived and/or modified sequence opt3 from Vatelizumab_LightChain1
gacuucgugaugacccagagccccgccuuucuguccgucacaccuggcgagaagguuacuaucacgugcucugcucaaucaagugugaacuacauucacugguaucagcagaaaccagaucaggcaccgaagaaacucauauacgacaccagcaaacuugccuccgggguacccucuagauucucgggaucagguagcggcacagauuauacuuuuaccaucaguucccuggaagcggaggacgcugccacauacuauugucaacaguggaccacuaauccuuugacauucgggcagggaaccaagguggaaauuaagaggacggucgcagccccaucuguguuuaucuuucccccuagcgaugagcaguuaaaguccggcacugcuucaguugugugccugcuaaacaauuucuacccacgggaagcaaaaguccaauggaagguggacaacgcccuccagagugguaauagccaggagucuguaaccgagcaggauuccaaagacucaacauauagccugaguucuacucuuacccuguccaaggcugauuacgaaaaacauaagguuuacgccugugaggugacacaccaaggguugagcucgcccgucaccaagucuuucaaccgcggagaaugc

SEQ ID NO: 23854 - RNA, 1353 nt, Artificial Sequence
  derived and/or modified sequence opt3 from Vedolizumab_HeavyChain1
caggugcaacugguccagagcggcgccgagguuaagaaacccggggcuuccgugaagguaucuugcaaaggaucagguuacaccuucacaaguuauuggaugcacugggugagacaggcaccuggccagaggcucgaauggaucggggagauugacccaagcgaauccaacacuaauuacaaccaaaaguuuaaaggacgggucacgcuuaccguggauauaucugccucgacagcguauauggagcugucaucauugcgcagugaagacacugcuguuuacuauugugcccgaggcgguuacgaugggugggacuaugcaaucgauuacuggggacagggcaccuuagugacagucuccucugccagcaccaagggcccguccguguucccccuggcuccuucaaguaagagcacuucugggggaacagcagcccuagguugccucguaaaagacuacuuuccagagcccguuaccguguccuggaauagcggcgcucugacgagcgggguccauacuuucccugccgugcuucagaguucuggacuguauuccuugagcucgguggucaccguuccaucuuccucacucggcacacagacuuacauuuguaacgugaaucacaagcccaguaacaccaaaguagauaagaaaguggagccuaagagcugcgacaagacacauaccuguccaccgugccccgcgccugaacuggccggugcaccauccgucuuucuguuucccccuaaaccaaaggauacgcucaugaucucucguacucccgaggugacauguguuguggucgacgugagccacgaagauccggagguaaaauuuaauugguauguugacgggguggagguccauaacgcuaagaccaaaccuagagaggaacaauacaauucaacuuauaggguggucaguguguuaacaguucugcaccaggauuggcuuaacggaaaggaauacaaaugcaagguguccaauaaggccuugcccgcaccaauugagaaaaccaucagcaaggcuaaaggccagccucgggaaccccagguauauacgcugccacccucucgcgacgagcuaaccaagaaccaagucucacucacaugucuggugaaaggcuucuacccuagugacauagccguugagugggaaagcaaugggcagccagagaacaauuacaagacuaccccgcccgugcuugauuccgacggaucuuucuuccuguauucgaaguugacagucgauaaaagcagauggcagcaagguaacguguuuuccugcucaguaaugcacgaagcgcuccauaaccacuacacucagaagagucugucuuuaagcccuggcaaa

SEQ ID NO: 23855 - RNA, 657 nt, Artificial Sequence
  derived and/or modified sequence opt3 from Vedolizumab_LightChain1
gacguggucaugacccagagcccccugucccucccuguuacaccaggcgagccggccucuaucucaugcagaaguagccaaucccuugcuaagucuuacgggaacacuuaucugucgugguacuugcagaaacccggacagucaccucaguuacugauuuaugguauaagcaauagguucaguggcgugccagaucgguuuuccgggucuggaagcggcacggacuucacccuaaagaucucccgcguagaagcagaggaugugggugucuacuauugucuccaagggacacaccagcccuacacuuuuggacagggcaccaaaguggaaauuaagcgaacaguugccgcgccuucaguguucaucuuuccacccagugacgagcagcugaaaagcggcaccgcuucugucgugugccuucugaacaauuucuauccucgugaagccaagguacaauggaagguugauaacgcauugcaguccggaaauucacaggagagcgugacugagcaggacaguaaagauucuacauacucccucagcucgacccugacgcugucuaaggccgacuacgaaaaacauaaggucuaugcuugugaggugacucaccaagggcucuccucaccagugaccaaaaguuuuaacagaggugaaugc

SEQ ID NO: 23856 - RNA, 1353 nt, Artificial Sequence
  derived and/or modified sequence opt3 from Veltuzumab_HeavyChain1
caggugcaacugcagcagagcggcgccgaggucaagaaacccggguccucuguuaaggugucaugcaaagcuaguggauacaccuucacaagcuauaacaugcacuggguaaagcaggcaccuggucaaggccucgaauggaucggggccauuuacccaggaaugggcgacacuuccuauaaucagaaauuuaaggguaaggcgacgcuuaccgcugaugagucuacaaacacugccuacauggaacugucgucauugagaagcgaggacaccgcauucuauuacugugccaggaguacauauuacgggggagauugguacuuugacguguggggccagggcaccacugucacaguguccucugcuagcaccaaagggccguccguuuuccccuuagcaccuucaaguaagagcacgucuggagguacugccgcucugggcugccuagugaaagauuauuuuccagaacccgucaccguguccuggaacucaggggcccucacaagcggaguacauacuuucccugcgguucugcagaguucuggccuuuacucccugagcucgguggucaccgugccaucuuccucauuggguacacaaaccuauauauguaaugugaaucacaagcccaguaacacgaaagucgacaagcggguugagccuaagagcugcgauaaaacucauacauguccaccgugccccgcaccugagcuccucgggggaccauccguguuucuguuucccccuaagccaaaagacacccugaugaucucucgcacucccgaaguaacauguguggucguggauguuagccacgaggacccggaagugaaguuuaauugguacgucgauggcguggagguacauaacgccaaaaccaagccucgagaggaacaguauaauucaacguaccguguugugagugucuuaaccgugcugcaccaggacuggcuuaacggcaaagaguauaagugcaaggucuccaauaaagccuugcccgcuccaauugaaaagacaaucagcaaagcaaaggggcagccuagagagccccaaguguacacucugccacccucuagggaagagaugaccaaaaaccagguuucacuaacaugucucgugaagggauucuacccuagugauauugcuguagagugggaaagcaauggucagccagagaacaauuauaagacuaccccgcccguccuggacuccgacggcucuuucuuccuuuacucgaaacugacaguggauaagagccgguggcaacaggggaacguguuuuccugcucaguuaugcacgaagccuugcauaaccacuauacccagaaaagucucucucugagcccuggaaag

SEQ ID NO: 23857 - RNA, 639 nt, Artificial Sequence
  derived and/or modified sequence opt3 from Veltuzumab_LightChain1
gacauccagcugacccaaagccccuccucucucucagccagugugggcgauagagucacaaugacuugcagggcuagcuccucuguuucguacauucacugguuccagcagaaaccugggaaagcaccaaagccguggauauaugccacgucaaaccuugcgagcggagugcccguacgguuuagugguuccggcucugggaccgacuacacauucacuaucagcucccugcagccugaggauauugcuaccuauuacugucaacaguggacaucaaauccacccaccuuuggaggcgguacuaaauuggaaaucaagcgcacaguggccgcaccuagugucuucauuuuuccacccagcgacgagcaguuaaaaucugggaccgccuccgugguuugccugcuaaacaauuucuauccucgagaagcuaaggugcaguggaaggucgauaacgcacuccaaucaggaaauagccaggagagugugacggaacaggacucuaaagauuccacuuacagccugucgucuacccuuacacuguccaaggccgacuaugagaaacauaagguauacgcuugugagguuacucaccagggcuugucaaguccagugaccaagagcuuuaaccguggcgaaugc

SEQ ID NO: 23858 - RNA, 1359 nt, Artificial Sequence
  derived and/or modified sequence opt3 from Vesencumab_HeavyChain1
gaggugcagcuggucgaaagcggcgggggacucguucaacccgguggcucccuuagacugucuugcgccgcuucaggguucaccuuuaguagcuacgcaauguccugggugaggcaggccccuggaaagggcuuggaguggguaucucagaucucgccagcggguggguauacaaacuacgcugacucagugaaaggacgguucacuauuagcgccgauacgaguaagaauaccgcauauuuacagaugaacucccugcgcgccgaagacacagcugucuacuauugugcacgaggcgagcuaccguacuaucguaugucuaaagugauggauguuuggggccaagggacucucgugaccgucagcuccgccucaacaaagggacccaguguguuuccucuggcuccaagcucuaaauccaccucagguggcacugccgcgcuugggugccugguaaaggacuacuuccccgaaccuguuacagugagcuggaauaguggagcauugaccucuggcguccacacguuuccagccgugcuccaguccagcggucuguacucgcugucuuccguggucacuguucccucaaguagccucgggacccagacauauauauguaacgugaaucauaagccuuccaacacuaaaguagauaagaaaguggagccaaagucuugcgacaaaacccacacauguccgcccugcccugcuccagaguuacugggaggccccagcgucuuccuuuuuccuccaaagcccaaggauaccuugaugaucucaagaacgccggaagugacuuguguuguggucgacgugagucaugaggauccugaaguaaaauucaauugguacguugacggcguggagguccacaacgccaagacaaaacccagggaggaacaguauaauuccaccuaccggguggucagcgugcugacuguucuacaucaagauuggcucaacgggaaggaguauaaaugcaaggugucuaauaaagcacugccagcuccuauugaaaagacaaucucaaaggccaaaggacagccccgcgagccacagguauacacccuucccccuaguagagaagagaugacgaagaaccaggucagccugaccuguuuggugaaagguuuuuauccauccgacauugcgguugagugggaaucuaauggccaaccggagaacaauuacaagacaacucccccugugcucgauucggacgggagcuucuuucuguacuccaaauuaaccgucgacaagucaagguggcagcagggaaacguguucaguugcucuguaaugcacgaagcccugcacaaccauuauacacaaaagagccucucccuuucaccaggcaaa

SEQ ID NO: 23859 - RNA, 642 nt, Artificial Sequence
  derived and/or modified sequence opt3 from Vesencumab_LightChain1
gacauccagaugacccaaagccccuccucucugucagccagugugggcgauagagucacaauuacuugcagggcuagccaguacuucuccucuuaucucgcaugguaccagcagaagccugggaaagccccaaaacuucugauauauggagcgucgucacgggcuagcgguguuccgagucgcuuuuccggcucugggagcggaacggacuucaccuugacaaucuccucauuacaacccgaggauuuugccacuuacuauugucagcaguaccugggcaguccuccaaccuucggucaggggacaaagguggaaauuaagcgaaccguagcagcccccagcguguuuaucuucccuccaucugacgagcaacuaaaauccggaacugcuucagucgugugccuccugaacaauuuuuauccccgugaagcaaagguucaguggaagguggauaacgcccuucagagcggcaauagucaggagucugucacagaacaagacuccaaagauagcaccuacucgcugucuuccacguugacucucucaaaggcugacuacgagaaacacaagguguaugccugugagguaacccaucagggccugaguagcccuguuacaaaauccuucaacagaggggaaugc

SEQ ID NO: 23860 - RNA, 1338 nt, Artificial Sequence
  derived and/or modified sequence opt3 from Visilizumab_HeavyChain1
caggugcaacugguccagagcggcgccgagguuaagaaacccggggcuuccgugaagguaucuugcaaagcaucaggauacaccuucaucaguuauacaaugcacugggugagacaggccccuggucagggccucgaauggaugggguacauuaacccaaggagcggauauacucauuacaaucaaaaacuuaaggacaaggcgacgcugaccgcugauaaguccgccucuacagcauauauggaguugucgucauuacggagcgaagacacugccgucuacuauugugcucgcagugcauacuacgauuaugacggcuuugccuacuggggucaggggacccuggugacaguuuccucugcuagcaccaaaggaccguccguguucccccuagccccuugcucacgaaguacuagcgagucuacagcggcacucggcugucuggucaaggauuauuuuccagaacccgugaccguauccuggaacucaggcgcccuuacgagcgggguucacacuuucccugcugugcugcagaguucuggauuguacucccucagcucggucgugaccgugccaucuuccaauuuugguacacagacuuauaccugcaacgucgaccauaaacccucaaauacaaagguugauaaaaccguggagcguaaguguugcguagaguguccuccaugcccggcucccccugcagcugccccaaguguguuccuguuucccccuaagccaaaagacacgcugaugauaagcagaacucccgaagucacaugugugguuguggaugucucccacgaggacccggaagugcaauucaacugguacguagauggcguugaggugcauaaugcgaagaccaaaccuagggaggaacaguuuaacucuacuuuccgggucgugagcguccucacagugguucaccaggacugguuaaaugggaaggaguauaaaugcaaggugucaaacaaaggacugcccgccccaaucgaaaagaccauuaguaagacgaaaggccagccucgcgagccccaaguauacacccuuccacccuccagagaagagaugacaaagaaucaggucagcuugacuugucuggugaaagguuuuuacccuucugauaucgcaguugagugggaaucaaacgggcagccagagaauaacuauaagaccacaccgcccaugcuagacagugacggcagcuucuuucucuacuccaaacugacuguggauaagucuagguggcaacagggaaaugucuucucgugcagcgugaugcacgaagcccuucauaaccacuauacccagaagucccugucauugaguccuucuaaa

SEQ ID NO: 23861 - RNA, 639 nt, Artificial Sequence
  derived and/or modified sequence opt3 from Visilizumab_LightChain1
gacauccagaugacccaaagccccuccucucugucagccagugugggcgauagagucacaauuacuugcagcgcuuccucuucgguuucauacaugaacugguaucagcagaagccugggaaagcaccaaagaggcucauauacgacacgagcaaacuugccaguggagugccgucccgguucucugguagcggcuccgggaccgauuuuacacugacuaucucaaguuugcagcccgaggacuucgcgaccuauuacugucaacaguggagcucuaauccuccaacauuuggaggcgguaccaagguagaaauuaaacgcacuguggcugcccccuccgucuucaucuuuccuccaucagaugagcaguuaaagagcgggacagcaagugugguuugccugcuaaacaauuucuauccccgagaagccaaggugcaguggaaagucgacaacgcucuccaaucuggaaauucccaggagagcgugaccgaacaggauucgaaggacucuacguacucccugucaaguacucuuacccugagcaaagcagauuaugagaagcacaaaguauacgccugugagguuacacaucagggcuuguccucuccugugacuaagagcuuuaaccguggcgaaugc

SEQ ID NO: 23862 - RNA, 1353 nt, Artificial Sequence
  derived and/or modified sequence opt3 from Volociximab_HeavyChain
caggugcaacugaaggagagcggccccgggcucgucgccccuucccagucucuuucaauuaccugcacaaucaguggauucagccugacugacuacgguguucacugggugagacagccaccgggcaaaggguuggaaugguuaguagugauaugguccgauggaucuucgacguauaacucagcucugaaguccaggaugaccauccggaaagacaauaguaagucccaggucuuucuaauuaugaacucucuccaaacagaugacagcgcaauguacuauugugcccgccauggcacuuacuaugguaugaccacaaccggggaugcgcuggacuacuggggacagggcacuuccgugacaguuucaagugcuagcaccaaaggccccucuguguucccucuugccccaugcucccgaucaacgagcgagaguacugcagcccugggguguuuggucaaggauuauuuucccgaaccugugaccguaucuuggaauagcggagcucucacaagcgguguucacacuuucccagcagugcugcagucgucuggccuguacucccucucaagugucgugaccgugcccagcuccucuuuagggacaaagaccuacacgugcaacgucgaccauaaaccuagcaauacuaagguugauaaacguguggagucaaaguauggaccaccgugucccaguugcccugccccagaauuucugggcggucccuccguauuccuuuuuccuccaaaacccaaggacacauugaugaucagcagaaccccggaggugacuugugucgugguugaugugucucaggaggacccugaaguccaauucaacugguacguggaugggguagagguucacaaugcuaagacaaaacccagggaggaacaguuuaacucaaccuaucggguggucagugugcugacgguccuacaucaggacuggcucaauggaaaggaguacaaaugcaaggugagcaacaaaggccugccauccucuauugaaaagaccaucucgaaagccaagggccagccucgcgagccccaaguuuauacacuuccacccagccaggaagagaugacuaagaaucaggugucccugaccuguuugguaaaaggguucuacccuucagacauagcggucgaaugggagaguaacggacaaccagagaauaacuauaagacaacuccgcccgugcucgauucugacgguagcuuuuuccuguacuccagauuaaccguugauaaaucaagguggcaggaaggcaauguguuuagcugcucugucaugcacgaggcacugcacaaccauuacacacagaagucccucagucuuagccuggggaaa

SEQ ID NO: 23863 - RNA, 645 nt, Artificial Sequence
  derived and/or modified sequence opt3 from Volociximab_LightChain
cagaucgugcugacccaaagccccgccauuauguccgcuucucucggcgagagagucacaaugacuugcacggcaucaaguagcguuuccucuaacuaccuucacugguaucagcagaaaccugggucggccccaaaucuguggauauacucaaccagcaacuuggcgaguggagugccggcuagguucuccgguucuggcagcgggacauccuauucauuaacuaucaguagcauggaagccgaggacgcagccaccuacuauugucaucaguaccugcggucucccccuacauuuggaggcgguaccaaacuagaaauuaagcgcacuguagcugcaccauccguguucaucuuucccccuucagaugagcaacucaaaagcgggacagccagugucgugugccugcuuaauaacuucuauccacgagaagcuaagguucaguggaaaguggacaaugcccugcagucuggaaacucccaggagagcgucaccgagcaagauucgaaggacucuacguacuccuugucaaguacucucacccugagcaaggcggauuacgaaaaacacaagguguaugcaugugagguaacacaucagggccuguccucucccguuacuaagagcuuuaaucguggcgaaugc

SEQ ID NO: 23864 - RNA, 1344 nt, Artificial Sequence
  derived and/or modified sequence opt3 from Vorsetuzumab_HeavyChain1
caggugcaacugguccagagcggcgccgagguuaagaaacccggggcuuccgugaagguaucuugcaaagcaucaggauacaccuucacaaacuaugguaugaauugggugagacaggccccuggccaggggcucaaguggaugggauggaucaacacuuacacgggcgaaccaaccuaugcggacgcuuuuaaagguagggucacaaugacucgggauaccaguauuagcacagccuacauggagcuuucccgccugcgaucugacgauaccgcaguguauuacugugcccgugacuauggggauuacggaauggacuacuggggccaaggcacuacaguuaccgugucgucagcuagcacgaaggggccgagugucuuccccuuggcaccuuccucuaagagcacuuccggagguaccgccgcuuuaggcugccuggugaaagauuauuuuccagaacccguaacaguuucauggaauaguggggcccuaacuagcggagugcacaccuucccugcgguccuccagucuuccggccuguacucacuuagcaguguggugacagucccaucuuccagccuggguacccagacguauauauguaacguuaaucauaagcccucgaacacuaaaguggacaagaaaguagagccuaagucuugcgauaagacacacaccuguccaccgugccccgcaccugaauugcucgggggaccauccguguuucuguuucccccuaaaccaaaggacacucugaugaucucaagaacacccgaggucaccugugugguuguggaugucagucaugaggacccggaagugaaauucaauugguacguagauggcguugaggugcacaacgccaagacgaaaccuagggaagaacaguauaauagcaccuaccgggucguguccguccucacaguguuacaucaagacuggcugaacggcaaggaguauaaaugcaagguuucuaauaaggcccuucccgcuccaauugagaaaacuaucagcaaggcaaaagggcagccucgcgagccccagguguacaccuugccacccucaagagacgaacugacaaagaaccagguaagucuaacuugucucgucaaaggauucuacccuuccgauauugcuguggagugggaaagcaauggucaaccagagaacaauuauaagaccacaccgcccguucuggacucugauggcucauuuuuccuuuacaguaagcugaccguggacaaauccagguggcagcaggggaacgucuuuagcugcucugugaugcacgaggccuugcacaaccauuauacucaaaagucgcucagccuguccccuggaaaa

SEQ ID NO: 23865 - RNA, 654 nt, Artificial Sequence
  derived and/or modified sequence opt3 from Vorsetuzumab_LightChain1
gacaucgugaugacccagagccccgauucccuggccgucucucucggcgagagagcuacaauuaacugcagggcaucaaagaguguuagcacuuccggguacucuuucaugcacugguaucaacagaaaccuggacagccaccgaaacuucugauauacuuggccucgaauuuagaaucaggugugcccgaccgguuuagcggcaguggguccggaacggauuucacccugacaaucucuagccuacaggcggaggacguagcuguguauuacugucaacauucccgcgaagucccuuggacuuuuggccaggguaccaagguggagauuaagcgaacaguugccgcaccaucaguguucaucuuucccccuagugaugaacagcucaaaagcgggaccgccucugucgugugccugcuuaacaauuucuauccacgugaggcuaagguacaguggaagguugacaacgcacugcaauccggaaauucacaggagagcgugacugaacaggauaguaaagacucuacauacuccuugagcucgacccucacgcugucuaaggccgauuaugagaaacacaaggucuacgcuugugaagugacucaucagggccuguccucacccgugaccaaaaguuuuaacagaggcgagugc

SEQ ID NO: 23866 - RNA, 1344 nt, Artificial Sequence; identical to SEQ ID NO: 23864
  derived and/or modified sequence opt3 from Vorsetuzumab_mafodotin_HeavyChain1

SEQ ID NO: 23867 - RNA, 654 nt, Artificial Sequence; identical to SEQ ID NO: 23865
  derived and/or modified sequence opt3 from Vorsetuzumab_mafodotin_LightChain1

SEQ ID NO: 23868 - RNA, 1347 nt, Artificial Sequence; identical to SEQ ID NO: 23090
  derived and/or modified sequence opt3 from Yttrium_(90Y)_clivatuzumab_tetraxetan_HeavyChain1

SEQ ID NO: 23869 - RNA, 645 nt, Artificial Sequence; identical to SEQ ID NO: 23091
  derived and/or modified sequence opt3 from Yttrium_(90Y)_clivatuzumab_tetraxetan_LightChain1

SEQ ID NO: 23870 - RNA, 1338 nt, Artificial Sequence
  derived and/or modified sequence opt3 from Yttrium_Y_90_epratuzumab_tetraxetan_HeavyChain1
caggugcaacugguccagagcggcgccgagguuaagaaacccggguccucugugaagguaucaugcaaagcuaguggauacaccuucacaagcuauuggcuccacugggugagacaggcaccuggucagggccuugaauggaucggguacauuaacccaaggaaugacuauacugaguacaaccaaaauuuuaaggauaaagccacgauaaccgcggacgaauccacaaacacugcuuauauggagcugucuucguugcggucagaagauaccgccuucuacuuuugugcacgccgagacaucacaaccuucuauuggggacagggcacuacagucaccgugagcagugccuccacgaaggguccgucuguuuuucccuuagcuccuagcuccaagucaacaagugggggaaccgcagcccugggcugccuagugaaagauuacuucccagagcccgucacagugagcuggaacucuggcgcucucacuuccgggguacauaccuuuccugccguucugcagucaagcggacuuuacagucugucuuccguggucacagugccaagcucgucuuuggguacccagacguauauuuguaaugugaaucacaagcccuccaacacuaaagucgacaagcguguugagccuaaaucaugcgauaagacacauaccuguccaccgugccccgcgccugaacuccugggcgggccaaguguguuccuguuucccccuaagccaaaagacacucucaugaucagcagaacacccgagguaaccuguguggucguggauguuucccacgaagacccggaggugaaguucaauugguacgucgauggaguggagguacauaacgcaaaaacgaagccuagggaggaacaauauaauucuaccuaccggguugugagcgucuuaacagugcugcaccaggacuggcuuaacggcaaagaauauaagugcaaagucucaaauaaggccuugcccgcuccaauugagaagacuaucaguaaagccaagggucagccucgcgaaccccagguguacacccugccacccuccagagaggagaugacuaaaaaccaaguuagccuaacuugucucgugaagggguuuuauccuucugauauagcaguagaaugggagucaaauggacagccagaaaacaacuacaaaaccacaccgcccguccuggacagugacggcagcuucuuucuuuacuccaagcugaccguggauaagucuagguggcagcaaggcaauguuuucucgugcagcgugaugcacgaggcuuugcauaaccacuauacucagaaaucccucucacugaguccugggaag

SEQ ID NO: 23871 - RNA, 657 nt, Artificial Sequence
  derived and/or modified sequence opt3 from Yttrium_Y_90_epratuzumab_tetraxetan_LightChain1
gacauccagcugacccaaagccccuccucucucucagccagugugggcgauagagucacaaugagcugcaaguccucucagucgguucuuuacucagcuaaccacaaaaauuaucuggcaugguaccagcagaagccugggaaagccccaaaguuguuaauuuauugggcgagcacuagggagaguggagugccgucccgguucucugguagcggcuccgggacggacuuuaccuucacaauaucaagucugcaacccgaagauaucgcuacuuacuauugucaucaguaccuaagcucuuggaccuuuggaggcgguacaaaaguacagauuaagcgcaccguggccgcaccuuccgucuucaucuuuccacccucagacgagcagcucaagagcgggacugccagugugguuugccugcuuaacaauuucuauccucgagaagcuaaagugcaauggaaggucgauaacgcacugcagucuggaaauucccaggagagcgugacagaacaggacucgaaagauucuaccuacuccuugucaaguacgcucacucugagcaaggccgacuacgagaaacacaagguauaugcuugugagguuacccaucaaggccuguccucuccagugacaaagagcuuuaaccguggcgaaugc

SEQ ID NO: 23872 - RNA, 1326 nt, Artificial Sequence
  derived and/or modified sequence opt3 from Yttrium_Y_90_epratuzumab_HeavyChain1
caggugcaacugguccagagcggcgccgagguuaagaaacccggguccucugugaagguaucaugcaaagcuaguggauacaccuucacaagcuauuggcuccacugggugagacaggcaccuggucagggccuugaauggaucggguacauuaacccaaggaaugacuauacugaguacaaccaaaauuuuaaggauaaagccacgauaaccgcggacgaauccacaaacacugcuuaugagcugucuucguugcggucagaagauaccgccuucuacuuuugugcacgccgagacaucacaaccuucuauuggggacagggcacuacagucaccgugagcagugccuccacgaaggguccgucuguuuuucccuuagcuccuagcuccaagucaacaagugggggaaccgcagcccugggcugccuagugaaagauuacuucccagagcccgucacagugagcuggaacucuggcgcucucacuuccgggguacauaccuuuccugccguucugcagucaagcggacuuuacagucugucuuccguggucacagugccaagcucgucuuuggguacccagacguauauuuguaaugugaaucacaagcccuccaacacuaaagucgacaagcguguugagccuaaaucaugcgauaagacacauaccuguccaccgugccccgcgccugaacuccugggcgggccaaguguguuccuguuucccccuaagccaaaagacacucucaucagcagaacacccgagguaaccuguguggucguggauguuucccacgaagacccggaggugaaguucaauugguacgucgauggaguggagguacauaacgcaaaaacgaagccuagggaggaacaauauaauucuaccuaccggguugugagcgucuuaacagugcugcaccaggacuggcuuaacggcaaagaauauaagugcaaagucucaaauaaggccuugcccgcuccaauugagaagacuaucaguaaagccaagggucagccucgcgaaccccagguguacacccugccacccuccagagaggagacuaaaaaccaaguuagccuaacuugucucgugaagggguuuuauccuucugauauagcaguagaaugggagucaaauggacagccagaaaacaacuacaaaaccacaccgcccguccuggacagugacggcagcuucuuucuuuacuccaagcugaccguggauaagucuagguggcagcaaggcaauguuuucucgugcagcgugcacgaggcuuugcauaaccacuauacucagaaaucccucucacugaguccugggaag

SEQ ID NO: 23873 - RNA, 654 nt, Artificial Sequence
  derived and/or modified sequence opt3 from Yttrium_Y_90_epratuzumab_LightChain1
gacauccagcugacccaaagccccuccucucucucagccagugugggcgauagagucacaagcugcaaguccucucagucgguucuuuacucagcuaaccacaaaaauuaucuggcaugguaccagcagaagccugggaaagccccaaaguuguuaauuuauugggcgagcacuagggagaguggagugccgucccgguucucugguagcggcuccgggacggacuuuaccuucacaauaucaagucugcaacccgaagauaucgcuacuuacuauugucaucaguaccuaagcucuuggaccuuuggaggcgguacaaaaguacagauuaagcgcaccguggccgcaccuuccgucuucaucuuuccacccucagacgagcagcucaagagcgggacugccagugugguuugccugcuuaacaauuucuauccucgagaagcuaaagugcaauggaaggucgauaacgcacugcagucuggaaauucccaggagagcgugacagaacaggacucgaaagauucuaccuacuccuugucaaguacgcucacucugagcaaggccgacuacgagaaacacaagguauaugcuugugagguuacccaucaaggccuguccucuccagugacaaagagcuuuaaccguggcgaaugc

SEQ ID NO: 23874 - RNA, 1365 nt, Artificial Sequence
  derived and/or modified sequence opt3 from Zalutumumab_HeavyChain1
caggugcaacuggucgagagcggcgggggaguugugcagcccgguagaucccucaggcuuucuugcgccgcuucaggcuucaccuuuaguacauacgggaugcacuggguacggcaggcaccuggaaagggccuggaauggguggccgucaucugggacgaugguagcuauaaauacuauggggacuccgugaagggacgcuucacuauuucucgagauaacucgaaaaauacguuguacuuacagaugaacucacugcgugcggaggacaccgcuguuuauuacugugccagagauggcauaacaauggugaggggcgucaugaaggacuauuuugauuacugggggcaaggaacucuagugaccguaagcagugcauccacaaaagguccaucuguuuucccgcucgcccccagcuccaagucaaccaguggcgggacugcugcacugggaugccuugugaaggacuacuuuccugaaccagucacagugagcuggaacucuggcgcccugaccuccggugugcauacguuccccgcugucuugcagucaagcgggcucuauagucugucuuccguugugacuguaccuagcucgucucugggaacccagacauacaucuguaaugugaaucacaaaccauccaacacuaaggucgauaaacggguggagcccaagucaugcgacaaaacccauacauguccuccaugcccggcccccgaacucuuaggcggcccuaguguuuuucuguucccacccaagccuaaggauacccuuaugauuagccgcacgccagaggugacuugugucgugguagacguuucccacgaggaucccgaagugaaauuuaauugguaugucgacgggguggagguccauaacgcgaagacaaaaccgagagaggaacaguacaauucuaccuauagggugguuagcguguugacuguacugcaccaagacuggcuaaacggaaaggaguacaaaugcaaggucucaaauaaagcacucccugcccccaucgaaaagacaauuaguaaggcuaaaggucagccacgggagccucagguguauacccugcccccaucccgcgaagagaugacgaagaaccagguuagccuuaccugucuggugaaaggcuucuaccccucugauaucgccgucgaaugggagucaaaugggcaaccugagaacaauuacaagacaacuccaccgguguuggacagugauggcagcuuuuuccucuauuccaaacugaccguagacaagucucgauggcagcagggaaacguguuuucgugcagcguuaugcacgaagcauuacauaaccacuacacacaaaagucccugucacucagucccgguaaa

SEQ ID NO: 23875 - RNA, 642 nt, Artificial Sequence
  derived and/or modified sequence opt3 from Zalutumumab_LightChain1
gccauccagcugacccaaagccccuccucucucucagcuagugugggcgacagagucacaauuacuugcagggcaagccaggauauauccucugcccuuguuugguaccagcagaagccugggaaagcgccaaagcuguugaucuaugacgcuucgucauuagagagcggagugccgagucgguucuccgguucugaaagcggcacggauuuuacccugacaauuuccucacuacaacccgaggacuucgccacuuacuauugucagcaguuuaacaguuacccucucaccuucgggggaggcacaaaaguagaaaucaagcgcaccguggcagccccaagcgucuuuauuuuucccccuucugaugagcagcugaaauccgguacugcuucagugguuugccuucugaauaacuucuauccacgagaagcaaaggugcaauggaaggucgacaaugccuugcagagcgggaacagucaggagucugugacagagcaggauuccaaagacagcaccuacucgcucucuuccacgcugacucugucaaaggcugauuaugaaaaacacaagguauacgccugugagguuacccaucaaggacucaguagccccgugacaaaauccuucaaucguggcgaaugc

SEQ ID NO: 23876 - RNA, 1332 nt, Artificial Sequence
  derived and/or modified sequence opt3 from Zanolimumab_H0_HeavyChain
caggugcaacugcagcaguggggcgccgggcuccuuaagcccagcgagacccuguccuugacaugcgcugucuacggagguucuuucucaggcuauuacuggaguuggaucagacagccuccagggaaaggauuagaauggauuggcgagauaaaccacagcgguuccacuaauuauaacccgucucugaagucgaggguuacgaucucaguggacaccagcaaaaaucaauuuagucuaaagcucuccucuguaacagcagccgauacugcgguguacuauugugcucgggucauuaacugguucgaccccugggggcagggaacccuggugacaguuagcuccgccucaaccaaaggcccuaguguguuuccacuugcacccagcucuaaguccacuucaggcgggacagccgcucugggaugcuuggucaaggauuacuucccugaaccagugaccguaagcuggaauaguggugcacucacgucuggcguucauacuuuucccgccgugcugcaguccagcgggcuguauucgcucucuuccuggaccgucccuucaaguagcuuaggaacacagacuuacaucuguaacgugaauuucauuaaaccauccaacaccaagguggacaaaaaggucgagccgaaaucuugcgauaagacacacaccugucccccuugcccagcucccgaacugcuuggcgguccuagcguguuuuuguucccacccaagccgaaagacacgcugaugaucucacgcacuccugagguuacauguguaugggaugugagucaugaggaccccgaagucaaguuuaauugguacguggaugggguugaggugcacaacgccaaaaccaagccacgagaggaacaauauaauuccacuuaccgugucgugagcguacuaacaguucuccaucaggacuggcugaacggaaaagaguauaagugcaaagugucuaauaaggcgcuuccugcacccauagaaaagaccaucucaaaagccaagggccagccaagagagccccaggucuacacgcugccuccaaguagggaagagaugaccaaaaaccaagugagcuugacaugucucgucaagggcuucuauccguccgauauugcuguggaaugggagucuaaugggcagcccgagaacaacuacaaaacuaccccuccaguucuggacucggaugguagcuuuuucuuauauuccaagcugacaguggacaagucacgguggcagcaaggaaauguauuuaguugcucugucaugcacgaagcccuccacaaccauuacacucagaaaagccuuucccugucacccggcaag

SEQ ID NO: 23877 - RNA, 642 nt, Artificial Sequence
  derived and/or modified sequence opt3 from Zanolimumab_L0_LightChain
gacauccagaugacccaaagccccuccucugugucagccagugucggcgauagaguuacaauuacuugcagggcuagccaggacauauccucuuggcuggcagugguauaccagcacaagccugggaaagccccaaagcuccuuaucuaugcggcuucgucacugcagagcggagugccgagucgguucuccgguucuggcagcgggacggauuuuaccuugacaauuuccucauuacaacccgaggacuucgccacuuacuauugucagcaggcaaacaguuuuccuuacaccuucggaggcgguacaaaacuggaaaucaagcgcaccgucgccgcuccaagcguguuuauuuuucccccuucugaugagcagcuaaaauccgggacugcaucaguugugugccuccugaauaacuucuauccacgagaagccaagguccaauggaagguggacaaugcccuucagagcggaaacagucaggagucuguaacagaacaggauuccaaagacagcaccuacucgcugucuuccacguugacucucucaaaggcugauuaugagaaacauaagguuuacgcgugugaggugacccaccaaggccugaguagccccgucacaaaauucaaucguggcgaaugc

SEQ ID NO: 23878 - RNA, 1344 nt, Artificial Sequence; identical to SEQ ID NO: 23497
  derived and/or modified sequence opt3 from Zatuximab_HeavyChain1

SEQ ID NO: 23879 - RNA, 657 nt, Artificial Sequence; identical to SEQ ID NO: 23498
  derived and/or modified sequence opt3 from Zatuximab_LightChain1

SEQ ID NO: 23880 - RNA, 1356 nt, Artificial Sequence
  derived and/or modified sequence opt3 from Actoxumab_HeavyChain
caggugcaacuggucgagagcggcgggggaguugugcagcccgguagaucccucaggcuuucuugcgccgcuucaggcuucaguuuuagcaacuacgggaugcacuggguacggcaggcaccuggaaagggccuggaauggguggccuugaucugguaugacgguuccaaugaggauuacaccgacucugucaaagggcgcuucacaauuucgcgagauaacucaaagaauacuuuauaucugcagaugaacagccuacgugcggaagacacggcuguguacuauugugccagauggggaaugguuaggggcgugauagaugucuuugacaucuggggccaagggaccgugguaacaguuaguuccgcaucuacuaaaggaccaagcguguucccgcucgcccccuccucaaagaguaccagcgguggcacagcugcacuggggugccuugucaaagauuacuuuccugagccagugaccgugucuuggaacuccggagcccugacuucaggcguccauacauuccccgcuguuuugcagagcaguggucucuauucucuguccagcgugguaaccgugccuucgucuucccuggggacgcagacuuacauuuguaaugucaaucacaagccaucaaacaccaagguggacaaacggguugaacccaagaguugcgauaaaacacauacuuguccuccaugcccggcccccgagcucuuaggaggcccuagcguguuucuguucccacccaagccuaaagacacccuuaugaucucccgcacaccagaggucaccugugugguaguugaugugucucacgaagaccccgaggucaaguuuaauugguacguggauggcgucgaagugcauaacgcgaagacgaaaccgagagaggagcaguauaauagcacuuacaggguugugucaguauugacaguccugcaccaagacuggcuaaacgggaaggaauauaaaugcaaggugaguaauaaagcacucccugcccccauugagaagaccaucuccaaagcuaagggacagccacgggaaccucagguuuacacucugcccccaagccgcgaggaaaugacaaagaaccaggugucucuuaccugucuggucaaagguuucuaucccucagacauagccguggagugggagaguaauggccaaccugaaaacaacuacaagacgaccccaccgguauuggauagcgacggguccuuuuuccucuauucuaaacugacaguggauaagucgcgauggcagcagggaaauguuuuuagcugcuccgucaugcacgaggcauuacauaaccacuacacucaaaaaucacugagucucucucccggcaag

SEQ ID NO: 23881 - RNA, 642 nt, Artificial Sequence
  derived and/or modified sequence opt3 from Actoxumab_LightChain
gacauccagaugacccaaagccccuccucugugucagccagugucggcgauagaguuacaauuacuugcagggcuagccaggggauauccucuuggcuggcaugguaccagcacaagccuggaaaagccccaaagcuccuuaucuaugcggcuucgucacugcagagcggugugccgagucgguucuccggcucugggagcggaacggacuuuaccuugacaauuuccucauuacaacccgaggauuucgccacuuacuauugucagcaggcaaacaguuuuccuuggaccuucggccaggguacaaaaguagaaaucaagcgcaccguggccgcuccaagcgucuuuauuuuucccccuucugacgagcaacugaaauccgggacugcaucagugguuugccuacucaauaacuucuacccacgagaagccaaggugcaguggaaggucgauaaugcucugcagagcggaaacagucaggagucugugacagaacaagacuccaaagauagcaccuauucgcuuucuuccacgcugacuuugucaaaggccgacuacgagaaacauaagguauaugcgugugagguuacccaccagggccucaguagccccgugacaaaauccuucaaucguggcgaaugc

SEQ ID NO: 23882 - RNA, 1326 nt, Artificial Sequence
  derived and/or modified sequence opt3 from Andecaliximab_HeavyChain
caggugcaacugcaggagagcggccccgggcucgucaagccuuccgaaacccuuucucugacaugcacuguuucaggauucaguuuguuaagcuacggugugcacuggguaagacagccaccgggcaaagggcuggaguggcuaggagugaucuggacgggcgguaccacaaacuauaauuccgcccucaugucuagguuuacuauuucgaaggacgauucaaagaacaccgucuaccugaaaaugaauagccuuaaaacagaagacaccgcuauauauuacugugcacgguauuacuaugggauggauuacuggggacagggcacucuggugacaguuaguuccgccucuaccaagggccccagcguguucccuuuggcgccaugcucccgcucaacgagugagagcacugcugcccucgggugucuggucaaggacuacuuucccgaaccugugaccguaucuuggaacuccggagcacugacaucagguguucauacuuucccagccgugcuccaaagcaguggcuuauauucucuguccagcgucgugaccgugcccucgucuucccuugggacaaaaaccuacacgugcaaugucgaucacaagccuucaaacacuaaaguugacaagcgaguggagaguaaauauggaccaccgugucccccuugcccagcucccgaguuuuugggcgguccuagcguauuccuguuuccacccaagccgaaggauacacuaaugaucucccguaccccugaagugacuugugucgugguugacgugucucaggaggaucccgaaguccaguucaauugguacguggacgggguagagguucauaacgcaaaaacaaagccaagagaggaacaguuuaauagcaccuauaggguggucucagugcucacgguccugcaccaagauuggcuuaacggaaaagaguacaagugcaaagugaguaauaagggccugccuuccagcauugagaaaaccaucucuaaggccaagggccagccccgggaaccacagguuuauacauugcccccuucacaggaagagaugacuaaaaaccaagugagucucaccugucugguaaagggguucuacccaagcgacauugcugucgagugggaauccaauggacagccggagaacaauuacaaaacaacucccccuguguuagauucugacgguucguuuuuccuguauagccgccucaccguugacaaguccagauggcaggaaggcaacguguuuucaugcagugucaugcaugaggcccuucacaaccacuacacacaaaaaucucugagcuugucccuagggaag

SEQ ID NO: 23883 - RNA, 642 nt, Artificial Sequence
  derived and/or modified sequence opt3 from Andecaliximab_LightChain
gacauccagaugacccaaagccccuccucucugucagccagugugggcgauagagucacaauuacuugcaaggcuagccaggacguuaggaacacgguggcaugguaccagcagaaaccugggaaggccccaaaacuccuuauauauuccucuucguaccggaauaccggaguaccggaucgcuucucagguagcggcagugggacagacuuuacucugaccaucuccucuuugcaagcggaggauguggcugucuauuacugucagcagcacuauauuacacccuacaccuucggaggcgguacuaagguggaaaucaaacgaacaguugccgcaccuagcguguuuauuuucccacccuccgacgagcaguuaaagucagggaccgccagugucgugugccugcuaaacaauuuuuauccucgugaagcuaagguacaauggaaaguugauaacgcacuccagagcggaaauucucaggaguccgugacggaacaggacucaaaggauagcacuuacagucugucuuccacccuuacacugagcaaagccgacuacgagaagcauaaagucuaugcuugugaggugacucaccaaggcuugucgucuccagugaccaaguccuucaacagaggcgaaugc

SEQ ID NO: 23884 - RNA, 1353 nt, Artificial Sequence
  derived and/or modified sequence opt3 from Aprutumab_HeavyChain
gaggugcagcugcucgaaagcggcgggggacuuguccaacccgguggcucccugagauugucuugcgccgcuucaggguucaccuuuaguagcuacgcaauguccuggguuaggcaggccccuggaaagggcuuagagugggugucugcgaucucggguucagggacaagcacuuauuacgcugacaguguaaaaggacgguucacgauuucccgcgauaacucuaagaauacccuguaucuacagaugaacagccuccgagccgaagacacagcaguguacuauugugcccgugucagauacaauuggaaccacggcgauugguuugacccauggggccaggggacucuggugaccguuuccucagcuaguacaaaaggaccgagcguguucccccuugcaccuucuuccaagucaaccagcgguggcacugccgcucuggggugcuuggucaaagauuauuuuccagagcccgugacaguaaguuggaacucuggagcccucaccuccggcguucauacguucccugcggugcugcaaagcucgggucuguacucucucuccucagucgugacugugccaaguagcuccuuagggacccagacauacauauguaaugucaaucacaagcccucuaacacuaagguugacaaaaagguggaaccuaaaagcugcgauaagacccauacauguccaccgugccccgcaccugagcugcuuggaggcccaucaguauuuuuguuucccccuaaaccaaaggacacccugaugaucaguaggacgcccgaggugacuugugucgugguugaugugucccacgaagacccggaggucaaguucaauugguauguggauggcguagaaguucauaacgccaaaacaaagccucgggaggagcaguacaauagcaccuaucgcguggucucugugcuaacuguccuccaccaggacuggcugaacgggaaagaauacaagugcaaagugucaaauaaggcccuucccgcuccaauugagaaaacaaucaguaaggcaaagggacaaccuagagaaccccagguuuauacccugccacccagcagggaugaguugacgaaaaaccaggugucccucaccugucugguaaaggguuucuacccuucugacauugcugucgaaugggagucgaauggccagccagagaacaacuauaaaacaacuccgcccguguuagacagcgauggguccuuuuuccuguacucaaagcucaccguugacaaaagucgguggcaacagggaaauguguuuucuugcagcgucaugcacgaagcccuucauaaccacuacacacagaagucccugucauugagcccuggc

SEQ ID NO: 23885 - RNA, 648 nt, Artificial Sequence
  derived and/or modified sequence opt3 from Aprutumab_LightChain
cagagcgugcugacccaacccccuuccgccucuggcacaccagggcagagagucacuaucucaugcaguggaagcuccucuaacauugguaauaacuacguuucgugguaucagcagcucccgggcacggcucccaaacuucugauauacgagaauuauaacaggccugcaggggugccagaccgguucucaggaagcaaaaguggcaccuccgccucuuuggcgaucagcgguuuacgcuccgaagaugaggcugacuacuauuguucaaguugggaugacagccugaauuacuggguauuugggggaggcacaaagcuaacugugcucggccaacccaaagccgcaccuucugucacccuguucccacccuccucagaggaacuucaggccaacaaggcuacacuggugugcuugauuagcgauuuuuauccuggggcaguuaccguggccuggaaagcugacaguucuccagucaaggccggaguggaaacuacaaccccguccaagcagagcaauaacaaauacgcggcaucgucuuaccucucccugacgcccgagcaguggaagucacaccgaaguuauagcugucaaguaacucaugaggguuccaccguugaaaagacaguggccccuacugagugcucu

SEQ ID NO: 23886 - RNA, 1341 nt, Artificial Sequence
  derived and/or modified sequence opt3 from Azintuxizumab_HeavyChain
gaggugcagcuggucgaaagcggcgggggacucguucaacccgguggcucccuuagacugucuugcgccgcuucaggguucaccuuuagugacuacuauauggcaugggugaggcaggccccuggaaagggcuuggaguggguagcgagcaucaacuacgaugguuccucuacauauuacguggacucggucaaagggcgguucacuauuucacgcgauaaugcuaagaacagcuuauaucugcagaugaauagucuacgagccgaagacacggcaguguacuauugugcccgugauagaggauacuacuuugacuauuggggccagggcaccacaguuacuguguccucugcuagcaccaaagggccauccgucuucccgcucgcacccucaaguaagagcacaucuggagguaccgccgcucugggcugccuugugaaagauuacuuuccugagccaguaacuguuuccuggaacucaggggcccugacaagcggagugcacaccuuccccgcggucuugcaaaguucuggccucuauucccugagcucgguggugacggucccuucuuccucacuggguacucagaccuacauauguaauguuaaccauaagccaaguaauacaaagguggacaaaaagguagaacccaaaagcugcgauaagacucacaccuguccuccaugcccggcacccgagcucuuagggggaccuuccguguuucuguucccacccaaaccuaaggacacacuuaugaucucuaggaccccagaggucacgugugugguuguggaugucagccaugaagaccccgaggugaaguuuaacugguauguagauggcguugaagugcacaaugccaaaacuaagccgcgggaggagcaguacaacucaacauaucgcgucgugagugucuugaccgugcugcaucaggacuggcuaaauggcaaagaauacaagugcaaaguuuccaacaaggcucucccugcccccauugagaaaacuaucagcaaggcaaaggggcaaccaagagaaccucagguguacacacugcccccaucuagggaggaaaugaccaaaaaucagguaucacuuacgugucuggucaagggauucuaucccagugacauugcuguggagugggagagcaacggucagccugaaaauaacuacaaaaccacaccaccgguuuuggauuccgacggcucguuuuuccucuauucuaagcugacuguggauaaaagccgguggcaacaggggaacgucuuuuccugcucagugaugcacgaggccuuacacaaucauuacacccagaagagucugucucucagccccggaaag

SEQ ID NO: 23887 - RNA, 660 nt, Artificial Sequence
  derived and/or modified sequence opt3 from Azintuxizumab_LightChain
gacguggucaugacccagacaccccugagccucuccguuacuccuggccaaccagccucuaucucaugcagaaguagccagucccuugugcacucuaacgggaauacguaccugcauugguauuugcagaaaccgggacagucgccccaauuacugauuuacaaaguaucaaacagguucagcggugugccugaucgguuuaguggcuccgggucuggaaccgacuucacacuaaagauaagccgcgucgaggcugaagaugugggcguuuauuuuuguucccagucaacucacgugccacccuucaccuuuggugggggaacaaaagucgagaucaagcgaaccguggcagccccuaguguauucauuuuuccacccagcgacgaacagcucaaaucuggcacugcguccguugugugccugcuuaauaacuucuacccucgugaggcuaagguccaguggaagguggauaaugcccugcaaucaggcaacagccaggaaagugugacagagcaggacucuaaagauuccaccuauagcuugucgucuacgcucacucuguccaaggcagacuacgagaaacauaaggucuaugccugugaaguuacccaccaggggcugucaaguccagugacaaagagcuuuaauagaggagagugc

SEQ ID NO: 23888 - RNA, 366 nt, Artificial Sequence
  derived and/or modified sequence opt3 from Blinatumomab_HeavyChain1
caggugcaacugcagcagagcggcgccgagcucgucagacccggguccucuguuaagaucucaugcaaagcuaguggauacgcauucagcuccuauuggaugaacugggugaagcagaggccuggucaaggccuugaauggauugggcagauauggccaggagacggcgauaccaauuacaacgguaaauuuaaggggaaagccacacugacugcggacgagucuucgucaacggcuuauaugcaguugagcaguuuagccuccgaagauucugcaguauacuucugugcccggcgcgagaccacaacugugggacgauauuacuaugcuauggacuacuggggccagggcaccacagucaccgug

SEQ ID NO: 23889 - RNA, 363 nt, Artificial Sequence
  derived and/or modified sequence opt3 from Blinatumomab_HeavyChain2
gacaucaagcugcagcaaagcggcgccgagcucgcuagacccggggcauccgugaaaaugucuugcaagaccucaggauacacauucacuagguauacgaugcacugggucaaacagcggccuggucagggccuugaauggauuggguacauaaacccaagucgcggauauaccaauuacaaccagaaguuuaaagauaaggccacacugacuaccgacaagagcuccucuacagcguauaugcaauugucgucauuaaccagcgaggauagugcuguuuacuauugugcccgauacuacgacgaucauuauugccuggacuacuggggccaggguacuacacuaaccguguccucuguagaa

SEQ ID NO: 23890 - RNA, 1494 nt, Artificial Sequence
  derived and/or modified sequence opt3 from Blinatumomab_LightChain_HeavyChain_HeavyChain_LightChain
gacauccagcugacccaaagccccgccucccucgcugugucucuuggccagagagcaacaauuucaugcaaggccagucagagcgucgauuacgacggggauuccuaucugaacugguaccagcaaauaccuggacagccaccgaaauuguuaaucuaugacgcgucuaaucugguuucggguauucccccuagguucucaggcagcgggaguggaacugauuuuacgcuaaacauccacccaguggagaagguagacgcugccaccuaccauugucagcaguccacagaagaucccuggacuuucggcggugggaccaaacucgagauuaagggaggcggcgggucuggagguggcgggagcggaggcggugggucccaagugcagcugcagcagucaggagcagaacuuguccggccuggcaguagcgugaaaaucucuugcaaggccuccggcuaugcuuuuucaagcuacuggaugaauuggguuaagcaacgcccagggcagggacuggaguggauaggucagaucuggcccggcgacggggauacaaacuauaauggaaaauucaagggcaaagcaaccuugacugccgacgaaaguucuuccacagcuuacaugcaacucagcucgcuggccucugaggauuccgcgguguacuuuugugcacgacgugagaccacgacugucgguagauauuacuaugccauggacuacugggggcagggcaccacagugacuguaucaaguggaggcgggggaagcgauauuaagcugcagcaguccggugcugaacucgccaggccuggcgcaucuguuaaaaugagcugcaagaccucaggguauacauucacccgguacacgaugcacugggugaagcaacgcccaggacagggcuuagaguggaucgguuauauuaacccgaguagaggguacacuaauuacaaccagaaauuuaaggacaaagcuacacugaccacugacaaguccagcucuacagccuauaugcagcuuucaaguuugaccagcgaagauuccgcggucuacuauugugccagguacuaugacgaucauuacugccuggacuauuggggccaaggaacgacccuaacagugucuucgguggagggcgggagcggagguuccggcgggucaggaggcagugguggggucgaugacauccagcucacucagucucccgcaauaaugagcgcuuccccuggcgagaaaguuaccaugacaugucgggccucaagcucuguguccuacaugaauugguaccagcaaaagaguggaacuagcccaaaacgcuggauuuaugauaccucuaagguagcuuccggcgugcccuaccgauucucagggaguggaagcggcacaucguauucccugaccaucucuagcauggaagccgaggacgcagccacuuacuauugccagcaguggucaaguaacccucuuacguuuggugcugggacaaagcuggaauugaaa

SEQ ID NO: 23891 - RNA, 333 nt, Artificial Sequence
  derived and/or modified sequence opt3 from Blinatumomab_LightChain1
gacauccagcugacccaaagccccgccucccucgcugugucucuuggccagagagcaacaauuucaugcaaggccagucagagcgucgauuacgacggggauuccuaucugaacugguaccagcaaauaccuggacagccaccgaaauuguuaaucuaugacgcgucuaaucugguuucggguauucccccuagguucucaggcagcgggaguggaacugauuuuacgcuaaacauccacccaguggagaagguagacgcugccaccuaccauugucagcaguccacagaagaucccuggacuuucggcggugggaccaaacucgagauuaag

SEQ ID NO: 23892 - RNA, 324 nt, Artificial Sequence
  derived and/or modified sequence opt3 from Blinatumomab_LightChain2
guggacgauauccagcugacccaaagccccgccauuauguccgcuucuccuggcgagaaggucacaaugacuugcagagcaucaaguagcguuuccuacaugaacugguaucagcagaaaucugggacgucgccaaagagguggauauacgacaccucaaaaguggccagcggaguaccguaucgguucagugguuccggcucugggacaagcuacucccucacuaucucaaguauggaagcggaggaugcugccaccuauuacugucagcaauggagcucuaauccccuuacauuuggagcaggcaccaagcuggaauugaaa

SEQ ID NO: 23893 - RNA, 1350 nt, Artificial Sequence
  derived and/or modified sequence opt3 from Brazikumab_HeavyChain
caggugcaacuggucgagagcggcgggggaguugugcagcccgguagaucccucaggcuuucuugcgcugcuucaggcuucaccuuuaguagcuacgggaugcacuggguacggcaggcaccuggaaagggccuggaauggguggccgucaucugguaugacgguuccaacgaguacuaugcggauucugugaaagggcgcuucacaauuucgcgagacaauucaaagaacacuuuguacuuacagaugaauagccugcgugcugaagauacggccguuuauuacugugcaagagacaggggauauaccaguuccugguacccagaugccuuugacauauggggccaaggcacaauggugacugucucuagcgcuuccaccaaagggccgucaguguucccccuagcaccuugcagucggagcacaucugaguccaccgccgcucucggaugucugguaaaggauuacuuuccagaacccguuacugugucauggaacagcggugcccuuacaaguggcguccauaccuucccugcggugcugcagucuuccggguuguauagccucucgucuguggucacgguuccauccucaaauuuuggaacucagaccuacacaugcaacguggaccacaaacccaguaauacuaagguagauaagaccguggagcgcaaauguugcgucgaguguccuccaugcccggcacccccuguggccggcccaagcguuuuccuguuucccccuaagccaaaagacacacugaugaucuccagaacccccgaagugacgugugucgugguagauguuucucaugaggacccggaagugcaguucaacugguaugucgaugguguggagguccacaaugcuaagacuaaaccuagggaggaacaauuuaacagcacauuccgggugguuucagugcucaccguaguccaucaggacugguuaaaugggaaggaguacaagugcaaagugaguaacaagggacugcccgccccaauugagaaaacuaucuccaagacaaaaggccagccucgcgaaccccagguuuauacccuuccacccagccgagaagagaugacgaagaaucaagugucuuugaccugucuggucaaaggcuuuuacccuucagacauugcaguggagugggaaaguaacgggcagccagagaauaacuauaagacaacuccgcccaugcuagauagcgacggauccuucuuccucuacucuaagcugaccguagauaaaucgagauggcagcaagguaacguguuuagcugcuccguuaugcacgaagcccuucacaaucauuacacacagaagucacugaguuugucuccuggcaaa

SEQ ID NO: 23894 - RNA, 651 nt, Artificial Sequence
  derived and/or modified sequence opt3 from Brazikumab_LightChain
cagagcgugcugacccaacccccuuccgucucuggcgccccagggcagagaguuacaaucucaugcacuggaaguagcuccaacacgggugcuggcuacgacgugcacugguaucagcagguaccggggaccgcacccaagcuccuuauuuacggaucuggcaauaggccuucgggugugccagaucgguucucagggagcaaaaguggaacauccgccucucuggcgauaacuggcuugcaagcugaggacgaagccgauuauuacugucagagcuaugacuccucauuaaguggcugggucuuugggggagguacccgccugacagugcuaggccagcccaaggcagccccuagcguuacccucuucccacccucuuccgaggaacugcaggcuaacaaagcaacucuugugugccugaucucagauuuuuacccuggggccgucacaguggcuuggaaggccgacagcaguccaguaaaagcgggaguugagaccacgacuccgucuaagcaauccaauaacaaguaugcagccagcucguacuugucucucacccccgaacaguggaaaucccaucgaucauacaguugucaggugacacacgagggcagcacugucgagaagaccguggcuccuacagaaugcucc

SEQ ID NO: 23895 - RNA, 363 nt, Artificial Sequence
  derived and/or modified sequence opt3 from Brolucizumab_HeavyChain
agcgaggugcagcuggucgaauccggcgggggacucguucaacccgguggcucucuuagacugucaugcaccgccaguggguucagcuugacagacuacuauuacaugacuugggugaggcaggcuccuggaaagggcuuagaguggguagguuuuaucgauccagacgaugacccguauuacgcaacgugggccaaagggcgguucaccauuucccgcgauaacucuaagaauacacuguaucuacagaugaacucgcuccgagcggaagacacugcuguguacuauugugccggaggcgaucacaauucaggcugggggcuggacauauggggacaggguacccuugucacagugagcagu

SEQ ID NO: 23896 - RNA, 333 nt, Artificial Sequence
  derived and/or modified sequence opt3 from Brolucizumab_LightChain
auggagaucgugaugacccagagccccuccacacugucugccucagucggcgacagaguuauuauaacuugccaagcuagugaaaucauucacagcuggcucgcaugguaccagcagaagccugggaaagccccaaaacuucugaucuauuuggcguccacguuagcuucuggagugccgucgagguucucagguagcggcaguggggccgaguuuacccugacaauuuccucucuacagcccgaugacuucgcaacuuacuauugucaaaacguauaccucgccagcaccaauggagcuaacuuuggccaggguacaaagcugaccgugcuu

SEQ ID NO: 23897 - RNA, 1347 nt, Artificial Sequence
  derived and/or modified sequence opt3 from Cabiralizumab_HeavyChain
caggugcagcugguccagagcggcgccgagguuaagaaacccggguccucugugaagguaucaugcaaagcuaguggauacaccuucacagacaacuauaugaucugggugagacaggcaccuggucagggccucgaauggaugggggauauuaauccauacaacggaggcacuacguuuaaucaaaaguucaaagguagggucaccauaacagccgacaagagcacuuccaccgcguauauggagcuuucuucgcugcggucagaagauacagcuguguacuauugugcccgcgagagcccguacuuuaguaacuuguauguuauggacuacugggggcagggaaccuuagugacugucuccucugcaagcacaaagggccccuccguguucccucuggccccaugcucacgaaguaccagcgaaucuacggcugcacuaggcugucucguaaaagauuacuuucccgagccuguuacuguguccuggaauagcggggcccugaccagcggaguccacacauucccagcugugcuucagaguucuggucuguauuccuugagcucgguggucacuguucccucuuccucacucggcaccaagacauauaccugcaacguggaccauaaaccuaguaauacgaagguagauaaacguguggagagcaaguacgggccaccgugucccccuugcccagcccccgaauuucugggaggcccuuccgucuuccuguuuccacccaagccgaaagacacucucaugaucucuagaacaccugaggugaccuguguuguggucgaugugagccaggaagaccccgagguacaauucaacugguacguugaugguguggagguccacaaugcgaagacuaaaccaagggaagaacaguuuaacucaacauaucggguggucaguguguuaaccguucugcaucaggacuggcuuaaugggaaggaauacaaaugcaagguguccaacaaaggauugccuagcucuauugagaagacgaucucaaaggcaaaaggccagccccgcgaaccacaaguauauacccugcccccuagucaggaggagaugacaaagaaucaggucagccuaacuugucucgugaaaggcuucuacccauccgauauugccguugaaugggagucuaacgggcaaccggaaaauaacuacaagaccacacccccugugcuggacucggacggaucauuuuuccuuuauuccagacugacugucgauaaaucaagguggcaggaggguaacguguucaguugcucuguaaugcacgaggcuuugcauaaucacuacacccaaaagagccucucccugucauuaggcaag

SEQ ID NO: 23898 - RNA, 654 nt, Artificial Sequence
  derived and/or modified sequence opt3 from Cabiralizumab_LightChain
gagaucgugcugacccagagccccgccacacucucccuuucuccuggcgaaagagcuacucugucaugcaaggcaagucaaagcgucgacuacgauggggacaacuauaugaauugguaccagcagaaaccaggacaggccccgagguuguuaauuuaugcggcuuccaaccuggagucugguauacccgcccgguucucgggcucagggagcggaacggauuuuacccuaacaaucaguucccucgaaccugaggacuucgcaguuuacuauugucaccugucuaaugaagaucuuagcacuuuuggcggugggaccaagguggagauuaaacgcacaguagccgcuccauccguguucaucuuucccccuucagacgagcaacugaagaguggaaccgcaagcgucgugugcuugcucaacaauuucuacccacgagaagccaaaguucaguggaagguggauaacgcucugcagucuggcaauucccaggagucagucacugaacaagacagcaaggauaguacauauucucuguccagcacccucacguuaucgaaagccgacuacgagaagcauaaaguguacgcgugugagguaacucaccagggccugucuucccccguuaccaagucauuuaaccguggggaaugc

SEQ ID NO: 23899 - RNA, 1329 nt, Artificial Sequence
  derived and/or modified sequence opt3 from Camrelizumab_HeavyChain
gaggugcagcuggucgaaagcggcgggggacucguucagcccgguggcucccuuagacugucuugcgccgcuucaggguucaccuuuaguagcuacaugauguccugggugaggcaggcaccuggaaagggcuuggaguggguagccacaaucucuggugggggagcgaacacuuauuacccagacucggugaaaggccgguucacgauuucacgcgauaaugcuaagaacagcuuauaucugcagaugaauagucuacgagccgaagacaccgcagucuacuauugugcccgucagcucuacuauuuugauuacuggggccaagggacaacugugaccguuuccucugcuagcacaaaaggaccguccguguucccccuggcaccuugcucaagaaguaccagcgagucuacugccgcucuugguugucuggucaaggacuacuuuccagaacccgugacaguauccuggaacucaggcgccuugaccagcgggguucacacguucccugcggugcuccagaguucuggacuguauucccugagcucggucgugacugugccaucuuccucacucggcaccaaaacauacacuugcaaugucgaucauaagcccaguaacaccaagguugacaaaaggguggagagcaaguaugguccuccauguccgcccugcccugcaccagaguuuuuagggggacccuccguauuccuguuuccuccaaaacccaaggauacacuuaugauaucucggaccccggaagugacgugugucgugguugacgugagccaggaggauccugaaguccaguucaauugguacguggacggcguagagguucacaacgccaaaacuaagccccgcgaggaacaauuuaauucaacauauagaguggucaguguguugaccguccugcaucaggauuggcuaaacggcaaggaguacaaaugcaagguguccaauaaagggcucccaagcucuaucgaaaagacuauuucaaaagcuaagggacagccuagggagccccagguuuauacacugccacccagucaagaagagaugaccaaaaaccaggugagccuuacgugucugguaaaggguuucuacccuuccgacaucgccgucgagugggaaucuaauggccagccagagaacaauuacaagaccacaccgcccguguuggauucggacgggagcuuuuuccucuauucccggcugacuguugacaaaucacgcuggcaagaaggaaacguguucaguugcucugucaugcacgaggcauuacauaaccacuacacccaaaagagccugucccucucacuuggcaaa

SEQ ID NO: 23900 - RNA, 642 nt, Artificial Sequence
  derived and/or modified sequence opt3 from Camrelizumab_LightChain
gacauccagaugacccaaagccccuccucucugucagccagugugggcgauagagucacaauuacuugccucgcuagccagacgauagggaccuggcuuacaugguaccagcagaagccuggaaaagcaccaaagcuguugaucuauacugccaccuccuuagcggacgguguuccgucuagguucucgggcucagggagcggaacagauuuuacccugacuauuaguucccuacaacccgaggacuucgcuacauacuauugucaacagguguacucuaucccuuggaccuuuggcggugggacgaaaguagaaauuaagcggacuguggccgcaccaagcgucuucaucuuucccccuuccgaugagcagcucaaaucaggaaccgccagugugguuugccugcuuaacaauuucuauccacgcgaagcuaaggugcaguggaaggucgacaacgcacugcagagcggcaauucucaggaguccgugacagaacaggauucaaaagacagcacuuacaguuugucuuccacccucacacugagcaaggccgauuaugagaaacacaagguauacgcuugugagguuacccaucaaggccugucgucucccgugacgaaauccuuuaaccgaggggaaugc

SEQ ID NO: 23901 - RNA, 777 nt, Artificial Sequence; identical to SEQ ID NO: 23068
  derived and/or modified sequence opt3 from Caplacizumab_HeavyChain

SEQ ID NO: 23902 - RNA, 657 nt, Artificial Sequence
  derived and/or modified sequence opt3 from Citatuzumab_bogatox_HeavyChain
gaggugcagcugguccaaagcggccccgggcucguucagccuggagguuccgugagaaucucuugcgccgcuucaggcuacaccuucacaaacuaugggaugaauuggguaaagcaggcaccaggaaaaggccuugaauggauggguuggauuaacacuuacacgggggagaguaccuaugccgacagcuuuaagggaagguucacauuuucccuggauacuucugcgucggcugccuacuugcagauaaauucauuacgggcagaagacaccgccguguauuacugugcucgcuucgcaaucaaaggcgauuauuggggccaagggacacugcuaaccgucagcagugccuccacuaagggaccgucuguguuuccccucgcuccuagcuccaaaucaacaagugguggcaccgccgcgcuggggugccuuguuaaggacuacuucccagagcccgugacggucagcuggaacucuggagcacugacuuccggcgugcacaccuuuccugccguauugcagucaagcggucucuacagucugucuuccguugugacagucccaagcucgucucuggggacucagaccuauauuuguaaugugaaccauaagcccuccaauacaaaaguggauaagaaagucgaaccuaagucaugc

SEQ ID NO: 23903 - RNA, 1356 nt, Artificial Sequence
  derived and/or modified sequence opt3 from Cosfroviximab_HeavyChain
gacgugaagcugcucgagagcggcgggggacuuguccagcccgguggcucccugaaauugucuugcgccgcuucaggguucaguuuaagcaccuccggaguuggcguggguugguuuagacaaccuucugggaagggacuggaauggcuagcacucaucuggugggaugacgauaaauacuauaacccaucgcugaagucacagcuuagcauuaguaaagacuucuccaggaaucagguauuucugaagauaucuaacguggauaucgccgacacagcgacuuacuauugugcucggcgcgauccguucggcuacgacaaugccaugggcuauugggggcagggaacgagcgucaccguguccucagcaaguacaaagggucccagcguuuuuccuuuggccccaucuuccaaaucaacuagcggcgggaccgcugcacucggaugccuggugaaggauuacuuccccgagccugucacagugaguuggaacucuggcgcccugaccuccgguguacacacuuuuccagcuguucuccaaagcucgggguuauauucucuguccucaguggucacagugcccaguagcucccuuggaacccagacguacauuuguaaugugaaccauaaaccuucuaauacuaaggucgacaaacgaguugaaccaaagagcugcgauaagacccacacauguccgcccugcccugccccagaguugcugggcggccccucaguguuccuauuuccuccaaaacccaaggacacucucaugaucagucguaccccggaaguaacauguguggucguggauguuucccaugaggacccugaggugaaauucaacugguacgucgacgggguggaaguacacaaugcgaagaccaaacccagagaggaacaguauaacagcacguacaggguugugucuguccugacugugcuucaucaggauuggcugaauggaaaggaguauaaaugcaaggucucaaacaaggcauugccagccccuauugagaaaacaaucaguaaggcuaaaggucaaccccgggaaccacagguguacacccugcccccuagccgcgacgagcucacuaagaaucagguuuccuuaacaugucuggugaaaggcuuuuauccaucugauauagccguagaaugggagucgaacgggcagccggaaaauaacuacaagaccacgcccccuguccucgacagcgauggauccuucuuucuuuauucaaagcugaccguggacaaaaguagauggcaacagggcaacguuuucucuugcagcgugaugcacgaggcauugcacaaucauuacacacagaagucccuaucacugagcccagguaaa

SEQ ID NO: 23904 - RNA, 639 nt, Artificial Sequence
  derived and/or modified sequence opt3 from Cosfroviximab_LightChain
gacaucgugaugacccagagcccccugucccucucuacaucagucggcgauagaguuagucuuacuugcaaggccagccaaaacguggggacggcuguagcaugguaccagcagaaaccuggacaguccccaaagcuguugauuuauucugccucgaauagguacaccggugugccggaccgguucacaggcucagggagcggaacugauuuuaccuuaacaauaaguaacaugcaauccgaggaccuggcggauuauuucugucagcaguacucuagcuauccccuaaccuuuggcgcugguacuaaacucgaacugcgcacagucgccgcaccuuccguguucaucuuuccacccucagacgagcagcuuaagagugggaccgccagcguugugugccuguugaauaacuucuacccucgagaagcuaaaguccaauggaagguggauaaugcacuccagucuggaaacucccaggagucaguaacggaacaggacagcaaggauaguacuuauucucuguccagcacccugacacucucgaaagccgacuacgagaagcacaaaguuuacgcuugugaggugacucaucaaggcuuaucuuccccagucaccaagucauuuaaucguggcgaaugc

SEQ ID NO: 23905 - RNA, 1344 nt, Artificial Sequence
  derived and/or modified sequence opt3 from Crizanlizumab_HeavyChain
caggugcaacugguccagagcggcgccgagguuaagaaacccggggcuuccgugaagguaucuugcaaagugucaggauacaccuucacaaguuaugacaucaacugggucagacaggcaccugguaagggccucgaauggaugggguggauuuacccaggagauggcagcauaaaauauaaugagaaguuuaaggguagggugacuaugacgguugacaaauccaccgauacagccuacauggaacuuucuucgcugcggucagaggacacugcgguguauuacugugcucgccgaggggaauauggaaacuacgagggcgccauggauuacuggggccaggggaccuuggucacagugagcagugcauccaccaagggaccgucuguauuccccuuagccccuugcagccguuccacuucagagaguacagcugcacuggguugucuaguuaaagacuauuuuccagaacccgugaccgucagcuggaacucuggcgcccucacguccggggugcacacuuucccugcugugcugcaaucaagcggacuuuacagucugucuuccgucguuaccgugacaagcucgaauuuuggcacucagaccuauacaugcaauguagaucauaagccaucuaacaccaaaguggacaagacggucgagagaaaguguugcguggaaugucccccuugcccagccccgcccguugcggguccuuccguguucuuguuuccacccaaaccuaaggauacucucaugaucucaaggacaccagaggucaccugugugguaguugacgugagucacgaggaucccgaaguccaguucaauugguacguggacgggauggagguccauaacgcaaaaacuaagccgcgggaggaacaguuuaauagcacauuccgcgugguuuccgugcugaccguaguccaccaagauuggcugaacggaaaagaauauaagugcgccgugucuaauaaaggccucccugcucccauugagaagacgaucagcaagaccaaaggccagccaagagagccucagguuuacacauuacccccaucaagggaagagaugacuaagaaccaggugagucugaccugucuugucaaaggguuuuaucccuccgacauugccguggaaugggagagcaauggacaaccugaaaacaauuacaagacaacuccaccgauguuggacucugaugguucauucuuucuguacaguaaacuaaccguagacaagagccgguggcagcagggcaacguguucuccugcucuguuaugcaugaggcacuccacaaccacuauacacaaaagucgcugagccuuucccccgggaaa

SEQ ID NO: 23906 - RNA, 654 nt, Artificial Sequence
  derived and/or modified sequence opt3 from Crizanlizumab_LightChain
gacauccagaugacccaaagccccuccucucugucagccagugugggcgauagagucacaauuacuugcaaggcuagccaguccguugacuacgaugggcacucuuauaugaacugguaccagcagaaaccuggaaaggcaccaaaacuccuuauauaugccgcgucgaaucuggagucaggugugccgagcagguucaguggcuccgggucuggaacggacuuuaccuugacaaucagcuccuuacaacccgaagauuucgcuacuuacuauugucagcagucagacgagaacccucugaccuuuggcggugggacaaagguagaaauuaaacggaccguggccgcaccaagugucuucaucuuucccccuagcgaugagcagcuaaagucuggaacugccuccgugguuugccuccugaauaacuucuacccacgcgaagcuaaggugcaauggaaagucgacaaugcacuucagucaggcaacagccaggagagugugacagagcaggauucuaaggacuccaccuauagccugucgucuacguugacucucuccaaagccgauuacgaaaagcauaaaguauacgcuugugagguuacccaccaaggccugucaagucccgugacaaagagcuuuaaucgaggggaaugc

SEQ ID NO: 23907 - RNA, 1365 nt, Artificial Sequence
  derived and/or modified sequence opt3 from Crotedumab_HeavyChain
gaggugcagcuggucgaaagcggcgggggacucguucaacccgguggcucccuuagacugucuugcgccgcuucaggguucaccuuuaguaacuacuugaugaauugggugaggcaggcaccuggaaagggcuuagaguggcuggccaacauccaggaagacgguauugagaaauauuacguagauagcgugaaggggcgguucacaauaucccgcgacaaugcgaaaaacucucuauaucuccagaugaacucgcugcgagcugaagauacugccgucuacuauugugcacgugagccaucacacuacgacauccuuacgggauaugauuacuacuauggcauggacguguggggccaagggaccacaguuacugugagcagugccuccaccaagggaccgucugucuuuccccuggcuccuugcagcagauccacaucagagaguaccgcagccuuggguugucucgugaaagauuacuucccagaacccguaacuguuagcuggaacucuggcgcucugacauccggggugcauaccuuuccugccguccugcagucaagcggacucuauaguuuaucuuccguggugacggucccaagcucgucucugggcacuaagaccuacacaugcaauguugaccacaagcccuccaauacuaaaguggauaagaggguagagucaaaauaugguccuccauguccgcccugcccugcgccagaguuccuugggggacccaguguguuuuuguucccuccaaagcccaaagacacccugaugauuagccggacaccggaagucaccugugugguuguggaugucucccaggaggacccugaagugcaguuuaauugguacguagauggcguugaggugcauaacgcaaagacgaagccccgcgaggaacaauucaauucuacuuauagagucgugagcguccuaacagugcuccaccaggacuggcugaacggcaaagaauacaagugcaaaguuucaaauaaggggcuuccaaguuccaucgagaaaaccauuagcaaggccaaaggacagccuagggagccccagguguacacucugccacccucucaagaagagaugacaaagaaccagguaucauugaccugucucgucaaggguuuuuauccuagugacaucgcuguggaaugggagagcaauggccagccagaaaacaacuacaaaacgaccccgcccguucuggauuccgacgggucuuucuuuuuauauucgcggcugacaguggauaagagccgcuggcaagagggaaaugucuucuccugcucagugaugcaugaggcccuccacaaccacuacacucagaaaagucuuucucugagcuugggcaag

SEQ ID NO: 23908 - RNA, 642 nt, Artificial Sequence
  derived and/or modified sequence opt3 from Crotedumab_LightChain
gacauccagaugacccaaagccccuccucucugucagccagugugggcgauagggucacaauuacuugcagggcuagccaggggauacggaacgaccucggaugguaccagcagaagccugguaaagcaccaaagcgccuuaucuaugccgcguccucucugcaaucgggcguuccgucacgauucagcgggaguggauccggcacggaguuuauuuugaccgugucuagcuuacagcccgaagauuucgcuacauacuauugucugcaguacaauuccaacccuuuuacuuucgguccagggaccaaaguagacaucaagcguacaguggccgcacccucagucuuuauuuucccuccaagugaugagcagcuaaaaagcggaaccgccucugugguuugccuccugaauaacuuuuaucccagagaagcuaaggugcaauggaaggucgacaaugcacuucaguccggcaacucacaggagagcgugacugaacaggauaguaaagacucuacauacucccugagcucgaccuugacgcucucuaaggccgauuaugagaaacacaagguauacgcuugugagguuacucaucaaggccuguccucaccugugaccaaaaguuucaauagaggggaaugc

SEQ ID NO: 23909 - RNA, 1356 nt, Artificial Sequence
  derived and/or modified sequence opt3 from Dezamizumab_HeavyChain
caggugcaacugguccagagcggcgccgagguuaagaaacccggguccucugugaagguaucaugcaaagcuaguggauucaccuuugcaacauacaacaugcacugggugagacaggccccuggucagggccucgaauggaugggguauaucuacccaggagacggcaaugcgaacuauaaucaacaguucaaggguagggucacuauuacggcugauaaaagcaccuccacagccuacauggagcuuucuucgcugcggucagaagacacugcaguguauuacugugcccgcggggauuuugacuaugauggaggcuacuacuucgacagcuggggccaggggaccuugguuacagugaguuccgcuucuaccaagggaccgagcgucuuucccuuagcaccuuccucaaagaguacuagcgguggcacagccgcucuggggugccuagugaaagauuauuucccagagcccguaaccguuucuuggaacuccggagcccucacgucaggcgugcauacuuuuccugcgguccugcagagcaguggucuuuacucucuguccagcguggugaccgucccaucgucuuccuuggggacacaaacuuauauauguaauguuaaccacaagcccucaaauaccaaaguggacaagaaaguagaaccuaagaguugcgauaagacacauaccuguccaccgugccccgcaccugagcuccugggaggcccaagcguguuccuguuucccccuaaaccaaaggacacgcucaugaucucccgaacucccgaggucacaugugugguuguggaugucucucacgaagacccggaggugaaauucaacugguacguagauggcguugaagugcauaaugccaagaccaaaccucgugaggagcaguauaacagcacuuacagagucgugucagucuuaacagugcugcaccaggacuggcuuaaugggaaggaauauaaaugcaagguuaguaacaaggcuuugcccgccccaauugagaaaaccaucuccaaggcaaaaggacagccuagggaaccccaaguguacacgcugccacccagccgggacgagcuaaccaagaaucagguaucucucacaugucuggucaaagguuuuuacccuucagauauugcuguggaaugggagaguaacggccagccagagaauaacuauaagacuaccccgcccguucuugacagcgauggguccuucuuucuguacucuaaguugacaguggacaaaucgcgcuggcaacagggaaacgucuucagcugcuccgugaugcacgaagcccuccauaaucacuauacucagaagucacugaguuuaucuccuggcaaa

SEQ ID NO: 23910 - RNA, 642 nt, Artificial Sequence
  derived and/or modified sequence opt3 from Dezamizumab_LightChain
gacauccagaugacccaaagccccuccucucugucagccagugugggcgauagagucacaauuacuugcagggcuagcgagaacauauacuccuaucucgcaugguaccagcagaagccugggaaagccccaaaacuucugauccacaaugcgaagacguuggcugaaggaguuccgucucgguucucggguucaggcagcgggaccgacuuuacauuaacuauuaguucccugcagcccgaggauuucgccaccuauuacugucaacaucacuauggagcaccucuaacauuuggccaggguaccaagcucgaaaucaaacgcacuguggccgcuccaucuguauucauuuuucccccuagcgacgagcagcugaaguccgggacagcaucaguggucugccuucugaacaauuucuacccacgagaagccaaggugcaguggaaaguugauaacgcuuugcaaaguggaaauagccaggagucugugaccgagcaggacuccaaggauucaacguauagccucaguucuacucugacccuguccaaagccgacuacgaaaagcauaaagucuacgcgugugaggugacacaccagggccucagcucgcccguaacuaagucuuuuaaccguggcgaaugc

SEQ ID NO: 23911 - RNA, 1506 nt, Artificial Sequence
  derived and/or modified sequence opt3 from Duvortuxizumab_Chain1_scFv
gagaacgugcugacccagagccccgccacacucuccgucacuccuggcgaaaaggcuacgauuaccugcagagcaucucaaucaguuaguuacaugcacugguaucagcagaaaccagggcaggccccgaggcuucugaucuacgacgcgagcaaucgggcuuccggagugcccucucgcuucucggguucaggcagcgggacagaucauacuuugaccauaaguuccuuagaggccgaagacgcagccacauauuacuguuuucaaggaucuguauauccuuucaccuuuggccaggguacuaagcuggagaucaaagggggaggcagcggcgggggaggugaagugcagcuagucgaguccggcgggggacucgugcagccaggcgguucacugcgacuuaguugcgcugcaagcggguucacauuuucuaccuacgccaugaacuggguucgucaagcucccggaaagggccuggagugggugggcagaauuagguccaaauauaauaacuacgccacguacuaugcggauucagucaaggggcgguucacuaucagccgcgacgauaguaaaaauucuuuguaccuccagaugaacucccugaagaccgaagacacagcaguguauuacuguguaagacacggaaauuuugguaacagcuauguuucgugguucgccuacuggggccaggggacucuggugaccgucucuuccgcuucaacaaagggagagguggccgcaugcgaaaaagagguggcugcccucgagaaggaagucgcggccuuagagaaagaaguugcagcucuggagaagggcgguggggauaagacccauacguguccuccaugccccgccccugaagcugccggcggaccaaguguguuucuuuucccgcccaaaccuaaggacacuuugaugauuagcaggacaccagagguaaccuguguggucguggauguuucccacgaggaccccgaagugaaauuuaauugguaugucgauggcguggagguacauaacgcaaagacuaaaccucgggaggaacaguacaauucuacauaccgcguugugagcguccugaccgugcuacaccaagacuggcucaacgggaaggaauauaaaugcaaggucucaaauaaggcccugccagcucccaucgagaaaacgauaaguaaggcgaaaggacagccgcgagagccucagguguacacccuucccccauccagagaagagaugacaaagaaccaaguuagccugugguguuuggugaaagguuucuauccuucugauaucgcaguagaaugggagucaaauggccagcccgaaaacaacuacaagacuaccccacccguccucgacagugacgggagcuuuuuccuguauuccaaguuaacaguggauaaaucuagguggcagcagggaaauguuuucucgugcagcgugaugcacgaggcccugcauaaccacuacacucaaaagucccucucacuuaguccuggcaaa

SEQ ID NO: 23912 - RNA, 813 nt, Artificial Sequence
  derived and/or modified sequence opt3 from Duvortuxizumab_Chain2_scFv
caggccguggucacccaagagcccagccugacaguuuccccuggcgggacugugacgcuuaccugcagaucuucaacaggagcuguaacuaccaguaacuacgcaaauugggugcagcagaagccaggucaggccccgaggggccucaucgggggaacaaacaaacgggcgcccuggaccccugcucgcuucagcggcucccuguugggugggaaggccgcauuaacuauuacaggagcccaagcugaagacgaggcagauuauuacugugcccugugguauucuaaucuaugggucuuuggcggcgggaccaaacucacggugcugggagguggcgggucgggaggcggugggcagguuacucuucgagaaucaggaccagcucuggugaagcccacccagacauugacucugaccugcacauucagcggcuuuagucucuccaccucuggcaugggggucggauggauacgucagccuccagguaaagcccuggaguggcucgcgcacaucuggugggacgaugacaagagauacaaccccgcauuaaagagcaggcugacgauuuccaaagauacuucaaagaaucaaguguuccuuacaaugaccaacauggacccuguagauacugccacauauuacugugcucggauggaauuguggaguuauuacuuugacuacuggggccaggggaccacgguuaccgugagcucugccuccacaaaaggaaaggucgcagcuugcaaagagaagguggccgcgcugaaggagaaaguggccgcacuaaaggaaaaagucgcugcccucaaggag

SEQ ID NO: 23913 - RNA, 681 nt, Artificial Sequence
  derived and/or modified sequence opt3 from Duvortuxizumab_Chain3_h-CH2-CH3
gacaagacccacacaugucccccuugcccagccccggaggcugcaggcgggcccagcguguuccuguuuccuccaaaacccaaggauacucucaugaucuccagaacgccugaaguuaccugcgucgugguagacgugucucaugaggauccagaagucaaauucaacugguacguggacggaguugaggugcacaaugccaagacaaaacccagggaggaacaguauaacucaacuuaccgggucgugaguguacuuaccguucugcaucaggauugguugaaugguaaggaguauaaguguaaagugagcaacaaggcguuaccugcuccaauugaaaagacaauauccaaggccaaaggccagccgcgcgagccccaggucuacacccugccuccaucucgagaagagaugacuaagaaucaggugucgcuaucaugcgcagugaagggguuuuaucccagcgacaucgccgucgagugggaaaguaacggacaaccugagaauaacuacaaaacaaccccacccguucucgauuccgacggcucuuucuuucuggugagcaaacuuacgguagauaaaucccguuggcagcaggguaauguguucucauguagugucaugcacgaagcucugcauaacagauauacucaaaagagcuugucucucuccccggggaaa

SEQ ID NO: 23914 - RNA, 360 nt, Artificial Sequence
  derived and/or modified sequence opt3 from Efungumab_HeavyChain
auggccgaggugcagcuggucgaaagcggcgcugagguuaagaaacccggggaaucccucagaaucucuugcaagggaucagguuguauuauaaguagcuacuggaucuccugggugaggcaaaugccuggcaaagggcuugaguggaugggaaagauugacccaggcgauucuuauaucaacuacucgccgucauuccagggucacguaaccauuagcgcagacaaaaguaucaauacagccuaucugcaguggaacuccuugaaggcgucugauacugcuauguacuauugcgcccgcgggggacgggacuuuggcgauagcuucgacuacuggggccaggggacguuagugaccguc

SEQ ID NO: 23915 - RNA, 750 nt, Artificial Sequence
  derived and/or modified sequence opt3 from Efungumab_HeavyChain_LightChain
auggccgaggugcagcuggucgaaagcggcgcugagguuaagaaacccggggaaucccucagaaucucuugcaagggaucagguuguauuauaaguagcuacuggaucuccugggugaggcaaaugccuggcaaagggcuugaguggaugggaaagauugacccaggcgauucuuauaucaacuacucgccgucauuccagggucacguaaccauuagcgcagacaaaaguaucaauacagccuaucugcaguggaacuccuugaaggcgucugauacugcuauguacuauugcgcccgcgggggacgggacuuuggcgauagcuucgacuacuggggccaggggacguuagugaccgucuccucaggagguggcgggaguggaggcggugggagcggaggcggcgggucugaugugguuaugacacaaucccccucauuucugagcgcauucgugggagaccgaauaacuaucaccugucgugccaguucugguauuuccagauaucuagcuugguaccagcaggcaccuggcaaggccccaaaacuccugaucuacgcugccagcacacuucagaccgggguccccucgagguuuucuggauccggcucagguacugaguucacacugaccauuaauaguuugcaaccugaagauuuugcgacguauuacugccagcaucucaacagcuauccacugacuuucgggggcggaaccaagguggacaucaaacgggcagccgcucuggag

SEQ ID NO: 23916 - RNA, 339 nt, Artificial Sequence
  derived and/or modified sequence opt3 from Efungumab_LightChain
gacguggucaugacccagagccccuccuuccugucugccuuuguuggcgauagaaucacaauuacuugcagggcuucaagugggauaagccgguaccucgcaugguaucaacaggccccuggaaaggcgccaaaacuucugaucuacgcugccuccacguugcagaccggugugccgucucgcuucucgggcucagggagcggaacagaguuuacuuuaaccauuaacagucugcagcccgaagacuucgcaacauauuacugucaacaccuaaauuccuauccucucaccuuuggcggugggacuaagguagauaucaaacgagccgcugcacuggag

SEQ ID NO: 23917 - RNA, 1350 nt, Artificial Sequence
  derived and/or modified sequence opt3 from Elezanumab_HeavyChain
gaggugcagcugguccaaagcggcgccgaaguuaagaaacccggggcuuccgugaagguaucuugcaaagcaucaggauacaccuucacaagucacgguaucagcugggugagacaggccccuggccaggggcucgacuggaugggauggauuuccccauauucuggcaacacuaauuacgcgcagaaacuucaagguagggucacgaugaccacagauacuucgaccucaacagcuuauauggagcugagcaguuugcgguccgaagacaccgccguguacuauugugcacgcguugggucuggaccguacuauuacauggauguguggggccagggcacuuuagucacagugagcuccgccucaaccaaggggcccaguguauuuccucuggcuccaagcucuaaguccacgucaggagguacugcagcccuaggcugccucguuaaggacuacuuccccgagccugugaccgucagcuggaacaguggggcucugacaucuggagugcauacuuuuccagccgugcuucaguccagcggccuguauucguugucuuccgucguuaccgugcccucaaguagccucgguacacagaccuacauauguaauguaaaccacaaaccuuccaauacgaagguggauaaaaaggucgaaccaaaaucuugcgacaagacucauacauguccgcccugcccugcgccagaggcagccgggggacccagcguguuccuguuuccuccaaagcccaaagaucaacugaugaucucacgaaccccggagguuacuuguguggucguggacguaagucacgaagauccugagguuaaguucaacugguauguggacggcgucgaagugcauaaugcuaaaacaaagccccgugaggagcaguacaacuccaccuauagagucgugagcguucucacgguguuacaccaggauuggcugaauggcaaagaauacaagugcaaaguaucuaacaaggcccuuccagcaccuauugagaagaccaucucaaaagcuaaggggcagcccagggaaccacaagucuauacauugcccccuagucgggaggaaaugacuaaaaaucaggugagccugaccugucuaguuaagggauuuuacccauccgacauugccguggagugggagucuaacggucagccggaaaauaacuacaaaacaacucccccuguccucgauucggacggcagcuucuuucuguauuccaagcugaccguggacaagucacgcuggcaacaggggaauguauucaguugcucugugcuucacgaggcguugcauaaccacuacacacagaaaagccucucccugucaccaggaaag

SEQ ID NO: 23918 - RNA, 645 nt, Artificial Sequence
  derived and/or modified sequence opt3 from Elezanumab_LightChain
cagagcgcccugacccaacccagauccgugucuggcucaccugggcagagugucacaaucagcugcacuggaacguccucuucgguuggugacucaauuuacgugagcugguaucagcagcacccaggcaaggcuccgaaacucaugcuuuacgauguaaccaagaggcccaguggggugccugaccgguucuccggaucuaaaagcggcaacacagcaucccugacuauaucagguuugcaagccgaggaugaagcggacuauuacuguuauaguuacgcugggaccgauacauuauuuggaggcggcaccaaggucacugugcuggggcagccaaaagccgcacccagcguuacacuauucccuccaucuuccgaggaacuccaggccaauaaggcuacccuggugugccuuaucucagacuuuuaucccggagcagucacgguggccuggaaggcugauagcaguccuguaaaagccgguguugagacuaccacaccaucuaagcaguccaacaauaaauacgcggcaagcucguaccugucuuugacuccggaacaauggaagucccaucgcucauauaguugucaggugacccacgagggcagcacagucgagaaaaccguggcccccacggaaugcucc

SEQ ID NO: 23919 - RNA, 1359 nt, Artificial Sequence
  derived and/or modified sequence opt3 from Emapalumab_HeavyChain
gaggugcagcugcucgaaagcggcgggggacuuguccagcccgguggcucccugagauugucuugcgccgcuucaggguucaccuuuaguagcuacgcaauguccuggguuaggcaggccccuggaaagggcuuagagugggugucugcgaucucggguucagggggaagcacauauuacgcugacaguguaaaaggccgguucacuauuucccgcgauaacucuaagaauacgcuguaucuacagaugaacagccuccgagccgaagacaccgcaguguacuauugugccaaagauggcuccucagggugguacgucccacacugguuugacccguggggacaggguacacuggugacuguuaguagcgcuucuaccaagggccccuccguguucccucuugcaccaucaagcaaaaguacaucugggggaaccgccgcucugggcugcuuggucaaggauuauuuucccgagccugugacuguauccuggaauagcggugcccucacaucggggguucauaccuucccagcggugcugcaaucuuccggacuguacucacucaguagcgucgugacggugcccuccucuagcuuaggcacucagaccuacauauguaacgucaaucacaagccuucaaacacaaaaguugacaagcguguggaaccaaaaaguugcgauaagacucauaccuguccgcccugcccugcaccagagcugcuuggcgggcccuccguauuuuuguucccuccaaaacccaaggacacacugaugaucagcagaaccccggaggugacgugugucgugguugaugugucucacgaagacccugaggucaaguuuaauugguauguggauggaguagaaguucauaacgccaaaacuaagcccagggaggagcaguacaauucaacauaucggguggucagugugcuaaccguccuccaccaggacuggcugaacgguaaagaauacaagugcaaagugagcaauaaggcccuuccagcuccuauugagaaaacuaucuccaaggcaaagggccaaccccgcgaaccacagguuuauacacugcccccuucuagagaggaaaugaccaaaaaccaggugucguugacgugucucguaaagggguucuacccaagcgauauugcugucgagugggaguccaauggacagccggaaaacaauuauaaaaccacacccccugugcuggacucagacggcagcuuuuucuuauacucuaagcugacuguugauaaaaguagguggcaacaggguaacguguuuuccugcucagucaugcacgaggcccuccauaaccacuacacccaaaagagccuuucucuguccccagggaag

SEQ ID NO: 23920 - RNA, 651 nt, Artificial Sequence
  derived and/or modified sequence opt3 from Emapalumab_LightChain
aacuucaugcugacccagccccacagcguguccgagucuccuggcaagacagucacuaucucaugcacgagaaguagcggguccauugccucuaauuacguucaaugguaucagcagaggccaggaucgucaccgaccacagugauauacgaagacaaccagcggcccagcgguguaccugaucgcuuuaguggcuccaucgacucuagcuccaauucagcuagucucacuauuagcgggcuuaaaaccgaggaugaagcagacuauuacugucaaucuuaugauggauccaaccgauggauguucggcggugggacaaagcugaccguguugggacagccaaaagccgcgcccucagucacuuuauuuccuccaagcagugaggaacugcaggcuaauaaggccacccuagugugccucaucucugacuucuaccccggcgcaguuacaguggccuggaaagcugauuccagcccugucaaggcaggcguggagacgacuaccccaucgaagcagucuaacaauaaauaugccgcuuccucauaccugagucuuacaccggagcaauggaaaagccaucguuccuacucuugucagguaacucacgaagggagcaccguugagaagacaguggcccccaccgaaugcuca

SEQ ID NO: 23921 - RNA, 1341 nt, Artificial Sequence
  derived and/or modified sequence opt3 from Enoblituzumab_HeavyChain
cagguggagcuggucgaaagcggcgggggacucguucaacccgguggcucccuuagacugucuugcgccgcuucaggguucaccuuuacaaguuacuggaugagcugggugaggcaggcaccuggaaagggcuuggaguuaguauccucuaucacuucguaugguucauucacguacuaugccgacagcgugaaagggcgguuuaccauuagucgcgauaacuccaagaauacacuguaccuacagaugaacucucuccgagcggaagacacugcugucuauuacugugcccguaauauguauacccacuucgauagcuggggacagggcacacuggugaccguuuccucagcaaguacuaaaggcccaagcguguuuccgcuugcccccucuuccaagucaacaagcgggggaaccgcugcacuggguugcuuggucaaagacuacuucccugagccagugacgguaaguuggaacucuggcgcccucacuuccgggguucauaccuuucccgcugugcugcaaagcucgggacuguacucucucuccucagucgugacagugccuaguagcuccuuaggcacucagaccuauauauguaaugucaaccacaagccaucuaauacaaagguugauaaaaagguggaacccaaaagcugcgacaagacccauacguguccuccaugcccggcccccgagcugcuuggugggccuucaguauucuuguuuccacccaaaccuaaggauacucugaugaucaguagaacaccagaggugaccugugucgugguugacgugucccacgaagaucccgaggucaaguucaacugguacguggacggaguagaaguucauaaugcgaaaacuaagccgagggaggagcaguauaacagcacauaccggguggucucugugcuaaccguccuccaccaggauuggcugaauggcaaagaauauaagugcaaagugucaaacaaggcacuuccugcccccauugagaaaacgaucaguaaggcuaagggccaaccacgcgaaccucagguuuacacccugcccccaagcagagacgaguugacuaaaaaucaggugucccucacaugucugguaaagggguuuuaucccucugauauugccgucgaaugggagucgaacggacagccugagaauaacuacaaaaccacaccaccgguguuagacagcgacgguuccuucuuucuguacucaaagcucacuguugauaaaaguagguggcaacagggcaacguguucucuugcagcgucaugcacgaagcacuucauaaucacuauacccagaagucccugucauugagccccgggaag

SEQ ID NO: 23922 - RNA, 648 nt, Artificial Sequence
  derived and/or modified sequence opt3 from Enoblituzumab_LightChain
gacaucgugcugacccagcccccuagcgucuccggcgccccagggcaaagaguuacaauuucuugcucaggaaguagcuccaacauagguucuaauucggugucaugguaccagcagcucccgggcacugcucccaaacuucugaucuaugauaacagcaagaggccuagugggguaccagaccgguucuccggaucuaagagcggcacguccgcaucauuggccauuaccgguuuacagagugaggaugaagcggacuacuauugucaaagccgcgauacauacggguauuacuggguguuuggaggcggcacuaaacugaccguccuagggcagcccaaggcugccccuucugugacacucuucccacccuccucagaggaacugcaggcaaauaaagccacccuuguuugccugaucagcgacuuuuauccuggagcugugacugucgcauggaagggugauaguucuccagugaaggccggcguagagacaaccacgccguccaaacagagcaacaauaaguacgcugccucgucuuacuugucccucacucccgaacaauggaaaucacaccgaaguuauagcugucagguuacccaugagggguccacaguggagaagacugucgcgccuaccgaaugcucu

SEQ ID NO: 23923 - RNA, 1323 nt, Artificial Sequence
  derived and/or modified sequence opt3 from Eptinezumab_HeavyChain
gaggugcagcuggucgaaagcggcgggggacucguucaacccgguggcucccuuagacugucuugcgccgugucagggaucgacuugaguggauacuauaugaacuggguaaggcaggcuccuggcaaggguuuagagugggugggggucauuggaauaaauggcgcaaccuacuaugccagcugggcgaaaggccgguucacaaucucccgcgauaacucuaagacuacgguguaccugcagaugaauagccuacgagcugaagacaccgccguuuauuuuugugcacguggggauauuuggggacaggguacacucgugacugucucaagcgccaguaccaaaggcccauccguguucccgcuggcucccucuagcaaguccacaucagggggaaccgcagcccuuggcugccugguaaaagacuacuuuccugagccaguuacugugaguuggaacagcggugcuuugacaucugggguccacaccuuccccgccgugcuccaauccucaggacuguauagccugaguucuguggucacgguuccuuccagcucgcucggcacucagaccuacaucuguaaugugaaccauaagccaucuaauacaaagguagaugcgagaguggaacccaaauccugcgacaagacucacaccuguccuccaugcccggcacccgaguuacugggcgggccuucagucacacuuuuuccacccaaaccuaaggauaccuugaugauuaguaggacgccagaggugacuuguguuguggucgacgugagccaugaagaucccgagguaaaauucaacugguacguugacggaguggaaguccacaaugccaagacaaagccgcgggaggagcaguaugcuuccaccuaccgcguggucucugugcugacuguucuacaucaggauuggcucaacgguaaagaauauaagugcaaagugagcaauaaggcccugccugcacccaucgagaaaacaauaucaaaggcuaaaggccaaccaagagaaccucagguauacacccuucccccaaguagggaggaaaugacgaagaaccaggucucccugaccuguuuggugaagggguuuuaucccagcgacaucgccguugagugggagucuaauggacagccugaaaacaauuacaaaacaacuccaccggugcucgauucagacggcaguuucuuucuguauagcaaguuaaccgucgacaaaucccgguggcaacaggguaacguguucucuugcucgguaaugcacgaggcgcugcacaaccauuacacacagaagucgcucucccuuucacccgggaaa

SEQ ID NO: 23924 - RNA, 657 nt, Artificial Sequence
  derived and/or modified sequence opt3 from Eptinezumab_LightChain
caggugcugacccaaagccccuccucucucucagccagugucggcgacagaguuacaaucaacugccaggcuagccaguccguguaccacaauacuuaucuugcaugguaccagcaaaagccugggaaaguaccaaagcagcugauuuaugaugccucuacguuggcgucgggagugccgucaagguucagcgguaguggcuccgggaccgacuuuacauuaacuauaucuagccugcagcccgaggaugucgcuaccuacuauugucuaggauccuacgacugcacaaacggcgauuguuucguguuuggugggggaaccaaaguugaaaucaagcggacuguggccgcaccuucagucuucauuuuuccacccagugacgagcagcucaaaagcggcacagccucugugguaugccugcuuaauaacuucuauccucgcgaagcuaagguucaauggaagguggauaaugcacugcaguccggcaacucacaggagagcgucaccgaacaggacaguaaagauucuacguacuccuugagcucgacucucacccugucuaaggccgacuacgagaaacauaagguguaugcuugugaggugacacaccaagggcuguccucaccagucacuaaaaguuuuaaucgaggagaaugc

SEQ ID NO: 23925 - RNA, 1368 nt, Artificial Sequence
  derived and/or modified sequence opt3 from Erenumab_HeavyChain
caggugcaacuggucgagagcggcgggggaguugugcagcccgguagaucccucaggcuuucuugcgccgcuucaggcuucaccuuuaguagcuucgggaugcacuggguacggcaggcaccuggaaagggccuggaauggguggccgucaucuccuuugacgguucuauuaaauacucgguggauucaguuaaggggcgcuucacaauaagccgagacaacaguaaaaauacuuuguuuuuacagaugaacucccugcgugcggaggauacggcuguguauuacugugccagagacaggcuaaauuauuacgauucuagcggauauuaccauuauaaguacuacggcauggcagucuggggccaagggaccacagugacuguauccucagccaguaccaaaggaccaagcguuuucccgcucgcucccugcucucgguccacaucagaaagcaccgcagcccuggguugucuugugaaggacuauuuuccugagccagucacugugaguuggaacucuggcgcucugacauccggggugcacaccuuccccgccgucuugcagagcucgggacucuacucucuguccucaguugugacgguaccuaguagcaauuuuggcacucagaccuauacaugcaacguggaucauaagccauccaauacuaaagucgacaagaccguggaacgcaaauguugcguugagugucccccuugcccagcgccgcccguggcagguccuucugucuuccuguuuccacccaagccuaaagauacacucaugaucagcagaaccccagaggugacguguguaguuguggacgucucacacgaagaucccgaggugcaguucaacugguacgucgacgggguggaaguucauaaugccaagacuaagccgagggaggagcaauuuaacaguacauuccgggugguauccgucuuaaccgugguucaccaggauuggcugaauggaaaagaauauaagugcaaagugagcaacaagggccuuccugcucccauugagaaaacuaucucuaagacaaaaggccagccacgcgaaccucaggucuacaccuugcccccaucacgagaggaaaugacgaagaaucaagugagucugaccugucuaguaaagggguucuaucccagcgacauugccguggagugggaguccaacggacagccugaaaauaacuacaaaacaacuccaccgaugcucgacucugaugguucguuuuuccuguacagcaaacuuaccguugacaaguccagauggcagcaaggcaacgucuuuucaugcagugugaugcacgaggcacugcauaaucacuauacacagaagucuuugagccucucccccgggaaa

SEQ ID NO: 23926 - RNA, 648 nt, Artificial Sequence
  derived and/or modified sequence opt3 from Erenumab_LightChain
cagagcgugcugacccaacccccuuccgucucugccgcuccaggccagaagguuacaaucucaugcagugggagcuccucuaacauuggaaauaacuacgugucgugguaucagcagcucccggguacugcacccaaacuucugauauacgacaauaacaagagaccuucaggcaucccagauagguucagcgggaguaaauccggaacgucuaccacauugggcauuacugguuuacaaaccggggacgaggccgauuauuacuguggaacaugggacagccggcuguccgcgguaguguuuggcggcgggaccaagcuaacuguccucggacagcccaaagcuaauccuacagugacccuguucccacccucaagugaggaacuucaggccaacaaggcaacgcugguuugcuugaucagcgauuuuuauccuggugccgugacugucgcuuggaaggcagacggcucuccagugaaagccgggguagaaaccacaaagccguccaaacagucaaauaacaaguacgcugccagcaguuaucucucucugacucccgagcaauggaaaucccaccgcagcuacucgugucagguuacccaugaaggaucuacaguggagaagaccgucgcgccuacggagugcucc

SEQ ID NO: 23927 - RNA, 1344 nt, Artificial Sequence
  derived and/or modified sequence opt3 from Fremanezumab_HeavyChain
gaggugcagcuggucgaaagcggcgggggacucguucaacccgguggcucccuuagacugucuugcgccgcuucaggguucaccuuuaguaacuacuggaucagcugggugaggcaggcaccuggaaagggcuuggaguggguagccgaaauucgguccgagucugacgcgucggcuacacacuaugccgaagcagugaaaggucgcuucacuauaucacgagauaaugccaagaacagcuuauaccugcagaugaauagucuacgugcugaggacacggcagucuauuacugucucgccuauuuugauuacgggcuggcuauccagaacuauuggggacaaggcacccuugugacaguuuccucugccagcacuaaaggcccauccguguucccgcuggcgcccugcucaagaaguaccagcgagucuacagcagccuuggggugucucgucaaggacuacuuuccugaaccagugaccguauccuggaacucaggagcucugacuagcgguguucauacauuccccgccgugcugcagaguucuggccucuacuccuuaagcucggucgugaccgugccuucuuccaauuuugggacgcagacuuauaccugcaaugucgaucacaaaccaucaaacacaaagguugacaagacuguggagaggaaauguugcguagaaugucccccuugcccagcaccgcccguggcuggaccuagugucuuccuguuuccacccaagccuaaagauacccuuaugauuagccggacaccagaggugaccuguguuguggucgacgugucccaugaggaucccgaaguacaguucaauugguacguugacggcguggagguccacaacgccaagacgaaaccgcgcgaggaacaauuuaauucuacuuucagaguggucagcguguugacaguugugcaucaggauuggcugaacgguaaggaauauaagugcaaaguaucaaauaaggggcuaccuaguuccaucgagaaaaccauuagcaagacuaaaggacagcccagggagccacaggucuacacacucccucccucucgggaagagaugaccaagaaccaagugucacugacgugucuuguuaaaggcuuuuauccaagugacaucgcgguggaaugggagagcaauggccagcccgaaaacaacuacaagaccacaccuccaaugcuggauuccgacgggucuuucuucuuguauucgaagcucacugucgacaaaagccgcuggcagcaaggaaauguguuuuccugcucaguaaugcacgaggcccugcacaaccauuacacccagaagaguuuaucucugagcccggguaaa

SEQ ID NO: 23928 - RNA, 642 nt, Artificial Sequence
  derived and/or modified sequence opt3 from Fremanezumab_LightChain
gagaucgugcugacccagagccccgccacacucucccuuucuccuggcgaaagagcuacucugucaugcaaggcaaguaaaagggucacgaccuacguuagcugguaucaacagaagccagggcaggccccgcgguuguuaauuuacggagcguccaaccgcuaucuggguauacccgcucgauucucuggcucggggucaggaacagacuuuacucuaaccaucagcagucucgagccugaagauuucgccguguacuauuguucccagucuuacaauuauccauacacauuuggccaagguaccaaacuggagauuaagcguacuguagcagcccccagcguguucaucuuuccuccauccgacgaacagcuuaaaucagggacagcuagugucgugugccuguugaacaauuucuaccccagagaggcaaagguucaguggaagguggauaacgcccuccagagcggaaauucucaagaguccgucaccgaacaggacucaaaagauagcacguauagucugucuuccacucugacccucagcaaggcugacuacgagaaacacaagguguaugccugugaaguaacacaucagggcuuaucgucuccuguuacuaaauccuuuaacaggggcgagugc

SEQ ID NO: 23929 - RNA, 1371 nt, Artificial Sequence
  derived and/or modified sequence opt3 from Frunevetmab_HeavyChain
caggugcaacuggucgagagcggcgccgaacucguucagcccggggagucccuuagacugaccugcgcugcaucuggauucucauugacaaacaauaacgugaauuggguaaggcaggccccugguaagggcuuagaauggaugggaggggugugggcgggcggugcuacugacuacaacagugcccugaaaagccggcuaacgaucacccgcgauacauccaagaauacugucuuucuccagaugcacucucugcaaucggaggacaccgcaacauauuacugugcccgagaugggggauauucaagcaguacccuuuacgcuauggacgcauggggccagggcacuacagugaccguuuccgccgcuucuacgacugccccaagcguguucccgcuggcgcccuccugcgggaccacaucaggagcaacugucgccuuggcuugucucgugcuggguuauuuuccugaaccaguaaccguuaguuggaacagcggcgcccugacaucuggggugcauaccuuccccgcaguccuccaggcuuccggauuauacucacugagcaguauggugacggugccuucuucccguuggcuuagcgauacuuuuacaugcaaugucgcccacccacccucgaacaccaaaguugacaagacugugagaaaaacagaucauccuccaggcccgaagcccugugacugcccuaaguguccacccccugagauguugggugggccaucuauuuucauauuucccccgaaaccuaaggauacccuguccaucucaaggacgcccgagguaaccugccuaguggucgaccucggaccagaugacagugaugugcagauuacaugguucguugacaauacucaaguguauaccgcgaaaacaagcccucgggaagaacaguuuaacuccacuuaccgcgucgugucuguacugcccauccuucaccaggacuggcugaagggcaaagaguucaaguguaagguuaauagcaaaucauugccaagucccauugagagaaccaucuccaaggccaaaggccagccucaugagccacaaguguacguccucccgcccgcacaggaggaacugagcaggaacaaggugucugucacaugcuuaauaaaaucauuucacccuccagauaucgcuguggaaugggagauuaccgggcagcccgaaccugagaauaacuaucggacuacgccaccccaacuggacagugauggaacauacuucguuuauagcaagcucuccguggaccgcucucacuggcagcgagguaauaccuacacuuguucgguaagccaugaggcccuucacucccaucacacccagaaaucacugacacagaguccgggcaag

SEQ ID NO: 23930 - RNA, 651 nt, Artificial Sequence
  derived and/or modified sequence opt3 from Frunevetmab_LightChain
gacaucgagaugacccagagcccccugucccucucugugacaccuggcgaaucagucaguauuagcugcagagccuccgaggauauauacaacgcucuugcaugguaucugcaaaagccagggaggucuccgcgguuguuaaucuacaauacugacacgcugcacaccggaguucccgaucgcuucucggguucaggcagcgggacagacuuuacucuaaaaauuagucgagugcagaccgaagauguaggaguguauuucugucagcauuacuuucacuauccucguacauucggccaggguaccaagcucgagcugaaaagauccgacgcccaaccaucugucuuucuuuuccagcccagccuggaugaauugcauacuggguccgcgucaaucgugugcauucucaacgacuuuuacccuaaggagguuaaugugaaauggaaggucgauggagugguacagaacaagggcauccaggagaguacaaccgaacaaaauagcaaagacucuacguauucccugucaagcacucugaccaugaguucuacagaguaccagucccacgaaaaguucagcugugagguuacucauaaaucgcucgcuucuaccuuagugaaguccuuuaacaggucagagugccagcgggaa

SEQ ID NO: 23931 - RNA, 1341 nt, Artificial Sequence
  derived and/or modified sequence opt3 from Gatipotuzumab_HeavyChain
gaggugcagcuggucgaaagcggcgggggacucguucaacccgguggcuccaugagacuuucuugcguggccucaggguucccuuuuaguaacuacuggaugaauuggguaaggcaggcuccaggaaagggccuggagugggugggugaaauccgguugaaaagcaacaauuauaccacacacuacgcagaguccgucaaggggcgcuucacuauuucucgagacgauucgaaaaacucauuauaucugcagaugaauagccuaaagacggaagacaccgccguguacuauuguacacgucauuacuauuuugauuacuggggacagggcacucucguuaccgugaguuccgcgucuacaaaaggcccgagcgucuucccccuggcuccuuccucaaagaguaccagcgggggaacugccgcacuugguugccuggugaaggacuacuuuccagagcccguaacaguuucuuggaacuccggcgccuugaccucaggggugcacacguucccugcuguccuccaaagcaguggacuguauucucuguccagcguggugacugucccaucgucuucccucggcacccagacauacauauguaauguuaaccauaaacccucaaauacuaagguggauaaaaagguagagccuaaaaguugcgacaagacccacacauguccaccgugccccgcaccugaauuacugggugggccaagcguguuucuuuuucccccuaagccaaaagauaccuugaugaucuccagaacgcccgaggucacuugugugguuguggacgucucucaugaagauccggaggugaaguucaacugguauguagacggaguugaggugcacaaugccaaaacaaagccuagggaggaacaguacaacagcaccuaucgggucgugucaguccugacugugcuacaccaggauuggcucaauggcaaagaauacaagugcaaaguuaguaacaaggcucugcccgccccaauugagaagacaaucuccaaagcgaagggccaaccucgcgaaccccagguguauacccuuccacccagcagagacgagcugacgaaaaaucagguaucuuugaccugucucgucaagggguucuacccuucagauauugcaguggagugggaaaguaacggacagccagagaacaauuacaaaacaacuccgcccguucuggacagcgacgguuccuuuuucuuauauucuaagcugaccguggauaagucgagguggcaacagggcaacgucuuuagcugcuccgugaugcaugaagggcuccacaaucauuacacacagaaaucacuuagucugucuccuggaaag

SEQ ID NO: 23932 - RNA, 657 nt, Artificial Sequence
  derived and/or modified sequence opt3 from Gatipotuzumab_LightChain
gacaucgugaugacccagagcccccuguccaacccugucacaccaggcgagccggccucuauuucaugcagaaguagcaagucccuccuucacucuaaugggauaacuuacuucuuuugguaucugcaaaaacccggacagucgccucaguuguuaaucuaccagaugucaaaccuggcuagcgguguuccagauagguucaguggcuccgggucuggaacggacuuuacccuacggauuagccgcguggaagcagaggauguaggcguguauuacugugcccaaaaucucgaacugcccccuacauucggucaggggacuaaggucgagaucaaacgaaccguggcggcuccauccguuuuuauuuuucccccuucagacgaacagcuuaagaguggaacagccagcguggucugccuguugaacaauuucuauccacgugaggcaaaagugcaguggaagguagauaacgcccuccaaucuggcaauucccaggagucaguuaccgaacaggacagcaaggauaguacuuacucucuguccagcacacugacccucucgaaagcugacuaugagaagcauaaaguguacgcaugugaagucacgcaccagggcuuaucuuccccggugacuaagucauucaacagaggggagugc

SEQ ID NO: 23933 - RNA, 1365 nt, Artificial Sequence
  derived and/or modified sequence opt3 from Gedivumab_HeavyChain
gaggugcagcuggucgaaagcggcgggggaguugugcaacccgguaagucccucagacuuucuugcgccgcuucaggccugaccuucaguagcuacgcaguacacugggugaggcaggccccugggaaaggauuggagugggucacauuaaucuccuaugacggcgcgaaccaguacuaugcugauucugugaagggucgguuuacuauuucgcgcgacaauucaaagaacacgguuuaccugcagaugaauagccuacgaccagaagauaccgccguguauuacugugcagucccggggcccguguucggaauauuuccuccauggaguuauuucgacaacuggggccaaggcauccucguaacaguuuccucugccagcacuaaagggcccuccguguuuccucuggcuccaucaaguaaaagcaccucuggagguacagcagcccuuggcugccuggucaaggauuacuuccccgagccugugaccguguccuggaacucaggggcuuugacuagcggaguccauacauuuccagccguucuccagaguucuggccuguacucccugagcucggugguaaccgugccgucuuccucacucgguacgcagacuuauauuuguaaugucaaucacaagcccaguaacaccaaaguggacaagaaaguugaaccuaagagcugcgauaaaacacauacuuguccacccugcccugcgccagaguuacuugggggacccuccguguuccuguuuccgccuaagcccaaggacaccuugaugaucucucguacaccagaggucaccugugugguaguugaugugagccacgaagacccugaggucaaauucaauugguacguggauggcgucgaagugcauaacgcaaagacgaaacccagagaggagcaguauaauucaacuuacaggguugugaguguacugacaguccuacaccaagacuggcucaacggcaaggaauauaaaugcaagguguccaauaaagcccugccagcucccauugagaagaccaucagcaaggccaaagggcagccucgggaaccacagguuuacacucuuccgcccucucgcgaggaaaugacaaagaaccaggugucacugaccuguuuggucaaaggauuuuauccuagugauauagcaguggagugggagagcaauggucaaccagaaaacaacuacaagacgacacccccuguacucgacuccgacggcucuuucuuucuguacucgaaauuaaccguggauaagagcagauggcagcaggggaauguuuucuccugcucagucaugcacgaggcucugcauaaccacuauacucaaaagagucucucucuuagcccaggaaaa

SEQ ID NO: 23934 - RNA, 648 nt, Artificial Sequence
  derived and/or modified sequence opt3 from Gedivumab_LightChain
gagaucgugcugacccagagccccgccacacucuccgucucuccuggcgaacgggcuacucuuucaugcagggcaagucaaguuauuagccacaaccuggccugguaccagcagaagccagggcaggcgccgcgguuguuaauauauggagcuuccacgcgcgccucugguauccccgcacgauucucgggcucagggagcggaaccgacuacacacugacuauuaccagucuacaauccgaggauuuugccguguauuacugucagcauuauucuaauuggccuccacgucucacauucggcggugggaccaaaguagaaaucaagagaacuguggcugcacccagcgucuuuauuuucccuccauccgacgagcagcugaaaucaggaacagccagugugguuugccuucugaacaauuuuuaccccagggaagcuaaggugcaguggaaagucgauaacgccuugcaaagcggcaauucucaggaguccgugaccgagcaggacucaaaggauagcacguauagucucucuuccacucugacccugagcaaggcggacuacgaaaaacacaagguauacgcaugugagguuacacaucagggccucucgucuccugugacuaaauccuucaacagaggggaaugc

SEQ ID NO: 23935 - RNA, 1329 nt, Artificial Sequence
  derived and/or modified sequence opt3 from Gemetuzumab_HeavyChain
gaggugcagcugguccaaagcggcgccgaaguuaagaaacccggguccucugugaagguaucaugcaaagcuaguggauacaccaucacagacagcaacauucacugggugagacaggcaccuggucagucccucgaguggauaggcuauaucuacccauauaaugggggaacugauuacaaccagaaguucaaaaauagggccacgcuuaccgucgacaacccgacaaauacugcguauauggaacugucuucguugcggucagaggauaccgcuuuuuacuauugugugaacggcaaucccugguuagccuacuggggucaagggacacugguuaccgugagcagugcauccacuaagggaccuucugucuucccacuagcccccugcagccgcuccacaucagaaaguaccgcugcacucggcugucuggugaaggacuacuuuccugagccaguaacgguuagcuggaacucuggcgcccuuacuuccggggugcauaccuuccccgcuguccugcagucaagcggauuguauagucucucuuccguggugacagucccuagcucgucucuggguacuaaaaccuacacaugcaauguugaucacaagccauccaacaccaaaguggacaagcgaguagagucaaaauauggcccgcccuguccuccaugccccgccccugaauuucucgggggaccaaguguguuccuguuucccccgaagccuaaggauacguuaaugauuagccguacucccgaggucacaugugugguuguggacgucucccaggaagauccagaggugcaguucaauugguacguagacggcguugaggugcauaacgcgaaaaccaagccuagagaggaacaauuuaauucuacuuauagggucgugagcguccugacagugcuucaccaggauugguugaacgguaaagaauacaagugcaaaguuucaaauaaggggcugcccaguuccaucgagaaaaccauuagcaaggcaaagggacagccacgggaaccccagguguauacgcuaccuccaucucaagaggagaugaccaaaaaccagguaucacucacaugucuggucaagggcuucuacccgagugacaucgccguggaaugggagagcaacggccagcccgaaaauaacuacaaaacuaccccuccaguucuugauuccgacgggucguuuuuccuguauucucgcuugacaguggacaagagcagauggcaagagggaaaugucuuuuccugcucagugaugcaugaagcucuccacaaccacuacacucagaaaagucugucuuuaagccuggguaag

SEQ ID NO: 23936 - RNA, 654 nt, Artificial Sequence
  derived and/or modified sequence opt3 from Gemetuzumab_LightChain
gacauccagcugacccaaagccccuccacacucucugccucagugggcgauagagucacuauuacgugcagggcuagugagagccuugacaacuacgggauacgguuccugaccugguuucagcagaagccuggaaaagcaccaaaguuguuaauguaugccgcguccaaucaggguucuggcguuccgucgcgcuucucagggagcggaaguggcacagaauuuacucugaccaucuccucucuacaacccgaugacuucgcuacauacuauugucagcagaccaaagaggugccuuggagcuuuggucaggggacuaagguagaagugaaacgaacagucgccgcaccauccguguucauuuuucccccuucagaugagcaacucaagaguggaaccgccagcguugugugccugcuuaacaauuucuacccacgugaagcuaagguccaguggaaaguggacaacgcacugcagucuggcaauucccaggagucaguaacggagcaagauagcaaggacaguacuuauucuuuguccagcacccucacacugucgaaagccgauuacgaaaagcacaaaguuuaugcuugugaggugacucaucagggccugucuucccccgucaccaagucauuuaacagaggggaaugc

SEQ ID NO: 23937 - RNA, 1365 nt, Artificial Sequence
  derived and/or modified sequence opt3 from Gilvetmab_HeavyChain
gaggugcagcugguccaaagcggcggggaccucguuaagcccggagguuccgugagacuuucuugcguagccucaggcuucaacaucaaaaauaccuacaugcacugggugaggcaggcuccugggaagggacugcaguggauuggccggauagcaccagccaacgucgauacaaaauaugcgccgaaguuucaggguaaagcuacuaucagugccgacacggcaaagaauaccgccuacaugcaauugaacagcuuacgcgcugaagauacagcaguguauuacuguguucugauuuauuacgacuaugauggggacaucgauguguggggacagggcacucuagucaccguguccucugccucgacaaccgcucccucaguauucccucucgccccaagcugcggcaguacuuccgggucuacaguugcgcuggcaugucuugugagcggauacuuucccgagccugucaccguguccuggaacucagguagucugacgagcggcgugcauacuuucccaucugucuugcaguccucagggcucuacagccugaguucuaugguuaccgugcccuccagccgauggccuucggaaacauuuacuugcaauguagcccacccagcuucuaagaccaaaguggacaagccgguccccaaacgugagaauggaagagugccuaggccacccgauuguccuaagugcccagcccccgaaaugcugggcgguccguccguuuucauuuuuccucccaaaccaaaggacacacucuuaaucgcacggaccccugaggugacgugugucgugguagcucuggaucccgaggacccagaaguucagauaucaugguucguggaugggaagcaaaugcagacugccaaaacacagccccgcgaggaacaguuugcgggaaccuauagagucgugaguguccuuccuaucggccaucaagacugguugaagggcaaacaguucacuugcaaggugaacaauaaagcccugccaagcccgauugagaggacaaucuccaaggcacgggggcaggcucaccaacccucuguuuacgugcuaccuccaagccgcgaggaacucaguaaaaacaccguaucacugacgugucuuauuaaggacuuuuucccucccgauaucgacgucgaguggcaguccaauggacagcaggaaccagagagcaaguaucgaaccacacccccgcaacuggaugaagacgguucuuacuuuuuguauucaaaacucaguguggauaagagcagauggcagaggggcgacacuuucauaugcgccguuaugcaugaggcucugcacaaccacuacacccaggaguccuuaucucauucgccugggaaa

SEQ ID NO: 23938 - RNA, 654 nt, Artificial Sequence
  derived and/or modified sequence opt3 from Gilvetmab_LightChain
gacaucgugaugacccagacaccccugagccucuccgucucucuuggcgagccugccucaauuaguugccacgcuagccaaaacauaaauguuuggcuguccugguacagacagaagccagggcagaucccgcaguuguuaauuuauaaagcaucucaucugcacacuggagugcccgauagguucucggguucaggcagcgggacggacuuuacccuacggaucagucgcguagaagccgaugacgcgggaguguacuauugucaacagggccaguccuggccucucacauucggucaggggacuaaggucgagauuaaacgaaacgaugcucaaccagccguguaccuguuucagcccucuccugaccagcuucauaccggaagcgcauccguugugugccugcucaauucauucuauccaaaggauaucaacgucaaauggaagguggacggcguaauacaggauacaggcauccaagaaaguguuaccgagcaggacagcaaggauucuacuuacuccuugucaagcacacugaccaugaguucuacggaauaucugucccacgagcucuacagcugugagauuacucauaaaucguuacccucuacccugaucaaguccuuucagcguucagaaugccaaagaguggac

SEQ ID NO: 23939 - RNA, 1344 nt, Artificial Sequence; identical to SEQ ID NO: 23222
  derived and/or modified sequence opt3 from Ifabotuzumab_HeavyChain

SEQ ID NO: 23940 - RNA, 642 nt, Artificial Sequence; identical to SEQ ID NO: 23223
  derived and/or modified sequence opt3 from Ifabotuzumab_LightChain

SEQ ID NO: 23941 - RNA, 1323 nt, Artificial Sequence
  derived and/or modified sequence opt3 from Iratumumab_HeavyChain
caggugcaacugcagcaguggggcgccgggcuccuuaagcccagcgagacccuguccuugacaugcgcugucuacggagguucuuucucagcauauuacuggaguuggaucagacagccuccaggcaaaggguuagaauggauuggagacauaaaccacggcggugggacuaauuauaacccgagccugaaguccaggguuacgaucucuguggauaccucgaaaaaucaauuuucacuaaagcucaacagcguaacagccgcggacacugcuguguacuauugugccagucugaccgcauacuggggacagggcucccuugucacagugucuagcgccuccaccaaaggccccucaguuuucccucuggcuccaaguagcaagucuacuuccgggggaacagcagccuuggguugccucgugaaggauuauuuucccgagccugucaccgugucauggaauagcggcgcucugacgagugggguacauacuuucccagccguucugcagucuuccggacucuacagcuuaucgucuguggucaccgugcccuccucaagucugggcacacagacuuacauuuguaacgugaaucacaaaccuagcaacaccaaggucgacaaaaagguugaaccaaaauccugcgauaagacacauaccuguccgcccugcccugcgccagagcuuuugggugggcccucuguguuucuguucccuccaaagcccaaagacacgcuaaugaucagccggacuccggaaguaacauguguggucguggauguuucacacgaggacccugaggugaaguuuaauugguaugucgauggaguggaaguacauaacgcaaaaaccaagccccgcgaggaacaauacaauaguacuuaucgaguuguguccguccucacagugcugcaccaggacuggcuuaacggcaaagaguacaagugcaaagucagcaauaaggcccugccagcuccuauugagaagaccaucucuaaagccaagggccagccccgugaaccacagguguauacguugcccccuucaagagaugagcucaccaaaaaccaaguuagucugacauguuuagugaagggguucuacccaagcgacauagcaguagaaugggaguccaauggacagccggaaaacaacuauaaaacuacacccccuguccuggauucugacgguucguuuuuccucuacagcaaacuuaccguggacaaguccagguggcagcaaggcaauguguuuucaugcaguguuaugcacgaggcucugcauaaccacacucagaagucuuugagccuauccccagggaag

SEQ ID NO: 23942 - RNA, 642 nt, Artificial Sequence
  derived and/or modified sequence opt3 from Iratumumab_LightChain
gacauccagaugacccaaagccccacaucccugucugccucagugggcgauagagucacuauuacgugcagggcuagucaggggauaagcuccuggcucaccugguaccagcagaagccugagaaagcaccaaagucucuuaucuaugccgcgucgucacugcaaagcggaguuccgagucgguucuccgguucuggcagcgggacagacuuuacuuugaccauuuccucauuacagcccgaagauuucgcuacauacuauugucagcaguacgacaguuauccuaucaccuuuggacaaggcacucgccuggagauuaaacgaacaguggccgcaccaagcguauucaucuuucccccuucugaugaacagcuaaaguccgguaccgccucaguggucugccuccugaacaauuucuacccacgugaggcuaaagugcaguggaagguugacaacgcacuucagagcgggaauagucaagaaucugugacggagcaggauuccaaggacagcacuuauucgcugucuuccaccuugacacucucaaaagccgauuacgagaagcacaaagucuacgcuugugaagugacucaucagggacugaguagccccguaaccaaguccuuuaacagaggcgagugc

SEQ ID NO: 23943 - RNA, 1344 nt, Artificial Sequence
  derived and/or modified sequence opt3 from Lacnotuzumab_HeavyChain
caggugcagcugcaggagagcggccccgggcucgucaagccuucccagacccuuucucugacaugcacuguuucagacuacaguaucacgagcgauuaugccuggaacuggauuagacaguucccaggaaaagguuuggaauggaugggcuacauauccuauucugggucgaccucauacaauccgagcuuaaagaguaggaucacaauuucccgggacacuucuaaaaaccaauuuagccugcagcuaaauuccgugaccgcugcagauacagccguauauuacugugcgucauucgacuaugcucacgccauggauuacuggggacagggcaccacugugacagucaguagcgcaucuaccaagggucccuccguguuuccucucgccccaucaagcaaaaguacgucugggggaacugcugcacugggcugccuuguuaaggacuacuuccccgagccugugaccgucuccuggaacagcggcgcccugacaucgggggugcauacuuuuccagcuguauugcagucuuccggacucuauucacugaguagcguugugaccguccccuccucuagccuggguacacaaaccuacaucuguaaugugaaccacaagccuucaaauacgaaaguggauaagcgcgucgaaccaaaaaguugcgacaagacucauacauguccgcccugcccugccccagagcucuuaggcgggcccuccguuuuccuguuuccuccaaaacccaaggauacccuuaugauuagccgaacuccggaagugacauguguaguggucgacgugucucacgaggauccugagguuaaguucaacugguauguggacggagucgaagugcauaaugcgaaaaccaagccccgugaggaacaguacaacucaacguauagaguaguuaguguguugaccguccugcaccaggauuggcuaaauggcaaagaguacaagugcaaagugagcaacaaggcacucccagccccuaucgagaaaacaauauccaaggcuaagggucagcccagggaaccacaagucuauacucugcccccuucucgggaggaaaugaccaaaaaucaggugucgcuuacaugucugguuaagggguuuuacccaagcgacaucgccguggagugggaauccaacggacagccggagaauaacuacaaaacuacacccccuguauuggacucagauggcaguuucuuucucuauucuaagcugaccgucgacaaaagccgcuggcaacagggcaacguguucuccugcucaguuaugcacgaggcauuacauaaucacuacacccaaaagagccugucucucuccccagggaag

SEQ ID NO: 23944 - RNA, 642 nt, Artificial Sequence
  derived and/or modified sequence opt3 from Lacnotuzumab_LightChain
gacaucgugcugacccagagccccgccuuccucuccgucacaccuggcgagaagguuacuuuuacgugccaggcuucucaaucaauugggaccaguauacacugguaccagcagaaaacagaucaagcaccaaaacuucugaucaaguaugccagcgaauccauuucuggaaucccgucgagauucucagguagcggcagugggacugacuuuaccuugacaauuuccucuguggaggcggaagaugcugccgacuacuauugucagcagaucaacagcuggcccaccacuuucggaggcgguacaaaguuagagauaaaaaggaccguagcagccccuuccguguuuaucuucccacccucagaugaacagcugaagagugggacggcuagcgucgugugccuacucaauaacuuuuacccucgggaggcaaagguucaauggaaaguggacaaugcccugcagucuggaaacucccaggagucagucacugaacaggauagcaaggacaguaccuauucucuuuccagcacacugacuuugucgaaagcugauuacgagaagcauaaaguguaugccugugaaguaacccaccaaggccucucuuccccaguuacaaagucauucaaucgcggcgagugc

SEQ ID NO: 23945 - RNA, 1347 nt, Artificial Sequence
  derived and/or modified sequence opt3 from Larcaviximab_HeavyChain
gaggugcagcugcaagaaagcggccccgagcucgaaaugccuggggccuccgucaagaucucuugcaaggcuucaggaaguagcuucaccgguuuuuccaugaacuggguuaaacagucuaauggcaaaucgcuugaguggauugggaacauagacacauacuauggaggcacuacguacaaucagaaguucaaagguaaggcaacccugacaguggauaagucaagcaguacugccuauaugcaguugaaauccuuaaccucugaagacagcgcgguauacuauugugcuagauccgccuacuaugggucaacauuugcauacuggggacaaggcacccuggugacugucagugccgcuagcacaaagggcccaucuguguucccgcuagcacccuccucaaaaagcaccagugggggaacggccgcucucgguugccugguuaaggauuacuuuccugagccagugacugucucuuggaacuccggcgcccuuaccagcggggugcacacauuccccgcgguacugcagucgucuggauuguauucccucucaaguguugugacugucccuagcuccucucugggcacccagacauacaucuguaaugugaaccauaaaccaagcaauaccaagguggacaagagggucgagcccaaaucaugcgauaagacgcacacuuguccuccaugcccggcacccgaacugcucggugggccuaguguuuuucucuucccacccaaaccuaaggacacacugaugauuucccggaccccagaggugacuuguguaguggucgaugugagccaugaagaccccgagguuaaauuuaacugguauguggauggagucgaggugcacaaugccaagacaaaaccgcgcgaggaacaguacaacucuaccuaucgaguaguuucagugcuuacggucuugcaucaagacuggcugaauggcaaggaauacaagugcaaagugaguaacaaggcucuaccugcccccaucgagaaaaccauuagcaaggcaaaaggccagccacgugaaccucaggucuauacauuacccccauccagagaugagcugacuaagaaucaggugucucuuaccugucugguuaagggguucuaccccucggacaucgcuguggagugggaaagcaacggacaaccugagaauaacuacaaaacaacuccaccgguauuggauuccgacgguucauuuuuccucuauaguaagcugaccgucgacaaaucuagguggcagcagggcaacguguuuagcugcuccguuaugcacgaagccuuacacaaucauuacacacaaaagucacugagccucucucccgggaaa

SEQ ID NO: 23946 - RNA, 642 nt, Artificial Sequence
  derived and/or modified sequence opt3 from Larcaviximab_LightChain
gacauccagaugacccaaagccccgccucccugucugcuucagugggcgagacagucacuauuacgugcagagcaagugaaaacauauacagcuaucucgccugguaccagcagaagcaggggaaauccccucaacuucugguuuauaaugcgaagaccuugaucgagggagugccaucuagguucucggguucaggcagcgggacacaguuuaguuuaaaaauuaacucccugcagccggaagauuucggaucuuacuuuugucagcaccauuucggcacucccuuuaccuucgguagcgggacagagcuagaaaucaagcggaccguagcugccccuuccguguuuauuuucccacccucagacgagcaacucaaaaguggaacugcaagcgucgugugccugcuuaauaacuuuuauccucgcgaggccaagguucaguggaagguggauaaugcucugcagucuggcaacucccaggaaucagucacagagcaagacagcaaagauaguaccuacucuuuguccagcacgcucacucugucgaaggcagacuaugaaaaacacaagguguacgccugugagguaacccaucagggccugucuuccccaguuacaaaaucauucaaucgaggggagugc

SEQ ID NO: 23947 - RNA, 1338 nt, Artificial Sequence
  derived and/or modified sequence opt3 from Lendalizumab_HeavyChain
caggugcaacugguccagagcggcgccgagguuaagaaacccggggcuuccgugaagguaucuugcaaagcaucaggauacaccuucacagacuauaguauggauugggugagacaggccccuggucagggccucgaauggaugggggcgauccaccuuaacacuggauacacgaauuauaaccaaaaguuuaaaggcagggucaccaugacacgggacacuagcaccuccacaguguacauggagcugucuucguugcgcucagaagauaccgcuguuuauuacugugcccgagguuucuaugacggguacagcccaauggauuacuggggacagggcacuacagugaccgucaguuccgcaucuacgaagggcccgagcguguuucccuuagccccuugcucccguucaacuuccgagagcaccgcugcacuggggugucuaguaaaggacuauuucccagaacccguuacagugucuuggaauaguggagcccucacuucagguguccauaccuuuccugcugugcugcagagcaguggccuuuacucucuguccagcguggucacaguuccaucgucuaacuucgggacccagacguauacuugcaauguggaucacaaacccuccaacacaaagguagacaaaaccguggagagaaaguguugcgucgaguguccuccaugcccggcgcccccuguggccggaccaucaguuuucuuguuucccccuaaaccaaaggauacucucaugauuaguaggacacccgaagugaccugugucgugguagacguuagccaagaggauccggaagugcaguuuaauugguacgucgacggcguggagguccauaacgcaaagacgaaaccucgggaggaacaguucaauuccaccuaucgcgugguuucugugcugacaguacugcaccaggauuggcucaacgguaaggaguacaaaugcaaggucagcaauaaaggguuacccucaaguauagaaaagacuaucuccaaagccaagggacaaccaagagagccucagguguauacccugcccccaagccaggaagagaugacaaagaaccaaguuucucuuacuuguuuggugaaaggcuuuuaccccucagacauugcugucgagugggaaaguaauggccagccugagaacaauuacaagaccacaccaccggugcuggacagcgauggguccuucuuucuauauucuaggcucaccguagacaaaucgcgguggcaggaaggaaacguguucagcugcuccguuaugcaugaggcccugcacaaccacuacacucagaagucacuuagucugucuuuggguaaa

SEQ ID NO: 23948 - RNA, 654 nt, Artificial Sequence
  derived and/or modified sequence opt3 from Lendalizumab_LightChain
gacauccagaugacccaaagccccuccucucugucagccagugugggcgauagagucacaauuacuugcagggcuagcgaguccguugacucuuacgggaacucguucaugcacugguaucagcagaagccuggaaaagcaccaaagcuccuuauauaccgggccucaaaucuggaaagcggugugccgagucgcuuuuccggcucugggagcggaacggauuucaccuugacaaucuccucauuacagcccgaggacuuugcgacuuauuacugucaacagaguaacgaagauccuuauaccuucggcggugggacaaaaguagagauuaagcgaaccguggcugccccaagcgucuuuaucuuucccccuucugacgaacagcugaaauccggaacugcaucagugguuugccuacucaauaacuucuacccacgugaggccaaggugcaguggaaggucgauaaugcucugcaaagcggcaacagucaggagucugugacagaacaggacuccaaagauagcaccuauucgcuuucuuccacgcugacuuugucaaaggcagacuacgagaaacauaagguauacgccugugaaguuacccaccagggccucaguagccccgugacaaaauccuucaauagaggggagugc

SEQ ID NO: 23949 - RNA, 1359 nt, Artificial Sequence
  derived and/or modified sequence opt3 from Lesofavumab_HeavyChain
gaggugcagcugguccagagcggcgccgaaguuaagaaacccggggagucccucaagaucucuugcaaagugucaggauacaguuucaccagccaguggauugguuggguaagacagaugccuggcaaggggcuugaauggauaggaaugauguauccaggcgaguccgaaacaaucuacucuccgucguuucagggucaagugacuauuucagcugacaacagcaucaguacggcauaucugcagugguccucuuugaaagccagcgauaccgcgauuuacuauugugcuuccgggcccggauacucaggcuaucacuacggcugguucgacacaugggggcagggaacuuuagucaccgugaguagcgccucuacaaaggguccuuccguuuuuccacuggcacccucaagcaagaguaccucuggcgggacugccgcucuaggaugccucgugaaagauuacuucccugagccagucacaguguccuggaauagcggcgcacugaccucggguguacauacguuucccgccguucuucagucuuccgggcuguauucauugaguagcguggucacugugccuuccucuagccucggaacccaaacauacaucuguaacgugaaucacaagccaucaaacacuaaagucgacaagaaaguugagccgaagaguugcgauaagacccauacaugucccccuugcccagcucccgaacugcugggcggcccuuccguguuccucuuuccacccaaaccgaaggacaccuuaaugauaagcaggacgccugagguaacuuguguggucguggauguuucucacgaagaccccgaggugaaauucaauugguaugucgaugggguggagguacauaacgccaagacaaaaccacgggaggaacaguacaauucaaccuaucgcguugugaguguccugacugugcuucaccaggacugguugaacggaaaggaauacaaaugcaaggucagcaauaaggcgcugccugcacccaucgagaaaacaauuuccaaggccaaaggucagccacgagaaccccaaguguauacccuaccuccaucucgugaggagaugacgaagaaccagguuucgcucaccugucuggugaaaggcuuuuacccgagcgauaucgcuguagaaugggaguccaaugggcagcccgaaaacaauuacaagacaacuccuccaguccuugacucagauggaaguuucuuucuguauucuaaguugaccguggacaaaagcagauggcaacagggcaacguuuucuccugcucagugaugcacgaggcccuccauaaucacuacacacaaaagagccugucuuuaucccccgguaaa

SEQ ID NO: 23950 - RNA, 657 nt, Artificial Sequence
  derived and/or modified sequence opt3 from Lesofavumab_LightChain
gacaucgugaugacccagagcccccugucccucccugucacaccaggcgagccggccucuauuucaugcagaaguagccaaucccuucugaggucuaacggguacaauuauuuggauugguacuuacagaagcccggacagucgccucagcugcuaauauaucucgguucaaaccgggcuagcggcguuccagaccgcuucaguggguccggaucuggcacugauuuuacgcugaaaaucagccgaguggaagcagaggacguagguguguacuauuguaugcaagcccuucagacccccuacacauucgggcagggaacuaagcuggaaauuaaacguaccgucgcggcuccuuccguguuuaucuucccacccucagaugagcaguugaagaguggcacagccagcguugugugccuccugaauaacuuuuauccuagagaagcaaaaguccaauggaagguggacaaugcccugcagucuggcaacucccaggagucaguaaccgagcaggauagcaaggacaguacuuacucucucuccagcacauuaacccugucgaaagcugauuacgaaaagcacaaaguuuaugcaugugaggugacgcaucaagggcuuucuuccccagucacuaagucauucaauaggggagaaugc

SEQ ID NO: 23951 - RNA, 1059 nt, Artificial Sequence
  derived and/or modified sequence opt3 from Letolizumab_HeavyChain
gaggugcagcugcucgaaagcggcgggggacuuguccaacccgguggcucccugagauugucuugcgccgcuucaggguucaccuuuaacugggaguuaaugggaugggcaaggcaggccccuggcaagggucuggaauggguuagugggaucgagggaccaggcgacgugacauacuaugcggauagcguaaaaggccgguucacuauuucccgcgacaauucuaagaacacgcuauaccuccagaugaauagccugcgagcugaagauaccgccguguauuacugugucaaaguggggaaggacgcaaaaucagauuaucguggacaggguacacuuguuacugugagcagugccuccaccgagccgaagucuagcgacaagacacacaccucacccccuuccccagcucccgagcuguugggcgggaguagcgucuuucucuucccuccaaaacccaaggauacucugaugauaucuagaacaccugaagugaccugcguaguuguggacgucucccaugaggauccagaagugaaauuuaacugguacguggacggagucgagguucacaaugcaaagacgaaaccgagggaggaacaauauaacucaacuuaccgggugguaagcgugcugaccguccuccaucaggauugguuaaauggcaaggaguacaaguguaaagugaguaacaaggcccugcccgcuccuaucgaaaagacaauuucuaaggccaaaggucagccacgcgagccccagguuuauacucuuccuccauccagagacgaauugaccaagaaucaagugagccugacaugccuagucaaaggguucuaccccucggauaucgcgguggagugggagucuaacggacagccggaaaauaacuauaagaccacgccucccguacucgacuccgacggcucauuuuuccuguacaguaaacuuacuguugauaaaucgagguggcagcagggcaauguguuuuccuguucugucaugcacgaggcacugcauaaccacuauacacaaaagagcuugucacucaguccagggaaa

SEQ ID NO: 23952 - RNA, 1338 nt, Artificial Sequence
  derived and/or modified sequence opt3 from Losatuxizumab_HeavyChain
gaggugcagcugcaagaaagcggccccgggcucgucaagccuucccagacccuuucucugacaugcacuguuucaggauacaguaucagcagagacuucgccuggaacuggauuaggcagccaccggguaaaggcuuggaguggaugggguauauauccuacaauggaaacacgcgguaucagcccucuuuaaagucgcgcaucaccauuucacgagauacaagcaaaaaucaauuuuuccugaagcuaaacagugugacugcugcagacaccgccacauacuauuguguaaccgcgucccguggcuuuccuuacuggggucaggggacucucgugacagucucuagcgcuuccaccaaaggaccaucaguguucccccuggccccuaguagcaagucuacguccggcggcacugcagcccuugggugccugguuaaggauuauuuuccagaacccgugaccgucucauggaauagcggagcuuugacaaguggugugcacacuuucccugcaguacuccagucuuccggccuguacagccugucgucuguugugaccgucccauccucaagucucgggacacagaccuacaucuguaacgugaaucauaaaccgagcaacacgaagguggacaaaaaggucgagcccaaauccugcgauaagacucacacauguccuccaugccccgccccugaauuacugggaggcccaucuguuuuucuuuuucccccgaagccuaaagacaccuugaugauuagcagaacucccgaggugacauguguaguggucgaugugucacaugaggacccagaaguuaaguucaauugguauguggauggugucgaggugcacaacgcuaaaaccaagccuagggaggaacaauacaauaguacguaucggguaguuuccgugcugaccguccuacaucaggacuggcucaacgggaaagaguacaagugcaaagugagcaauaaggcccugcccgcgccaaucgaaaagacaauaucuaaagcaaagggacagccccgcgagccucaggucuauacucuuccaccgucaagagaagagaugaccaaaaaccaagugagucugacauguuugguuaagggcuucuaccccagcgauaucgccguggaaugggaguccaauggccagccugagaacaacuauaaaacuaccccacccguacucgacucugaugggucguuuuuccuguacagcaaguuaacagucgacaaguccagguggcagcaaggaaauguguuuucaugcaguguuaugcacgaagcucugcacaaccauuacacccagaaaucucucagccuuuccccugguaag

SEQ ID NO: 23953 - RNA, 642 nt, Artificial Sequence; identical to SEQ ID NO: 23131
  derived and/or modified sequence opt3 from Losatuxizumab_LightChain

SEQ ID NO: 23954 - RNA, 1338 nt, Artificial Sequence
  derived and/or modified sequence opt3 from Lupartumab_HeavyChain
gaggugcagcugcucgaaagcggcgggggacuuguccaacccgguggcucccugagauugucuugcgccgcuucaggguucaccuuuaguaacgcauggaugagcuggguuaggcaggccccuggaaagggcuuagaguggguguccuacaucucuucgucagguagcacaauuuauuacgcggacaguguaaaagggcgguucacuauaucccgcgauaauucuaagaacacgcuguaucuacagaugaauagccuccgagcugaagacaccgccguguacuauugugcacgugagggacugugggccuuugauuacuggggccagggcacacuugucacuguguccucagcuaguaccaaagggccaagcguuuucccgcuggcacccucuuccaagucaacaagcggagguaccgccgcuuugggcugccucgugaaagacuauuuuccugaaccagucacugugaguuggaacucuggggcccugacauccggaguacacaccuuccccgcgguucugcaaagcucgggccucuacucuuuauccucaguggucacggugccuaguagcucccuggguacucagaccuacaucuguaaugugaaccauaagccaucuaauacaaaggucgauaaaaagguugagcccaaaagcugcgacaagacucacaccuguccuccaugcccggcacccgagcuuuugggagggccuucaguguuucuguucccacccaaaccuaaggauacacuaaugauuaguagaaccccagaaguaacguguguggucguggacguuucccaugaggaucccgaagugaaguuuaacugguaugucgacggcguggagguacacaaugccaaaacuaagccgagggaggaacaguacaacagcacauaucggguugugucuguccucaccgugcugcaucaggauuggcuuaauggcaaagaguacaagugcaaagucucaaacaaggcucugccugcccccaucgaaaagacuauuaguaaggcaaaggggcaaccacgcgagccucagguguauacauugcccccaagcagagacgaacucaccaaaaaucagguuucccugacguguuuagugaagggauucuaccccucugauaucgcuguagagugggagucgaacggucagccugaaaauaacuauaaaaccacaccaccgguccuggacagcgacggcuccuuuuuccucuacucaaaacuuacuguggauaaaaguagguggcaacaggggaacguguuuucuugcagcguuaugcacgaggcccugcacaaucauuacacccagaaguccuugucacuaagccccgga

SEQ ID NO: 23955 - RNA, 651 nt, Artificial Sequence
  derived and/or modified sequence opt3 from Lupartumab_LightChain
gagagcgugcugacccagcccccuuccgucucuggcgccccagggcaaagaguuacaaucucaugcacuggaaguagcuccaacauuggugcuggcuacgugguacacugguaucagcagcucccggggacggcacccaaacuucugauauacgacaauaacaagaggccuucuggagugccagaucgguucucgggcucaaagagcgguaccagugccuccuuggcgaucucuggguuacgcagcgaagacgaggcugauuauuacugugccgcaugggacgaucgacugaauggacccgucuuuggcggcgggacaaaacuaacugugcucggacagccuaaggccgcuccauccguuacccuguuucccccuucaagugaggaacuucaagcaaacaaagccacacuggugugcuugauuagcgacuucuauccaggugcugucaccguggccuggaaggcggauucuuccccgguaaaggcaggcguugaaacuacaacccccucaaaacagagcaauaacaaguacgccgcuaguucuuaucucucccugacgccugagcaguggaaaagccaucguucguacucuugucaggugacucacgagggguccaccgucgaaaagacaguggccccaacugagugcuca

SEQ ID NO: 23956 - RNA, 1731 nt, Artificial Sequence
  derived and/or modified sequence opt3 from Lutikizumab_HeavyChain
gaggugcagcuggucgaaagcggcgggggaguugugcagcccgguagaucccucaggcuuucuugcucagccaguggcuucaucuuuagccgguacgacauguccuggguacgccaggcuccugggaagggacuggaguggguggcauauauuucucacggcggugccgggaccuacuauccagauucggucaaaggacgauucacaauaucacgugacaacagcaagaauacuuuguuuuuacagauggauagucugagaccggaagacacgggcguguacuucugugcgaggggcgggguuaccaaaggauauuuugauguguggggucagggcacacccgucacuguguccucugcuagcaccaaggggccucaaguacagcuaguugaguccggaggcggugugguccagccagggcggucacuccgccugaguugcacagccagcggauucaccuuuucuauguucggcgugcauugggugagacaggcacccggcaaagggcuugaaugggucgccgcuguuuccuacgacggaucaaacaaguauuacgcagagagcgugaaggguagguuuacuaucagucgggauaauucuaaaaacauucuguucuugcaaauggacucccuccgccuggaggauacagccguauacuauugugcucgaggcagaccuaagguggucaucccagcgccccuggcccacugggggcagggaacccucgugacguuuagcucggcaucuacuaaaggcccuuccguuuucccauuagccccgucaaguaagagcaccuccggugggacagcugcccugggcugccuugugaaagacuacuuucccgaaccugucacugugucuuggaauagcggagcauugaccucaggcguacauacauucccagcuguucugcagaguuccgggcuauauagccucucuucaguggucaccgugcccaguagcucccugggaacgcagacuuacauuuguaacgucaaucacaagccuucuaacacaaagguggauaaaaagguugagccaaaaucgugcgacaagacccauacuugucccccgugcccugcccccgaagcggccgguggcccaagcguguuccuuuuuccucccaaaccaaaggauacacugaugaucuccaggacccccgagguaacgugugucgugguugacgugucacacgaggacccugaagucaaauucaauugguauguggaugggguagaggugcacaacgcaaagaccaagccacgggaggaacaauacaauaguacauaucguguugucucuguguugacugugcuccaucaggacuggcugaacggaaaagaauacaagugcaaagucagcaauaaggcuuuaccggcccccauagagaaaaccaucuccaaggcuaagggccagccucgcgagccacaaguuuacacacugcccccuucaagagaagagaugacuaaaaaccaggugagccucaccugucuugugaaggguuuuuauccaucugauauugccguagaaugggaguccaaugggcagcccgaaaacaacuacaaaacaaccccgccuguccuggacagugauggcagcuucuuuuuguauucuaagcuaacuguggacaaauccagguggcagcaaggaaauguuuucucaugcagugugaugcacgaggcacugcauaaccacuacacgcaaaagagccucucgcuguccccaggcaag

SEQ ID NO: 23957 - RNA, 981 nt, Artificial Sequence
  derived and/or modified sequence opt3 from Lutikizumab_LightChain
gacauccagaugacccaaagccccuccucucugucagccagugugggcgauagagucacaauuacuugcagggcuagcgggaacauacacaauuaccucacgugguaucagcagaccccuggaaaggcaccaaaacuucugaucuacaacgccaagacauuggcggacgguguuccgucccgguucucuggcucggggucaggaacugauuauaccuuuacaauuagcaguuuacagcccgaggacaucgcuaccuacuauugucaacauuucugguccauuccuuacacuuuuggccaggguacaaaacugcagaucacccgcacgguggccgcaccagauauacagaugacucaaucucccagcuccguaucagccagugugggggaccgagucaccaucacaugccgugcuagccagggaauuucuuccuggcuagcaugguaucagcagaagccuggcaaagccccaaagcuccugaucuacgaggcuucaaaucuugaaacuggcgugcccagcagauucagugggucuggauccgguagcgauuuuacccugacaauuucgucuuugcaaccugaagacuucgccaccuacuauugucagcagacguccucauuucuccugaguuucggcgggggaacuaagguugagcacaaaaggacaguggcggcaccaagcgucuuuaucuucccgcccuccgaugaacaacugaagucuggcaccgccagcgugguaugccucuuaaacaauuuuuacccucgggaggcuaaaguucaguggaagguggacaacgcccugcagucagguaauagucaggaguccgucacugaacaagauagcaaagacucuacauauucacuuaguagcaccuugacgcuguccaaggcagauuacgagaagcauaaaguguaugcuugugaagugacccaccaggggcuaucuucgccagucacaaagagcuucaaccgcggagagugc

SEQ ID NO: 23958 - RNA, 1341 nt, Artificial Sequence
  derived and/or modified sequence opt3 from Oleclumab_HeavyChain
gaggugcagcugcucgaaagcggcgggggacuuguccaacccgguggcucccugagauugucuugcgccgcuucaggguucaccuuuaguagcuacgcauauuccuggguuaggcaggccccuggaaagggcuuagagugggugucugcgaucucggguucagggggacggacauacuaugcugacagcguaaaaggccgcuucacuauuagucgagauaacuccaagaauacgcuguaccuacagaugaacucucuccgugccgaagacaccgcaguguauuacugugccagacugggcuaugggagggucgaugaguggggacgggguacacuugugacuguuagcuccgcuucaaccaaaggcccaaguguguuuccgcuggcacccagcucuaaguccacaucagggggaaccgccgcuuugggcugccucgucaaagacuacuucccugaaccagugacuguaagcuggaauaguggugcccugacaucugggguucacaccuuucccgcggugcugcaguccagcggacucuacucguuaucuuccgucgugacggugccuucaaguagccugggcacucaaaccuauauauguaacgucaaucauaagccauccaacacaaagguugauaaacgcguggagcccaagucuugcgacaaaacucacaccuguccuccaugcccggcacccgaguucgaaggcgggccuagcguauuucuuuucccacccaagccuaaagauacauugaugaucucaagaaccccagaggugacgugugucgugguugacgugagucaugaagaucccgaggucaaguuuaauugguacguggacggaguagagguucacaacgccaagacuaaaccgagggaggaacaguauaauuccacauaccggguggucagcgugcugaccguccuacaucaggauuggcucaacgguaaggaauauaaaugcaaggugucuaauaaagcucugccugccucaauugagaagacuaucaguaaagcaaagggccagccccgcgaaccacaaguuuacacacuuccucccagccgagaggagaugaccaagaaccaggugucccugacguguuugguaaaaggguucuauccaucugacauugcugucgaaugggagucgaauggacagcccgaaaacaauuacaagaccacaccuccagugcucgauagcgacggcuccuuuuuccuguacucaaaauuaacuguugacaagaguagauggcagcaagguaacguguuuucuugcagcgucaugcacgaggcccugcacaaccauuauacccagaaaucccucucacuuagcccggggaag

SEQ ID NO: 23959 - RNA, 648 nt, Artificial Sequence
  derived and/or modified sequence opt3 from Oleclumab_LightChain
cagagcgugcugacccaacccccuuccgccucuggcacaccagggcagagagucacuaucucaugcaguggaagccucuccaacauugguaggaauccgguuaacugguaccagcagcuucccggcacggcuccuaagcuguugauauauuuagacaaucugcggcuaucuggggugccagaucgcuucucgggaucaaaaagcggcaccagugcaucccucgccaucucuggucugcaaagcgaggacgaagcggauuacuauugugcuacaugggacgauucccaccccggguggacuuuuggaggcggcaccaaacuuacaguacuggggcagccuaaggccgcaccaucagugaccuuguuucccccuaguagcgaggaacuccaggccaacaaggcuacucuggucugccugauuucugacuucuacccaggagcagugacaguugccuggaaagcugauuccucaccggugaaggccggugucgagaccacgacucccagcaagcagaguaauaacaaauaugcggcaucuuccuaccucagcuuaaccccugaacaauggaagucgcaucgaucuuauuccugucaggugacacacgagggcucaacuguagagaaaaccguugccccaacagaaugcagu

SEQ ID NO: 23960 - RNA, 1449 nt, Artificial Sequence; identical to SEQ ID NO: 23575
  derived and/or modified sequence opt3 from Otlertuzumab_HeavyChain

SEQ ID NO: 23961 - RNA, 339 nt, Artificial Sequence
  derived and/or modified sequence opt3 from Ozoralizumab_HeavyChain
gaggugcagcuggucgaaagcggcgggggacucguucaacccgguggcucccuuagacugucuugcgccgcuucaggguucaccuuuagugacuacuggauguauugggugaggcaggcaccuggaaagggcuuggaguggguaagcgaaaucaacacaaaugguuuaauuacuaaauacccagauuccgugaaggggcgguucacgauaucucgcgacaacgccaaaaauacccuguaucuacagaugaacucgcuccgaccggaggauacagcggucuacuauugugcucguucacccagcggauuuaauagaggccagggcacucuggugaccguu

SEQ ID NO: 23962 - RNA, 1089 nt, Artificial Sequence; identical to SEQ ID NO: 23580
  derived and/or modified sequence opt3 from Ozoralizumab_HeavyChain_HeavyChain_HeavyChain

SEQ ID NO: 23963 - RNA, 1494 nt, Artificial Sequence
  derived and/or modified sequence opt3 from Pasotuxizumab_HeavyChain_LightChain_HeavyChain_LightChain
caggugcaacuggucgagagcggcgggggacucguuaagcccggugaaucccuuagacugucuugcgccgcuucaggcuucaccuuuagugacuacuauauguacugggugaggcaggcaccugggaaaggauuggaguggguagccaucauuagcgauggcgguuauuacacauauuacuccgacauaaucaaggggcgguucacuauuucucgcgauaacgcgaaaaauucguuauaucugcagaugaacucacuaaaggcugaagacacggccguguacuacugugcacgaggauuuccacuccugcgucacggcgccauggauuauuggggccaggggacccuugucacagugagcaguggagguggcggguccggaggcggugggucuggaggcggcgggagcgacauccaaaugacucaguccccgucaagucugagcgcuucuguuggagauagagugaccauuacaugcaaagcaucccagaaugucgacaccaacguggccugguaccagcaaaagcccggucaggcuccuaagucauugaucuauagcgccaguuacagguauucugauguaccaucccgguucagcggcucggcgucugggacugacuuuacacucaccauauccucaguucagagugaggauuucgcaacguacuauugucagcaauacgacagcuaccccuauacuuuuggaggcgguaccaaacuggaaaucaaguccgggggcggaggcucugaggugcagcuggucgagagcgggggaggucucgugcagccuggcgggucauuaaaacugaguugcgccgcuuccggauucacauuuaauaaguacgccaugaacugggugcgccaagcaccaggcaaaggucuugaaugggucgcuagaauuaggagcaaguauaauaacuacgccacuuauuacgcggauucuguuaaggaccgguucaccaucucacgcgacgauaguaaaaauacagccuauuugcagaugaacaaucugaagaccgaggacacggcaguguacuacuguguacgacaugggaacuuuggcaauagcuauauuuccuacugggcuuauuggggacagggcacucuagugacagucucuucgggaggggguggcagcgggggaggcgguuccgggggcggaggcucacagaccgugguuacucaagaacccagucucacagugucuccugggggaaccgucacgcugaccugcggcagcuccacaggugccgugacuucagggaacuacccaaauuggguacagcagaaaccgggacaggcucccagaggccuuaucgguggcaccaaguuccuggccccugggacaccagcaagguuuagcggaucuuugcucggcgggaaagccgcucugacuuuauccggaguucaacccgaggaugaggcggaauauuacugugugcugugguauaguaaccggugggucuucggcggugggaccaagcucacagugcuu

SEQ ID NO: 23964 - RNA, 357 nt, Artificial Sequence
  derived and/or modified sequence opt3 from Pasotuxizumab_HeavyChain1
caggugcaacuggucgagagcggcgggggacucguuaagcccggugaaucccuuagacugucuugcgccgcuucaggcuucaccuuuagugacuacuauauguacugggugaggcaggcaccugggaaaggauuggaguggguagccaucauuagcgauggcgguuauuacacauauuacuccgacauaaucaaggggcgguucacuauuucucgcgauaacgcgaaaaauucguuauaucugcagaugaacucacuaaaggcugaagacacggccguguacuacugugcacgaggauuuccacuccugcgucacggcgccauggauuauuggggccaggggacccuugucacagug

SEQ ID NO: 23965 - RNA, 369 nt, Artificial Sequence
  derived and/or modified sequence opt3 from Pasotuxizumab_HeavyChain2
gaggugcagcuggucgaaagcggcgggggacucguucaacccgguggcucccuuaagcugucuugcgccgcuucaggguucaccuuuaacaaauacgcaaugaauugggugagacaggccccuggaaagggcuuggaguggguagcgaggauccggaguaaauauaacaauuacgcuacauauuacgccgacagcgugaaggaucgcuucacuauuucccgagacgauucuaaaaacacggcauauuuacagaugaauaaccugaagaccgaagacacagccgucuacuauugugugcgucacgguaauuuugggaacucguacauaucauacugggcuuauuggggacagggcacucuaguuaccgug

SEQ ID NO: 23966 - RNA, 321 nt, Artificial Sequence
  derived and/or modified sequence opt3 from Pasotuxizumab_LightChain1
gacauccagaugacccaaagccccuccucucugucagccagugugggcgauagagucacaauuacuugcaaggcuagccagaacguugacacgaauguggcaugguaccagcagaaaccugggcaagccccaaagucccucauauauucugcgucguacagguauucagauguaccgagccgguucaguggauccgcuucugguaccgacuuuacacuuacuaucagcuccgugcagucagaggauuucgccaccuacuauugucagcaguacgacaguuaucccuacacauuuggcgggggaaccaaacuggaaauuaag

SEQ ID NO: 23967 - RNA, 327 nt, Artificial Sequence
  derived and/or modified sequence opt3 from Pasotuxizumab_LightChain2
cagaccguggucacacaagagcccagccugacuguuuccccuggcgggacggugacccucacaugcggaucuucaacuggugccguaaccaguggcaacuacccaaauugggugcagcagaagccggggcaggcucccagaggacuuaucggcgguacaaaauuccuggcaccugggaccccagccagguuuagcggauccuuguuaggcggcaaggcggcucugacucuaucugggguccaacccgaagacgaggccgaauauuacugugugcucugguauucgaaccgguggguuuucggagguggcacaaaacugaccgugcuu

SEQ ID NO: 23968 - RNA, 1023 nt, Artificial Sequence; identical to SEQ ID NO: 23624
  derived and/or modified sequence opt3 from Placulumab_HeavyChain

SEQ ID NO: 23969 - RNA, 1353 nt, Artificial Sequence
  derived and/or modified sequence opt3 from Porgaviximab_HeavyChain
gaggugcagcugcaagaaagcggcgggggacucaugcagcccgguggcuccaugaagcucucuugcgucgccucaggguucaccuuuaguaacuacuggaugaauuggguuagacagagcccugagaaaggacuggaauggguggcugagaucagguugaaguccaacaauuaugcaacacacuacgccgaaucuguaaaaggccgguucacuauuucgcgcgacgauucaaagcgaagcguguauuuacagaugaacacgcugcgugcggaggacaccgguauauacuauuguacaagagggaauggaaacuacagggcuauggauuauuggggccaaggcacuucagucaccguguccucugccagcacaaaagggccauccguuuuuccgcuagcacccucaaguaagagcaccucuggagguacugccgcucucggcugccuggugaaggacuacuucccugagccagucacaguguccuggaauaguggggcacuuaccagcggaguacauacguuucccgccguucugcagaguucuggcuuguacucccucagcucgguggucacugugccuucuuccucacuggguacccagacauauaucuguaacgugaaucacaaaccaaguaacacuaaggucgauaaacggguugaacccaagagcugcgacaaaacccauacauguccuccaugcccggcucccgagcugcucgggggaccuuccguguucuuauuuccacccaagccuaaggauacccugaugauuucucgcacgccagaaguaacuuguguggucguggacguuagccacgaggaucccgaggugaaauucaauugguacgucgacggcguggaaguacauaacgccaagacaaaaccgagagaggaacaguauaauucaaccuacaggguugugaguguccuuacuguguugcaccaagauuggcugaacggcaaggaguauaaaugcaaggucuccaauaaagcgcuaccugcacccaucgaaaagacaauuagcaaggccaaagggcagccacgggagccucagguguacacccuucccccaucucgcgacgagcugacgaagaaccagguuucacuuaccugucuggugaaaggauuuuaucccagugauaucgcuguagaaugggagagcaacggucaaccugaaaauaacuacaagacaacuccaccggucuuggacuccgacggcucuuucuuucucuacucgaaacugaccguggauaagagccgauggcagcaggggaauguuuucuccugcucagugaugcacgaggccuuacauaaccacuauacacaaaagagucugucucucagccccggaaaa

SEQ ID NO: 23970 - RNA, 642 nt, Artificial Sequence
  derived and/or modified sequence opt3 from Porgaviximab_LightChain
gacauccagaugacccaaagccccgccucccugucugugucagucggcgagacaguuaguauuacuugcagagcuagcgaaaacauauacuccucucucgcaugguaucagcagaaacaggggaaaucgccucaacuucugguguacucagccacgaucuuggcggauggaguaccaagcagguucagugguuccggcucugggacccaguauagcuuaaagauuaauucccugcagucagaggacuuuggaacauacuauugucagcacuucuggggcacuccguacaccuuuggugggggaacaaaacuagaaaucaagcggaccguggcugcccccagugucuucauuuuuccuccaagcgaugagcaacucaaaucuggcacugcauccgugguuugccugcuuaacaauuucuauccccgcgaagccaaggugcaguggaaggucgacaacgcucugcagucaggcaauagccaggagagugugacagagcaagauucuaaagacuccaccuacagcuugucgucuacgcucacucuguccaaggcagauuacgaaaaacauaagguauaugccugugagguuacccaccaggggcugucaaguccugugacaaagagcuuuaaccgaggagaaugc

SEQ ID NO: 23971 - RNA, 1341 nt, Artificial Sequence
  derived and/or modified sequence opt3 from Prezalumab_HeavyChain
gaggugcagcuggucgaaagcggcgggggacucguucagcccgguggcucccuuagacugucuugcgccgcuucaggguucaccuuuaguagcuacuggauguccugggugaggcaggcaccuggaaagggcuuggaguggguagccuauaucaaacaggacgguaacgaaaaguacuauguggauucugucaaagggcgguucacaauuucgcgcgacaaugcgaagaacucauuauaccugcagaugaauagccuacgagcugaggauacugccguguauuacugugcacgugaaggaauacucugguuuggcgaccugccaacguucuggggccaagggacccuuguuacagugaguuccgccucuacuaaaggaccgagcgucuuuccccuggcuccuugcuccagaucaaccagugagagcacagcagccuuggguugucucgugaaggauuauuucccagagcccguaaccguuucuuggaacuccggcgcucugacuucaggggugcacacauuuccugccguccugcagagcaguggacucuacucuuuauccagcguggugaccgucccaucgucuaauuucggcacgcagacuuauaccugcaacguugaccauaagcccuccaauacaaaaguggauaagacuguagaaaggaaauguugcguggaguguccuccaugcccggcgcccccugucgcagguccaucaguguuucuguuucccccuaagccaaaagacacccuuaugaucagucggacacccgaaguuaccuguguggucguggauguaagccacgaggacccggagguucaguucaacugguacguggauggggucgaagugcauaaugccaagacgaagccucgcgaggaacaauucaacuccacuuuuagagucgugucuguuuugacagugguacaccaggacuggcugaauggaaaagaguacaagugcaaagucagcaacaagggccuacccgcuccaauugagaaaaccaucucaaagacuaaaggccagccuagggaaccccagguguauacacucccacccagucgggaggaaaugaccaagaaucaaguuucccugacgugucuugugaagggguucuacccuagcgauauugccgucgagugggaaucuaacggacagccagagaauaacuauaaaaccacaccgcccaugcuggacucagacgguaguuucuuuuuguacagcaagcucacuguggauaaaucccgcuggcagcaaggcaacguauucucuugcucggugaugcaugaagcacugcacaaucacuauacccaaaagagcuuaucccugucaccugggaaa

SEQ ID NO: 23972 - RNA, 642 nt, Artificial Sequence
  derived and/or modified sequence opt3 from Prezalumab_LightChain
gacauccagaugacccaaagccccuccucucugucagccagugugggcgauagagucacaauuacuugcagggcuagccaggggauauccaacuggcucgcaugguaccagcagaagccugagaaagccccaaagucucuuaucuaugcggcuucgucacugcaaagcggaguuccgagucgguucuccgguucuggcagcgggacggacuuuaccuugacaauuuccucauuacagcccgaagauuucgccacuuacuauugucagcaguacgacaguuauccucgcaccuuuggacaaggcacaaaaguggagaucaagcgaaccguagcagccccaagcguguucauuuuucccccuucugaugaacagcugaaauccgguacugcuucagucgugugccuacucaauaacuucuacccacgugaggcaaagguucaguggaagguggacaaugcccugcagagcgggaacagucaagaaucugucacagagcaggauuccaaagacagcaccuauucgcuuucuuccacgcugacuuugucaaaggcugauuacgagaaacacaagguguacgccugugaaguaacccaucagggacucaguagccccguuacaaaauccuuuaauagaggcgagugc

SEQ ID NO: 23973 - RNA, 342 nt, Artificial Sequence
  derived and/or modified sequence opt3 from Radretumab_HeavyChain
gaggugcagcugcucgaaagcggcgggggacuuguccaacccgguggcucccugagauugucuugcgccgcuucaggguucaccuuuaguagcuucuccaugucuuggguuaggcaggcaccuggaaagggcuuagagugggugucgucaaucagcgguaguuccgggacaacuuacuaugccgacucuguaaaaggacgguuuacgauuagccgcgauaacuccaagaauacccuguaccuacagaugaacucacuccgagcggaagacacagcuguguauuacugugccaaaccauucccguauuuugauuacuggggccagggcacucuggucaccgug

SEQ ID NO: 23974 - RNA, 1071 nt, Artificial Sequence; identical to SEQ ID NO: 23643
  derived and/or modified sequence opt3 from Radretumab_HeavyChain_LightChain

SEQ ID NO: 23975 - RNA, 693 nt, Artificial Sequence
  derived and/or modified sequence opt3 from Radretumab_LightChain
gccagcgagaucgugcugacccagucccccggcacacucucucuuucaccuggggaaagagcuacucugaguugcagggcaagccaauccgucucuucgucauucuuggccugguaccagcagaagccaggacaggcgccgcgguuacugauuuauuacgcuagcagucgcgccacggguauacccgaccgauuuuccggcucugggagcggaaccgauuucacacuaacuaucucccgucucgagccugaagacuuugcaguuuauuacugucaacagaccggccggauuccacccacauucggucaggggaccaaaguggagaucaagucaggaggcaguggcgggccuagggccgcuccagaaguauaugcauuugccacucccgaguggccuggaagccgggauaaacgcacacuggcuugccuuauucagaacuucaugccagaggacaucucugugcaauggcugcacaaugaaguccaguugccggaugccagacauuccaccacgcagcccaggaagacuaaagguucaggcuuuuucguguuuagccggcucgagguuacccgcgcggaaugggagcagaaggacgaguucauaugucgagcagugcacgaagccgcuaguccuucucaaacaguccagagagccguguccguaaacccagagagcucgaggagagggggaugc

SEQ ID NO: 23976 - RNA, 1359 nt, Artificial Sequence
  derived and/or modified sequence opt3 from Ranevetmab_HeavyChain1
gaggugcagcuggucgaaagcggcgggggacucguucaacccgguggcucccuuagacugucuugcguggccucaggguucaguuugaccaacaauaacguaaauugggugaggcaggcuccuggaaagggcuuagagugggucgguggggugugggcaggaggcgccacagacuacaacagcgcgcugaaaucccgguuuacuaucucucgcgauaaugcuaagaacacgguuuuccuacagaugcacucgcuccgaucagaagacaccgccguguauuacugugcacgugauggcggguauagcaguuccacacuguacgccauggacgcuuggggacaggguacuucugucaccgugagcuccgcaucaacaaccgccccaaguguauuuccgcuugcucccagcugcggcucuacuuccgggucaacaguugcccuggcguguuuggugagcggauauuucccugagccagucaccgugaguuggaacucuggcucccucacgagcggugugcauacuuuucccucgguccugcaaucuuccgggcugcacucacucaguagcaugguuaccgugccuuccucuagauggccaagcgaaacauucacuugcaauguagugcaucccgcaucaaauaccaaagucgauaagccuguguuuaacgaguguaggugcacagacaccccaccgugucccguuccugagccauuaggaggccccagugugcugauuuucccuccaaaacccaaggauauacuucggaucacgcgcacuccggaagucacaugcgugguauuggaccugggcagagaggauccugaaguucagauuuccugguuuguggacgggaaggaggucaucaccgccaaaacucagagcagggagcagcaauucaauggaacauaccagguggucucugugcuacccauugaacaccaggauuggcucaccgguaaggaguuuaaaugucggguuaaccauaucgaccugccaucaccuauagaacgcacgaucaguaaggcucgaggcagagcccacaaacccagcguguauguacuuccacccuccccuaaggagcugucuucgagcgauaccgucuccauuacaugcuugaucaaggacuucuacccaccggacauugauguggaauggcagucaguugggcaacaggagcccgagaggaaacaccggaugacuccuccacagcucgacgaagauggaaguuacuuucuguauucuaaguuaagcguggacaaaucccguuggcaacagggcgaucccuucaccugugcagucaugcaugagacacugcagaaucacuacacugaccucucacuuagccauucuccugguaag

SEQ ID NO: 23977 - RNA, 1359 nt, Artificial Sequence
  derived and/or modified sequence opt3 from Ranevetmab_HeavyChain2
gaggugcagcuggucgaaagcggcgggggacucguucaacccgguggcucccuuagacugucuugcguggccucaggguucaguuugaccaacaauaacguaaauugggugaggcaggcuccuggaaagggcuuagagugggucgguggggugugggcaggaggcgccacagacuacaacagcgcgcugaaaucccgguuuacuaucucucgcgauaaugcuaagaacacgguuuuccuacagaugcacucgcuccgaucagaagacaccgccguguauuacugugcacgugauggcggguauagcaguuccacacuguacgccauggacgcuuggggacaggguacuucugucaccgugagcuccgcaucaacaaccgccccaaguguauuuccgcuugcucccagcugcggcucuacuuccgggucaacaguugcccuggcguguuuggugagcggauauuucccugagccagucaccgugaguuggaacucuggcucccucacgagcggugugcauacuuuucccucgguccugcaaucuuccgggcugcacucacucaguagcaugguuaccgugccuuccucuagauggccaagcgaaacauucacuugcaauguagugcaucccgcaucaaauaccaaagucgauaagccuguguuuaacgaguguaggugcacagacaccccaccgugucccguuccugagccauuaggaggccccagugugcugauuuucccuccaaaacccaaggauauacuucggaucacgcgcacuccggaagucacaugcgugguauuggaccugggcagagaggauccugaaguucagauuuccugguuuguggacgggaaggagguccuaaccgccaaaacucagagcagggagcagcaauucaauggaacauaccagguggucucugugcuccccaucgaacaccaggauuggcugaccgguaaggaguuuaaaugucggguuaaccauauugaccuuccaucaccuaucgaacgcacgauaaguaaggcucgaggcagagcccacaaacccagcguguauguacugccacccuccccuaaggaguugucuucgagcgauaccgucuccaucacaugccucauuaaggacuucuacccaccggacaucgauguggaauggcagucaguugggcaacaggagcccgagaggaaacaccggaugacuccuccacagcuggacgaagauggaaguuacuuuuuauauucuaagcugagcguggacaaaucccguuggcaacagggcgaucccuucaccugugcagucaugcaugagacacuccagaaucacuacacugaccuuucacugagccauucuccugguaag

SEQ ID NO: 23978 - RNA, 651 nt, Artificial Sequence
  derived and/or modified sequence opt3 from Ranevetmab_LightChain
gacaucgugaugacccagagccccgccucccugucucucucacaaggcgagacagucacuauuacgugcagagcuagugaagauauauacaacgcacuugccugguaucagcagaagccugggcaggcgccaaaacuguugaucuacaauaccgacacauuacacacuggaguuccgagcagguucuccgguucuggcucggggaccgauuuuucacugacaauuagcagucuagagcccgaagacguggcuguauauuacugucaacauuauuuccacuacccucggaccuuuggacagggcacuaagguggagcucaaacgcaacgaugcccagccagcagucuaucuguuccagcccuccccugaccaacuucauacagguucugccagcgugguuugccugcucaauuccuuuuacccaaaggauaucaacgugaaauggaaggucgacggggugauucaggauaccggaauccaggaaucaguaacggagcaggacaaggauaguacuuacagcuugucuuccacccugacaaugucaagcacugaguaucugagucacgaacucuacucuugugagauaacccauaaauccuuacccagcacacugaucaagucguuccaacgaucugaaugccagcguguugac

SEQ ID NO: 23979 - RNA, 1761 nt, Artificial Sequence
  derived and/or modified sequence opt3 from Remtolumab_HeavyChain
gaggugcagcuggucgaaagcggcgggggacucguucaacccgguagaucccuuaggcugucuugcgccgcuucaggcuucaccuuugacgauuacgcaaugcacugggugcggcaggccccugggaagggauuggaguggguaagugcgaucacauggaacagcggccauauugacuaugcugauuccguggaaggucgcuucacuauaucucgagacaaugccaaaaacucguuauaccugcagaugaacucacuacgugcagaggauacggccgucuauuacugugcuaaggugagcuaucucaguaccgcauccucucuggacuacugggggcagggaacacuuguuacugugagcuccggcggcgggggaucagguggcgggggaagugaaguccaacuggugcagagcggcgccgagguuaaaaagccagguucuuccguaaaagugucaugcaaggcuagcgggggaaguuuuggcggcuaugggaucggaugggucagacaggccccgggucagggcuuggaguggaugggagggauuacccccuucuuuggcuucgcggauuacgcacaaaaguuucaggguagggugacaaucaccgccgacgaaucuacuacaaccgcuuacauggagcucuccgggcugacgagcgaugacacugccguguauuacugugcacgggauccuaaugaguucuggaauggcuauuacucgacccacgacuuugauucuuggggacagggcacaacugucaccguuuccucagcuaguacaaaagggccaagcguguucccccuggccccuuccucuaagagcaccucaggagguacggcggcccucggcugcuuaguaaaagacuauuuuccagaacccgugacugucaguuggaacuccggggcacugacaagcggagugcauaccuucccugcuguucuucagucuucaggcuuguacagucugagcuccguggucacugugccaucuucgagccuagguacacaaaccuauauuuguaauguaaaccacaagccguccaauacgaaaguugacaagaagguggagcccaaaucaugcgauaagacccauacauguccuccaugccccgccccugaacuccuugggggcccaagugucuuucuguuucccccgaaaccuaaggacacucugaugaucucucgcacccccgaggugacaugugucgugguugaugugagccacgaagacccagagguaaaauucaacugguacgucgauggaguggaaguucacaaugcuaagacuaaaccuagagaggagcaguacaacuccaccuauaggguggucucaguguugacaguacuccaucaggacuggcugaauggcaaggaauacaagugcaaagugagcaacaaggccuuacccgcaccaauagagaaaaccaucucuaaggccaaagggcaaccccgggaaccucagguuuauacucugccaccgucccgcgaugagcucacgaagaaucaggucagucuuacaugucuggugaagggauucuaccccagcgacauugcuguggaaugggagucuaacggucagccugagaacaauuauaaaaccacuccacccgucuuggauuccgacggcucauucuuucuauacaguaagcugaccguugauaaaagccgauggcaacaggggaacguguucucgugcuccgugaugcacgaagcgcuccauaaucacuauacacagaagucucugagccuuucaccuggaaaa

SEQ ID NO: 23980 - RNA, 993 nt, Artificial Sequence
  derived and/or modified sequence opt3 from Remtolumab_LightChain
gacauccagaugacccaaagccccuccucucugucagccagugugggcgauagagucacaauuacuugcagggcuagccaggggauacggaacuaccucgcaugguaucagcagaagccuggaaaagccccaaaacuucugaucuacgcggcuuccacguugcaaucugguguuccgucgcgcuucucaggcagcgggaguggaaccgacuuuacauuaacuauuuccucucugcagcccgaggauguggccaccuauuacugucagcgauauaaucgugcaccuuacacauucggccaggguaccaaaguagaaaucaagagagggggaagcggcggcgggggauccggugagauugugcuaacucaaucaccagacuuucagagugucacacccaaagaaaaggugaccaucacgugcagggccagccaggauauaggcucugagcuccacugguaucagcaaaagccugaccagccacccaaacugcuuaucaaguacgcuucccauucaacuagcgggguuccuagucgguucucuggauccggcagcgguaccgauuuuacacugacuauuaacggguuggaagcagaggacgccggaaccuacuauugucaccagacagauucgcucccauacaccuucggcccgggcacgaaaguggacaucaagcgcacugucgcugcccccucuguguuuauuuucccuccauccgaugagcaacugaaaucagggacagcgaguguaguuugccugcucaauaacuuuuaucccagagaagcaaaggugcaguggaaggucgacaaugccuuacagagcggaaacucccaggagucugugaccgaacaagauagcaaagacucaacuuacagucuguccagcacacuuaccuugucuaaggcugacuaugagaaacauaagguguacgccugugaggucacgcaccagggucugucaaguccuguuaccaagagcuucaauaggggcgaaugc

SEQ ID NO: 23981 - RNA, 1341 nt, Artificial Sequence
  derived and/or modified sequence opt3 from Rosmantuzumab_HeavyChain
caggugcaacugguccagagcggcgccgagguuaagaaacccggggcuuccgugaagguaucuugcaaagcaucaggauacaccuucacagacuauaguauccacugggugagacaggccccuggucagggccucgaauggauuggguacauauauccaagcaacggagauuccggcuacaaucaaaaguuuaaaaacagggucacuaugacgcgggacaccucuacaucgacugcguauauggagcuuucacgccugcgaagcgaagauaccgcuguguacuauugugccacauacuucgcaaauaacuuugacuacuggggucaggggaccacuuugacaguuaguuccgccucuaccaagggaccgagcguguuccccuuagcuccuuccucaaagaguacgagcggcggcacugcagcccuggggugccuagucaaagauuauuuuccagagcccgugaccguaucuuggaacuccggagcucucacaucagguguucauacuuucccugccgugcugcagagcaguggccuuuacucucuguccagcgucgugaccgugccaucgucuuccuuggggacacagaccuauaucuguaaugucaaucacaagcccucaaacacgaaaguugacaagcguguggaaccuaaaaguugcgauaagacucauacauguccaccgugccccgcgccugagcuccugggaggcccaagcguauuucuguuucccccuaagccaaaagacacccucaugauuuccagaacucccgaggugacaugugucgugguugaugugucucacgaagacccggaggucaaguucaauugguacguggaugguguagaaguucauaacgcaaaaaccaagccuagggaggagcaauauaauagcacguaccggguggucucaguguuaaccguccugcaccaggacuggcuuaacgggaaagaauauaagugcaaagugaguaauaaggccuugcccgcuccaaucgagaagacaauuuccaaagccaagggacagccucgcgaaccccagguuuacacucugccacccagcagagaggaaaugaccaaaaaccaagugucucuaacaugucucguaaagggcuucuacccuucagauaucgcagucgagugggagaguaauggccagccagaaaacaacuauaaaacuaccccgcccgugcuggacagcgacggguccuuuuuccuuuacucuaagcugacaguugauaagucgagguggcagcaaggaaauguguuuagcugcuccgucaugcacgaggcuuugcauaaccacuauacccagaaaucacucagucugucuccugguaag

SEQ ID NO: 23982 - RNA, 654 nt, Artificial Sequence
  derived and/or modified sequence opt3 from Rosmantuzumab_LightChain
gacauccagaugacccaaagccccuccucucugucagccagugugggcgauagagucacaauuacuugcaaggcuagccaguccguugacuacgauggggacucuuauaugaacugguaccagcagaaaccuggaaaggcaccaaaacuccuuauauaugccgcgucgaaucuggagucaggugugccgagcagguucaguggcuccgggucuggaacggauuuuaccuugacaaucagccccguacaagcugaagacuucgccacuuacuauugucagcaguccaacgaggauccuuuaaccuuuggcgcagguacaaagcuggaacuaaaacggaccguggccgcuccaucagucuucauuuuucccccuagugacgagcagcucaagagcgggacugcaucugugguuugccugcuuaauaacuucuacccacgcgaagccaaggugcaauggaaagucgauaaugcucugcaguccggaaacucacaggagagcgugacagagcaggacaguaaggauucuaccuauuccuugagcucgacgcucacucugucuaaagccgacuacgaaaagcacaaaguauacgcgugugagguuacccaucaaggccuguccucacccgugacaaagaguuuuaaucgaggcgaaugc

SEQ ID NO: 23983 - RNA, 1332 nt, Artificial Sequence
  derived and/or modified sequence opt3 from Rozanolixizumab_HeavyChain
gaggugccccuggucgaaagcggcgggggacucguucagccugguggcucccuuagacugucuugcgccgugucaggguucaccuuuaguaacuacggaaugguaugggugaggcaagcuccaggcaaggguuuggagugggucgcauauaucgacagcgauggggacaauacauacuaucgggauuccgugaaaggacgcuucacuauuucucgagacaacgccaagucgucauuauaccugcagaugaauagccuacgugcggaagauacggcuguuuauuacuguaccacaggcauagugagaccguuucucuauuggggccaggggacucuggucaccgugaguuccgccucuacaaaaggacccagcguauucccucuugcaccaugcuccaggucaaccagugagagcacugccgcucuggguuguuugguuaaggacuacuuucccgaaccugugacagucucuuggaacuccggcgcacucaccucaggggugcacacguucccagccgugcugcagagcaguggacuguacucucucuccagcgucguuacugugcccucgucuuccuuaggcaccaaaacauauacuugcaauguagaucauaagccuucaaacaccaagguggacaaacgggucgagaguaaguacgguccaccgugucccccuugcccagcucccgaguuucuugggggaccuagcguguuccuguuuccacccaaaccgaaggauacauugaugaucucccgcaccccugaaguuacguguguggucguggacguaucucaagaggaucccgaaguucaguucaauugguauguggacggcgucgaggugcacaacgccaaaacuaagccaagagaggaacaguuuaauagcacauacagggucgugucaguucugaccgugcuacaucaggauuggcucaacggcaaggaguauaaaugcaagguaaguaauaaagggcugccuuccagcauugaaaagacuaucucuaaagcgaagggacaaccccgggagccacaggucuacacacuucccccuucacaggaagagaugaccaaaaaccaggugagucugacguguuugguuaaggguuucuauccaagcgacauugcaguggagugggaauccaauggccaaccggagaacaauuacaagaccacacccccuguccucgacucugaugggucguuuuuccuguacagccgcuuaacuguggacaaaucccgauggcaggaaggaaacguauucucaugcagugugaugcacgaggcccugcauaaccacuauacccagaagucucucagccuuucccugggcaaa

SEQ ID NO: 23984 - RNA, 657 nt, Artificial Sequence
  derived and/or modified sequence opt3 from Rozanolixizumab_LightChain
gacauccagaugacccaaagccccuccucucugucagccagugugggcgauagagucacaauuacuugcaagagcucccagucucucguuggggcuucgggaaaaacguaccuuuauuggcuguuccagaagccugguaaagcaccaaagagguugauauacuuagugucaacccuggacagcggcaucccgagucgguuuuccgggucuggaagcggcacagaguucacucuaaccauuuccucacuccagcccgaagauuuugccacauauuacugucugcaagguacccacuucccucauacuuuugggcagggaacaaaacuugagaucaagcgcaccguagcggcuccaaguguguucauuuuucccccuagcgacgaacagcugaagucuggcacggccuccgucgugugcuugcucaacaauuucuauccacgagaggcaaaaguucaguggaagguggauaacgcccugcaaucaggcaauagccaggaaagugucacugagcaggacucuaaagauuccaccuacagccugucgucuacacucacuuuauccaaggcugacuaugagaaacacaagguguacgcaugugaaguaacccaucaggggcugucaagucccguuacaaagagcuuuaaccguggagagugc

SEQ ID NO: 23985 - RNA, 1329 nt, Artificial Sequence
  derived and/or modified sequence opt3 from Sapelizumab_HeavyChain
caggugcaacugcaggagagcggccccgggcucgucaagccuuccgaaacccuuucucugacaugcgccguuucaggacacaguaucagccaugaccacgcuugguccugggugagacagccaccgggugagggcuuggaauggauuggguucauaucuuacucgggaaucacuaacuauaaucccucauuacagggcaggguaacgauuagccgggauaacaguaaaaauacccuguaccuacaaaugaacucccuccgcgcagaggacacagccguguauuacugugcgcgaucucuggcucguacuaccgccauggauuauuggggugaagggacacuugucaccgugagcuccgcaucaacuaagggaccuaguguuuuuccacuggcccccagcucuaaauccacaucaggcggcaccgcugcauuggggugccucgugaaggacuacuucccugagccagucacggugagcuggaauaguggagcccugacuucugguguacauaccuuucccgcuguucugcaguccagcggccucuauucguuaucuuccguggucacagugccuucaaguaacuucgggacucagaccuacacauguaauguggaucacaaaccaagcaacaccaaggucgacaagacgguugagagaaaauccugcguggaauguccgcccugcccugccccacccguagcgggaccuucuguguuucuguucccacccaagccgaaagauacucuuaugaucagcaggacaccugaggucaccugugugguuguggacgucucacaggaagaucccgaggugcaauuuaauugguacguagacggcguugaggugcauaacgcaaagacuaaaccacgggaggaacaguucaauaguacauuucgcgucguguccgucuugaccgugguucaccaggauuggcugaacgguaaggaauauaagugcaaagugagcaauaaggggcuaccugcccccauugagaaaacgaucucuaagaccaaaggacagccaagagaaccccaaguauacacacucccuccaucacaggaggagaugacuaagaaccaggucagucugaccugucuugugaaaggcuucuauccgagcgacauagcuguugaaugggaguccaauggccaacccgaaaacaacuacaagacaacuccuccaaugcuggauucugacgggucguuuuucuuguauagcaagcucaccguggacaaauccagguggcaggagggaaaugucuuuucaugcagugugaugcacgaagcccugcaugcacacuacacacagaagucuuuaagccuguccccc

SEQ ID NO: 23986 - RNA, 642 nt, Artificial Sequence
  derived and/or modified sequence opt3 from Sapelizumab_LightChain
gacauccagaugacccaaagccccuccucucugucagccagugugggcgauagcgucacaauuacuugccaggcuuccacggacauaucuucgcaccucaacugguaccagcagaaaccugggaaagcaccagagcuucugaucuauuacggaucacauuuguuaagcgguguuccgaguagauucuccggcucugggagcggaaccgauuuuacauucacuauuuccucacuggaagccgaggacgcggcuaccuauuacuguggccaagguaauaggcuacccuauacauuugggcagggaaccaagguggaaaucgagcggacuguagccgcaccuaguguguucauuuuuccacccagcgaugaacagcucaaaucuggcacagccuccgucgugugccugcuuaacaauuucuacccucgcgaggcuaagguucaguggaaaguggacaacgcacugcaaucaggcaauagccaggagagugucaccgaacaggauucuaaggacuccacguauagcuugucgucuacucucacccuguccaaggccgauuacgagaaacacaagguguacgcuugugaaguaacacaucaggggcugucaaguccaguuacuaagagcuuuaaccgaggagagugc

SEQ ID NO: 23987 - RNA, 1356 nt, Artificial Sequence
  derived and/or modified sequence opt3 from Selicrelumab_HeavyChain
caggugcaacugguccagagcggcgccgagguuaagaaacccggggcuuccgugaagguaucuugcaaagcaucaggauacaccuucacagguuauuacaugcacugggugagacaggccccuggccaggggcucgaauggaugggauggaucaacccagacaguggcgguacuaauuaugcgcaaaaguuucaggggagggucacgaugacccgggauacaagcauuuccacugcuuacauggagcuuaaccgccugcgaucugacgauaccgccguguauuacugugcacgugaccagccguugggauauugcacaaauggcguuuguucguacuucgauuacuggggccaggggaccuuagugacugucucaagcgccaguacaaaaggacccuccguguuuccucuggcuccaugcucuagaagcaccuccgaaucaacggcagcccuagguugucucguaaaggacuauuuccccgagccuguuacugugaguuggaacagcggcgcucugaccucugggguccauacauuuccagccgugcuucaauccucaggacuguacagcuugaguucuguggucacuguucccuccagcaauuucggcacccagacauauaccugcaacguggaucacaagccuucgaauacgaaaguagacaagacuguggaaaggaaauguugcgucgaguguccaccgugccccgcgccuccaguggcaggucccucuguuuuucucuucccuccaaagcccaaagauacacugaugauaucccggaccccggaggugacuugugucgugguagacguuucacaugaagauccugaggugcaguuuaacugguacgucgacgggguggaaguccacaaugccaagacaaagccccgcgaggagcaguucaacaguaccuuuagagugguuagcgugcugacgguaguccaucaagauuggcucaauggaaaagaauauaagugcaaaguguccaacaagggcuuaccagcuccuaucgagaaaaccauuucuaagacaaaaggccagcccagggaaccacagguuuacacucugcccccuagccgggaggaaaugaccaagaaucaagugucacuuacaugcuuggucaagggguucuauccaagugacaucgccguggagugggaguccaacggacagccggaaaauaacuacaaaacuacacccccuaugcuggacagcgaugguucauuuuuccuauacucuaagcucaccguagacaaaagucgcuggcagcagggcaacguguucagcuguuccguuaugcacgaggcacugcacaaucauuauacccaaaagucucuuucgcugagcccagggaaa

SEQ ID NO: 23988 - RNA, 642 nt, Artificial Sequence
  derived and/or modified sequence opt3 from Selicrelumab_LightChain
gacauccagaugacccaaagccccuccucugugucagccagugucggcgauagaguuacaauuacuugcagggcuagccaggggauauacuccuggcuggcaugguaucagcagaagccuggaaaagccccaaaccuccuuaucuacacggcgucuacccugcaaucgggugugccgucacgguucagcggcaguggguccggaacagacuuuacuuugaccauuucuagcuuacagcccgaggauuucgcuacauauuacugucagcaggccaauaucuuuccucugaccuucggcggugggacuaagguagaaauuaaacgcacaguggcagccccauccgucuuuaucuuucccccuucagacgagcaacuaaagaguggaaccgcuagcgugguuugccuccugaacaauuucuauccacgagaagcaaaagugcaguggaaggucgauaacgcccuucagucuggcaauucccaggagucagugacggaacaagacagcaaggauaguacuuacucucuguccagcaccuugacacucucgaaagcugacuaugagaagcacaaaguauacgccugugagguuacucaucagggccugucuucccccgugaccaagucauucaaccguggggaaugc

SEQ ID NO: 23989 - RNA, 354 nt, Artificial Sequence
  derived and/or modified sequence opt3 from Solitomab_HeavyChain1
gaggugcagcugcucgaacaaagcggcgccgagcuugucagacccgggaccuccguuaagaucucuugcaaggcuucaggauacgcauucacaaacuauuggcuggguugggugaaacagaggccuggccacggguuggaauggauuggagacauauuuccaggcagugguaauauccauuacaacgagaaauucaaggggaaagccacuuuaacggcggauaagagcuccucuaccgcuuauaugcagcugucgucacuaacauuugaagacagcgccguauacuucugugcacggcuccgcaauugggaugagccgauggacuauuggggacagggcacuaccgugacaguc

SEQ ID NO: 23990 - RNA, 375 nt, Artificial Sequence
  derived and/or modified sequence opt3 from Solitomab_HeavyChain2
gacgugcagcugguccaaagcggcgccgagguuaagaaacccggggcuuccgugaagguaucuugcaaagcaucaggauacaccuucacaagauauacuaugcacugggugaggcaggccccuggucagggccucgaauggaucggguacauuaacccaagucggggauauacgaauuacgcggauagcgucaagggccgcuuuaccauaacaacugacaaauccaccucuacagcuuauauggagcuuucgucacugcgaagcgaagauaccgccacuuacuauugugcacguuacuacgacgaucauuauugcuuggacuacuggggucaggggacaaccgugacgguuaguuccggagagggcacuucuacc

SEQ ID NO: 23991 - RNA, 1488 nt, Artificial Sequence
  derived and/or modified sequence opt3 from Solitomab_LightChain_HeavyChain_HeavyChain_LightChain
gagcuggugaugacccagagccccuccucucucacagucacugccggcgaaaagguuacgaugucaugcaaaaguagccaaucccuucugaacucugggaaucagaagaacuacuugaccugguaucagcagaaaccuggacaaccaccgaaguuacugaucuacugggcuucgacaagagagucaggugugcccgacagguucacuggcagcgggaguggaaccgauuuuacacuaaccauuuccucuguacaggcagaagaccucgccguguauuacugucagaaugauuauagcuacccucugacuuucggcgcggguacaaaacuugagauaaaagggggaggcggcuccgggggagguggcucagggggaggcgguagugaaguccagcuguuggagcaaagcggggcugagcucgugcggccaggaaccucuguuaagaucuccugcaaggccucaggcuaugcauuuacgaacuacuggcugggcugggugaagcagcgccccgggcacggacuggaauggauuggugacaucuucccuggcagcgggaauauucauuacaacgagaaauuuaagggaaaagccacucucaccgcugauaagaguucuuccacagcauauaugcaguuaagcucgcugacuuucgaagacucugccgucuacuuuugugcucgacuucguaauugggaugagccaauggacuauuggggccaggguaccacagugaccguauccucagggggcggaggcagugauguucaauuggugcagagcggggccgaggucaagaaacccggagcguccgugaaggugucuugcaaagcaagcgguuacacguucacuagauauacaaugcacugggucaggcaggccccuggccaagggcuggaauggaucggauacauaaacccaucacggggcuauaccaauuacgcugacaguguuaagggucgcuuuacuaucacaaccgauaaauccacgagcaccgccuacauggagcuaucuucacucagaagugaagacacagcaacuuauuacugugcuagguauuacgaugaccauuauugccuggacuacugggggcagggcaccacagugacuguaagcuccggagagggcaccucuacagggucgggagguagcggcggguccggaggcgccgaugacauugugcuuacccagucaccggcgacucugaguuugucucccggugaacgggccacgcucagcugucgcgcaucccagucagucagcuauaugaacugguaccaacagaagccugggaaagcuccaaagcgauggaucuacgauacaucuaagguggccuccggcguucccgcuagauucaguggaagcggcucugggaccgacuauucccugacuauuaauucauuagaggccgaggaugcagccaccuacuauugccagcaguggaguagcaacccucugacauuuggaggcgguaccaaaguggaaaucaag

SEQ ID NO: 23992 - RNA, 339 nt, Artificial Sequence
  derived and/or modified sequence opt3 from Solitomab_LightChain1
gagcuggugaugacccagagccccuccucucucacagucacugccggcgaaaagguuacgaugucaugcaaaaguagccaaucccuucugaacucugggaaucagaagaacuacuugaccugguaucagcagaaaccuggacaaccaccgaaguuacugaucuacugggcuucgacaagagagucaggugugcccgacagguucacuggcagcgggaguggaaccgauuuuacacuaaccauuuccucuguacaggcagaagaccucgccguguauuacugucagaaugauuauagcuacccucugacuuucggcgcggguacaaaacuugagauaaag

SEQ ID NO: 23993 - RNA, 324 nt, Artificial Sequence
  derived and/or modified sequence opt3 from Solitomab_LightChain2
gccgacgauaucgugcugacccagagccccgcuacacucucccuuucuccuggcgagagagcaacucugucaugcagggccagucaaagcgucuccuacaugaacugguaucagcagaagccagggaaagcgccgaagcgguggauuuacgacacgucuaaaguugcuucgggagugcccgcccgcuucucagguagcggcagugggaccgauuauuccuugacaauaaauucuuuagaagcagaggacgccgcuacuuacuauugucagcaauggagcuccaacccucugaccuuuggaggcgguacaaagguagaaaucaaa

SEQ ID NO: 23994 - RNA, 1359 nt, Artificial Sequence
  derived and/or modified sequence opt3 from Suptavumab_HeavyChain2
gaggugcagcuggucgaaagcggcggggaccucguucaacccggaagaucccuuaggcugucuugcguggcuucagguuucaccuuugaugacuacgcuaugcacuggguacggcaggcaccuggcaagggguuggagugggugaguggagucagcugguccggcucuacaguggguuaugccgauucgguuaaagggcgcuucacugugucacgagacaacgcgcaaaagagcuuauaccugcagaugaauagucuacgugcugaagauacggcccucuauuacugugucaaagacgcauauaaguuuaacuacuauuacuacggacuggauguguggggccaaggcaccacaguaacuguuuccucugccagcaccaaagggccauccguguucccgcuugcucccucaaguaagagcacaucuggagguaccgcagcccugggcugcuuggucaaggacuauuuuccugagccagugacuguguccuggaacucaggggcucucacaagcggaguccauaccuuccccgccguucugcagaguucuggccuguacucccucagcucggugguaacggugccuucuuccucauuagguacucagaccuauaucuguaaugucaaucacaaaccaaguaacacaaagguggauaaaaagguugaacccaaaagcugcgacaagacucauaccuguccuccaugcccggcgcccgagcugcuugggggaccuuccguguuuuuguucccacccaagccuaaagauacacugaugauuucuagaaccccagaggucacgugugugguaguugacgugagccacgaagaucccgaggucaaguuuaauugguacguggacggcgucgaagugcauaacgcaaaaacuaagccgagggaggagcaguauaauucaacauaccggguugugaguguacuaaccguccuccaccaagacuggcugaacggcaaagaauauaagugcaaaguguccaauaaggcccuuccugcucccauagagaagacuaucagcaaagccaaggggcagccacgcgaaccucagguuuacacacugcccccaucuagagaugaguugaccaaaaaccaggugucacucacgugucuggucaagggauucuaccccagugacauugcaguggaaugggagagcaauggucaaccugagaacaauuauaaaaccacaccaccgguauuagauuccgacggcagcuuuuuccuguacucgaagcucacuguggauaagucuagguggcagcaggggaacgucuuuuccugcucaguuaugcacgaagcccuucauaaccacuauacccagaaaagucugucuuugagccccggaaag

SEQ ID NO: 23995 - RNA, 1356 nt, Artificial Sequence
  derived and/or modified sequence opt3 from Suvratoxumab_HeavyChain
gaagugcagcuggucgaaagcggcgggggacucguucaacccgguggcucccuuagacugucuugcgccgcuucaggguucaccuuuaguagccacgacaugcauugggugaggcaggcaacaggaaagggcuuggaguggguauccgguaucgggacugccggagauacguacuauccugacucugugaaaggccgguucaccauuucgcgcgaaaacgcgaaaaauucauuauaccugcagaugaacagccuacgagcuggcgauacagccgucuauuacugugcacgugacagauauaguccaacugggcacuacuauggaauggauguguggggucagggcaccacaguuaccguguccucugccagcacuaaggggccguccgucuuuccccucgcuccuucaaguaagagcacaucuggaggcaccgcagcccuggguugccuugugaaagacuacuucccagagcccguaacgguuuccuggaacucaggggcucugacuagcggagugcauaccuuuccugccgucuugcaaaguucuggccucuacucccugagcucgguggugacagucccaucuuccucacugggcacucagaccuauauauguaauguuaaucacaagcccaguaacacaaagguggauaaaaggguagaaccuaagagcugcgacaaaacccauacguguccaccgugccccgcgccugagcucuuagggggaccauccguguuccuguuucccccuaagccaaaagauacucuuuacaucacacgggagcccgaagucaccugugugguuguggacgucucucacgaggauccggaagugaaguucaauugguauguagacgguguugaggugcacaacgcaaagacuaaaccucgcgaggaacaguacaauagcacauauagagucgugucagucuugaccgugcugcaucaggauuggcuaaacggcaaggaguacaaaugcaagguuaguaauaaagcccuccccgcuccaauugaaaagacgaucuccaaagccaaggggcaaccuagggagccccagguguauacccugccacccagccgggaagagaugacaaagaaccagguaucucuuacuugucuggucaaaggauuuuacccuucagacauugcaguggagugggaaaguaauggccagccagagaacaauuacaagaccacaccgcccguuuuggacagcgaugguuccuucuuucucuauucuaaacugacuguggacaagucgcgcuggcaacaggggaacgucuucagcugcuccgugaugcacgaggcuuuacauaaccacuacacccagaaaucacugagucucucuccuggcaag

SEQ ID NO: 23996 - RNA, 639 nt, Artificial Sequence
  derived and/or modified sequence opt3 from Suvratoxumab_LightChain
gacauccagaugacccaaagccccuccacacugucugccucagugggcgauagagucacuauuacgugcagggcuagucagagcauauccucuuggcucgcaugguaccagcagaagccugggaaagccccaaaacuucugaucuauaaggcgucgucauuggagagcggaguuccgagucgguucuccgguucuggcagcgggaccgaauuuacauuaacuauuuccucacugcaacccgacgauuucgcuaccuacuauuguaagcaguacgccgacuauuggacauuuggacagggcaccaaaguggagaucaagcgcacuguagcagccccuaguguguucauuuuuccacccagcgaugaacagcuaaagucugguacagcuuccgucgugugccuccugaacaauuucuacccucgagaggcaaaaguucaauggaagguggacaacgcccuucagucagggaauagccaggaaagugucaccgagcaggauucuaaagacuccacguauagccugucgucuacuuugacccucuccaaggcugauuacgagaaacacaagguguacgccugugaaguaacacaucaaggacugucaaguccaguuacuaagagcuuuaaccguggcgagugc

SEQ ID NO: 23997 - RNA, 642 nt, Artificial Sequence
  derived and/or modified sequence opt3 from Tadocizumab_LightChain
gacauccagaugacccaaacacccagcacucuguccgccucugugggcgauagagucacgauuucaugcagggcuagucaggacauaaacaauuaccucaacugguaucagcagaagccugggaaagcaccaaaacuucugaucuacuauaccagcacauugcacuccggaguuccgucucgguucucggguucaggcagcgggacugauuacaccuuaacaauuaguucccugcaacccgacgauuuugccaccuauuucugucagcagggaaauacucuaccuuggacauuuggccaggguaccaagguggagguaaagcgcacgguggcggcuccaucugucuucaucuuucccccuagcgacgaacaacucaaauccgggacugccucagugguuugccugcuuaacaauuucuacccacgagaggcaaaggugcaguggaaggucgauaacgcccugcagaguggaaauagccaggaaucugugaccgagcaagacuccaaagauucaacauauagcuugaguucuacucucacccuguccaaggcugacuacgaaaaacauaagguauacgcaugugagguuacacaccagggccugagcucgcccgugaccaaaucuuuuaaccguggcgagugc

SEQ ID NO: 23998 - RNA, 1341 nt, Artificial Sequence
  derived and/or modified sequence opt3 from Tanezumab_HeavyChain
caggugcaacugcaggagagcggccccgggcucgucaagccuuccgaaacccuuucucugacaugcacuguuucaggauucaguuugaucgguuacgacuuaaacuggauuagacagccaccgggcaaagggcuggaguggauaggaaucauuuggggcgaugguacgaccgacuauaauagcgccgugaaguccaggguaacaaucucuaaagauacuucgaagaaccaguuuucacuaaaacucagcagugugaccgcugcagacacagccgucuacuauugugcgcgcgggggauacugguaugcuaccuccuacuauuucgauuacuggggccaaggcacucuggugacaguuucuagcgccuccaccaaggggcccucaguguuuccucuugcaccaugcagucggagcacgucugaauccacugccgcucugggauguuuggucaaggacuacuuccccgagccugugaccguaucauggaauagcggugcacucacaaguggcguucacacuuuuccagccgugcugcagucuuccgggcuguauagccucucgucugucgugaccgugcccuccucaaacuucggaacacagaccuacacgugcaaugucgaucauaaaccuaguaacacuaagguugacaaaacaguggaacgaaaguguugcguagaguguccaccgugccccgcuccuccaguggccggccccagcgucuuuuuauucccuccaaaacccaaggauacccugaugauuucccguacuccggaggugacauguguuguggucgacgugucucacgaagauccugagguacaguuuaauugguauguugacgguguggaaguccauaacgcgaagaccaaacccagagaggagcaauucaauagcacguuuaggguggucucagugcuuaccguugugcaccaggauugguugaacgggaaggaauacaaaugcaagguaaguaauaaaggacugccauccagcaucgagaagacaauaucuaaaacuaagggccagccucgggaaccccaggucuauacccuaccacccucacgcgaggaaaugacaaagaaccaagugagucucacuugucugguuaaaggcuucuacccuagcgacaucgcaguggagugggaguccaaugggcagccagaaaacaauuauaagaccacaccgcccaugcuugacucugauggaucguuuuuccuguacagcaaauugaccgucgacaaguccagauggcagcaagguaacguguucucaugcaguguaaugcaugaggcccuccacaaccacuacacucagaaaucucugagcuuauccccuggcaag

SEQ ID NO: 23999 - RNA, 642 nt, Artificial Sequence
  derived and/or modified sequence opt3 from Tanezumab_LightChain
gacauccagaugacccaaagccccuccucucugucagccagugugggcgauagagucacaauuacuugcagggcuagccaguccauaucuaacaaucucaacugguaccagcagaagccugggaaagcaccaaaacuucugaucuauuacacgucgcgguuccacucaggaguuccgagccgcuuuagugguuccggcucugggaccgacuucacauuuacuauuagcuccuugcaacccgaggauaucgccaccuauuacugucagcaggaacauacauuaccuuauaccuucggacagggcacuaagcuggagauuaagcgaacaguggcggcuccaucaguauuuaucuuucccccuagugacgaacaacuaaaaagcgguaccgccucuguggucugccuccugaauaacuucuacccacgugaggcaaaggugcaguggaagguugauaaugcccuucaguccgggaacucacaggaaagcgugacggagcaagacaguaaagauucuacuuauucccugagcucgaccuugacacucucuaaggcugacuacgagaaacacaaggucuacgcaugugaagugacucaucagggacuguccucacccguaaccaaaaguuucaauagaggcgagugc

SEQ ID NO: 24000 - RNA, 1353 nt, Artificial Sequence
  derived and/or modified sequence opt3 from Tavolixizumab_HeavyChain
caggugcaacugcaggagagcggccccgggcucgucaagccuucccagacccuuucucugacaugcgccguuuacggagguucauucaguagcggcuauuggaacuggaucagaaaacacccagggaagggauuggaauacauuggcuauauauccuacaaugguaucacuuaucauaacccgucuuuaaaaucgaggauuacgaucaaucgggacaccucaaagaaccaguacagccugcaacuaaauagugugacacccgaggauacugcuguauauuacugugcacgcuacaaauaugacuacgaugggggacacgccauggacuauuggggccagggcacccucgugacagucuccucugcgagcaccaaggggccuuccguguuuccacuggcucccucaaguaagagcacuucuggagguacagccgcacuuggcugccugguuaaagauuacuucccugaaccagugaccgucuccuggaacucaggggccuugacgagcggagugcauacuuuucccgcuguacuccagaguucuggccuguauucccugagcucgguugugaccgucccuucuuccucacucgguacacagacuuacauuuguaaugugaaccacaagccaaguaauaccaaaguggacaagcgagucgagccgaaaagcugcgauaagacacauaccugucccccuugcccagcacccgaauuacuugggggaccuuccguuuuccuguuuccacccaagccgaaagacacguugaugaucucucguacuccugaggugacauguguaguggucgaugugagccacgaggaccccgaaguuaaguucaacugguauguggauggcgucgaggugcacaaugccaaaaccaagccacaagaggaacaguacaacucaacuuacagaguaguuagugugcugacaguccuacaucaggacuggcucaauggcaaagaguauaagugcaaaguguccaacaaggcucugccugcccccauagaaaagaccaucagcaaagcgaaggggcagccaagggagccccaagucuacacgcuuccuccaucucgggaagagaugaccaaaaaucaggugucacugacauguuugguuaagggauuuuauccgagugauauugcaguggaaugggagagcaacggucagcccgagaacaauuacaaaacuaccccuccaguacucgacuccgacggcucuuucuuucuguauucgaaguuaacagucgauaagagccgcuggcaacaggggaacguguucuccugcucaguuaugcacgaagcccugcauaaucacuacacucagaaaagucucucucuuagccccggaaag

SEQ ID NO: 24001 - RNA, 642 nt, Artificial Sequence
  derived and/or modified sequence opt3 from Tavolixizumab_LightChain
gacauccagaugacccaaagccccuccucucugucagccagugugggcgauagagucacaauuacuugcagggcuagccaggacauauccaacuaccucaauugguaucagcagaagccugggaaagcaccaaaacuucugaucuacuauacgucuaaguugcacucgggaguuccgucacgguucagcgguaguggcuccgggaccgauuacacauuaacuauuucuagccugcaacccgaggacuuugccaccuauuacugucagcagggauccgcgcuaccuuggacauucggccaggguaccaagguggaaaucaaacgcacuguagcugccccaucaguguuuauuuuucccccuagugaugagcaacucaagagcgggacagcaucugucgugugccugcuuaacaauuucuauccacgagaagccaagguucaguggaaaguggacaacgcucugcaguccggaaauucacaggagagcgucaccgaacaagauaguaaggacucuacguacuccuugagcucgacucucacccugucuaaagcagauuacgagaagcauaaaguguaugccugugagguaacacaccagggccuguccucacccguuacuaagaguuucaaccguggcgaaugc

SEQ ID NO: 24002 - RNA, 1335 nt, Artificial Sequence
  derived and/or modified sequence opt3 from Telisotuzumab_HeavyChain
caggugcagcugguccagagcggcgccgagguuaagaaacccggggcuuccgugaagguaucuugcaaagcaucaggauacaucuucaccgccuauacaaugcacugggugagacaggcgccuggucagggccucgaauggaugggguggauuaagccaaacaauggacuugcuaacuacgcccaaaaauuucagggcagggucacuaugacgcgggacaccaguauaagcacagcauauauggagcugucccgcuugcgaucugaugacacugccguguacuauugugcucguucggaaaucaccacagaguucgauuacuggggucaggggaccuuaguuacugugucaagcgcaaguacaaagggaccguccgucuuuccccuggccccuucuagcaaguccaccucaggcggcacggcugcccuagggugccucgugaaagacuauuucccagaacccguaacuguuaguuggaauagcggagcgcugaccucuggugugcauacauuuccugcaguccuucaguccucaggccuguacagcuugaguucuguggugacugucccauccagcucgcucgggacccaaacauacauuuguaacguuaaucacaagcccucuaacaccaaaguggauaagagaguagagccuaaauccugcgacugucauugcccaccgugucccgccccugagcugcugggaggcccaucaguguuccucuuucccccuaagccaaaggauacguuaaugaucaguaggacucccgaagucacaugcgugguuguggacgucagccacgaggauccggaagugaaauucaauugguauguagacgguguugaggugcauaacgcuaagaccaaaccucgggaggaacaguacaauuccacuuaucgcgucgugucuguccugacagugcuucaccaggauugguugaacgggaaggaguacaaauguaagguuagcaauaaagcccugcccgcaccaauugaaaagaccaucucaaaggcuaaaggacagccuagagagccccaaguguauacgcuaccacccaguagggaagagaugaccaagaaccagguaucccucacaugccuggucaaaggcuuuuacccuagcgacauagccguggagugggaaucuaauggccagccagagaacaauuauaagacuaccccgcccguucuugauucagacgggaguuucuuucuguacagcaaauugacaguggacaagucccgguggcaacagggaaacgucuucucuuguucggugaugcacgaagcgcuccauaaccacuacacucaaaagagccuguccuuaucaccuggu

SEQ ID NO: 24003 - RNA, 654 nt, Artificial Sequence
  derived and/or modified sequence opt3 from Telisotuzumab_LightChain
gacaucgugaugacccagagccccgauucccuggccgucucucucggcgagagagcuacaauuaacugcaagucaagugaaagcguugacuccuacgcaaauucuuuccuucacugguaucaacagaaaccugggcagccaccgaagcuguugauauacagggccucgacucgggagucaggagugcccgaucgcuuuagcgguaguggcuccgggacggacuucaccuuaacaaucucuagccugcaggcggaagauguagcuguguauuacugucaacaguccaaagaggacccucuaacuuuuggaggcgguaccaaggucgaaauuaaacgaacaguggccgcaccaucaguuuucaucuuucccccuagugaugagcagcucaagagcgggaccgccucuguggucugccugcuuaacaauuucuauccacgugaggcuaaggugcaguggaaaguagacaacgcacugcaauccggaaauucacaggaaagcguuacugagcaggauaguaaggacucuacauacuccuugagcucgacccucacgcugucuaaagccgauuaugaaaagcauaaaguguacgcuugugaggucacucaccagggccuguccucacccgugaccaagaguuuuaacagaggcgagugc

SEQ ID NO: 24004 - RNA, 1335 nt, Artificial Sequence; identical to SEQ ID NO: 24002
  derived and/or modified sequence opt3 from Telisotuzumab_vedotin_HeavyChain

SEQ ID NO: 24005 - RNA, 654 nt, Artificial Sequence; identical to SEQ ID NO: 24003
  derived and/or modified sequence opt3 from Telisotuzumab_vedotin_LightChain

SEQ ID NO: 24006 - RNA, 1350 nt, Artificial Sequence
  derived and/or modified sequence opt3 from Timigutuzumab_HeavyChain
gaggugcagcuggucgaaagcggcgggggacucguucaacccgguggcucccuuagacugucuugcgccgcuucaggguucaacaucaaggacaccuacauucacugggugaggcaggcaccuggaaaaggcuuggaguggguagcccggauauauccaacaaaugguuacacucgcuaugcggauagugugaaggggcgauuuacgaucagcgcugacaccuccaaaaacacagccuacuuacagaugaauagccugcgugcagaagauacugccgucuauuacuguucgagauggggaggcgacggcuucuaugcuauggauuacugggggcagggaacccuagugacaguuucaagcgcaaguaccaaggguccguccguguuuccccucgccccuucuagcaaauccacuucaggcgggacagcugcccugggaugccuugucaaggacuacuucccagagcccgugaccguaaguuggaacagcggcgcgcugacgucugguguucauacuuuuccugcaguguugcaauccucagggcucuauagccugaguucugucgugaccgugccauccagcucgcugggaacacagacuuacauuuguaaugucaaccacaagcccucuaauaccaaaguugauaagaaaguggaaccuaaguccugcgacaaaacacauaccuguccaccgugccccgccccugagcucuuaggcggcccaucaguauuccuguuucccccuaagccaaaggauacgcuuaugaucaguaggacucccgaggugacaugugucgugguugacgugagccacgaagauccggaggucaaauucaacugguauguggacgggguagaaguucauaaugcuaagaccaaaccucgggaggagcaguacaacuccacuuaucgcguggucucuguguugacaguccugcaccaggauuggcuaaauggaaaggaauacaaaugcaaggugagcaacaaagcccuccccgcaccaauugagaagaccaucucaaaggcuaaaggucaaccuagagaaccccagguuuauacgcugccacccaguagggacgagcuuaccaagaaucaggugucccugacauguuugguaaaaggcuuuuacccuagcgacauagccgucgaaugggagucuaacgggcagccagagaauaacuacaagacuaccccgcccgugcucgauucagacggaaguuucuuucuguauagcaaauuaacaguugauaagucccgguggcaacagggcaacguguucucuugcucggucaugcacgaaggucugcauaaucacuacacucagaagucucucucccuuucaccugggaaa

SEQ ID NO: 24007 - RNA, 642 nt, Artificial Sequence; identical to SEQ ID NO: 23668
  derived and/or modified sequence opt3 from Timigutuzumab_LightChain

SEQ ID NO: 24008 - RNA, 1332 nt, Artificial Sequence; identical to SEQ ID NO: 23052
  derived and/or modified sequence opt3 from Timolumab_HeavyChain

SEQ ID NO: 24009 - RNA, 642 nt, Artificial Sequence; identical to SEQ ID NO: 23053
  derived and/or modified sequence opt3 from Timolumab_LightChain

SEQ ID NO: 24010 - RNA, 1347 nt, Artificial Sequence
  derived and/or modified sequence opt3 from Tomuzotuximab_HeavyChain
caggugcaacugaagcagagcggccccgggcucguccagccuucccagucucuuucaauuaccugcacaguuaguggauucagccugacuaacuacggugugcacuggguaagacaauccccaggcaaaggguuggagugguuaggagugaucuggucuggcgguaauacggacuauaacaccccguuuacaucgaggcugucaauaaauaaggauaacagcaaaagucaggucuucuuuaagaugaacucccuacagucuaaugacacugccaucuacuauugugcucgggcacucaccuacuaugauuacgaguucgccuauugggggcagggaacacuggugaccguuagcacugcguccacaaaaggccccucaguguuuccucuugcuccaaguagcaagucuaccuccggcgggacggccgcacugggaugcuuggucaaggacuacuuccccgaaccugugacuguaucauggaauagcggugcccucaccaguggcguucauacauuuccagcugugcugcaaucuuccgggcuguacagccucucgucugucgugacugugcccuccucaaguuuaggaacccagacauauauuuguaacgucaaucacaaaccuagcaacaccaagguugauaaaaagguggaaccaaaauccugcgacaagacgcauacuuguccgcccugcccugcaccagagcugcuuggcggucccucuguauucuuguuuccuccaaagcccaaagauacacugaugaucagccgcaccccggaagugacuugugucgugguugacgugucacacgaggauccugaggucaaguucaauugguacguggacgggguagaaguucauaacgccaaaacaaagccccgagaggaacaguauaauaguaccuaccguguggucuccgugcuaacgguccuccaccaggauuggcugaacggaaaagaguauaagugcaaagugagcaauaaggcccuuccagcuccuauugagaagaccaucucuaaagcgaagggccaacccagagaaccacagguuuacacacugcccccuucaagggacgaguugacuaaaaaccaggugagucucaccugucugguaaagggcuuuuauccaagcgauauagcagucgaaugggaguccaacgggcaaccggaaaauaacuacaaaacaacucccccuguguuagacucugacggaucguucuuucuguacagcaagcucaccguugauaagucccgguggcagcaggguaauguguucucaugcagugucaugcacgagggccuucauaaccacuauacacagaaaucucugagcuuguccccagggaag

SEQ ID NO: 24011 - RNA, 642 nt, Artificial Sequence; identical to SEQ ID NO: 23083
  derived and/or modified sequence opt3 from Tomuzotuximab_LightChain

SEQ ID NO: 24012 - RNA, 1347 nt, Artificial Sequence; identical to SEQ ID NO: 23811
  derived and/or modified sequence opt3 from Trastuzumab_duocarmazine_HeavyChain

SEQ ID NO: 24013 - RNA, 642 nt, Artificial Sequence; identical to SEQ ID NO: 23668
  derived and/or modified sequence opt3 from Trastuzumab_duocarmazine_LightChain

SEQ ID NO: 24014 - RNA, 1368 nt, Artificial Sequence
  derived and/or modified sequence opt3 from Varisacumab_HeavyChain
caggugcaacugguccagagcggcgccgagguuaagaaacccggggcuuccgugaagguaucuugcaaagcaucaggagguaccuucaguagcuacgccaucuccugggugagacaggcgccuggccaggggcucgaauggaugggaggcuuugacccagaggauggugaaacaauuuaugcucaaaaguuccaggggagggucacuaugacggaggacaccucuacagauacugccuacauggaacuuucgucacugcggagcgaggacaccgcaguguauuacugugccacaggacgcaguaugguucgaggcgugauaaucccguuuaacggcauggaugucugggggcagggaaccacugugacaguauccucugcuagcaccaaaggucccuccguuuucccuuuggcaccaucaaguaagagcacgucuggcgggacugccgcuuuaggaugccuggugaaggacuauuuucccgagccugucaccguguccuggaacucaggcgcccuaacaagcggugugcacacuuucccagcgguccuccagaguucugggcuguacucccuuagcucgguugugaccguacccucuuccucacugggaacacaaaccuauauuuguaaugugaaucauaaaccuaguaacacgaaggucgauaaaaagguggaaccaaaaagcugcgacaagacucacacauguccgcccugcccugcaccagaguugcucggcggccccuccguuuuucuguucccuccaaagcccaaagauacccugaugaucucucguacuccggaagugacaugugucgugguagacguuagccaugaggauccugaggugaaguuuaauugguacgucgacgggguggaaguccacaacgccaaaaccaagcccagagaggaacaguacaauucaacguauagggugguuagugugcucaccguauuacaucaggauuggcugaacggaaaagaguacaagugcaaagucuccaauaaggcccuuccagcuccuauugaaaagacaaucagcaaagcaaagggucagccccgggagccacaaguguauacuuugcccccuucucgcgacgagcugaccaaaaaccagguuucacuaacaugucucgugaagggcuucuacccaagugacauagcugucgaaugggagagcaaugggcagccggaaaacaauuauaaaacuacacccccugugcuggauuccgacggaucguuuuuccuuuacucuaagcugaccguagauaagagcagauggcaacagggcaacguguuuuccugcucaguuaugcacgaggccuugcacaaucauuauacccagaaaagucucucucugagcccagguaag

SEQ ID NO: 24015 - RNA, 642 nt, Artificial Sequence
  derived and/or modified sequence opt3 from Varisacumab_LightChain
gacaucagaaugacccagagccccuccucucugucagccagugugggcgauagggucacaauuacuugccgggcuagccaauccauaucuucguaccucaacugguaucagcagaagccugggaaagcaccaaaacuucugaucuacgccgcgagcucauugcagaguggaguuccgucccgcuucucugguagcggcuccgggacggacuuuaccuuaacaauuucaagucugcaacccgaggauuucgcuacuuauuacugucagcagagcuauucuaccccucuaacauuuggaggcgguaccaaaguggaaaucaagcgaacuguagccgcaccauccguguucauuuuucccccuucagacgagcagcucaaaagcgggacagccagugucgugugccugcuuaauaacuucuacccacgugaagcuaagguucaauggaagguggauaaugcacugcagucuggaaacucccaggagagcgucaccgaacaggacucgaaagauucuacguauuccuugucaaguacucucacccugagcaaggccgacuacgagaaacacaagguguacgcuugugagguaacacaucaaggccuguccucucccguuacuaagagcuuuaauagaggcgaaugc

SEQ ID NO: 24016 - RNA, 1359 nt, Artificial Sequence
  derived and/or modified sequence opt3 from Vunakizumab_HeavyChain
gaggugcagcugguccaaagcggcgccgaaguuaagaaacccggggcuuccgugaagguaucuugcaaagcaucaggauacaccuucacagacuaugaggugcacugggucagacaggccccuggucagggccucgaauggaugggggugaucgauccaggaacuggcgguguugcguacaaccagaaguuugaggggagggugacgaugaccgcugacacaaguacuagcaccgccuauauggaacuucggucccugcgcucugaugacacagcagucuacuauuguacccgauacucguuguucuauggaucaagcccguacgccauggauuacuggggccaaggcacuuuagugacaguaaguuccgcuucuaccaaagggcccagcguuuuuccucuggcaccauccucaaagaguacgagcggagguacugccgcucuaggcugccucgugaaggacuauuuccccgagccugucaccgugucuuggaacuccggggcccugacaucaggagugcauacuuuuccagcgguccuucagagcaguggccuguacucuuuguccagcguugugaccguacccucgucuucccucgguacacagaccuauauuuguaaugugaaucacaaaccuucaaacacgaaggucgauaaaaagguggagccaaaaaguugcgacaagacucauacauguccgcccugcccugcaccagaacugcucgggggacccagcguuuuccuguuuccuccaaagcccaaagauaccuuaaugauaucccguacuccggaggugacaugugucgugguagacguuucucacgaagauccugaggugaaguucaauugguacgucgacggcguggagguccauaacgccaaaaccaagcccagagaggaacaguauaauagcacguacagggugguuucagugcugaccguacuucaccaagauugguugaacggcaaagaauauaagugcaaagucaguaauaaggcucugccagccccuaucgagaagacaauuuccaaagcaaaggggcagccccgggaaccacagguguacacucuacccccuagccgcgaggagaugaccaaaaaccagguuucucucacaugucuggugaagggauuuuacccaucagacaucgcugucgaaugggagaguaauggucaaccggaaaacaauuauaaaacuacacccccugugcuugacagcgauggcuccuucuuucuguacucuaaguugaccguagacaagucgagauggcagcaggggaacguguucagcugcuccguuaugcacgaggcccuccauaaucacuauacccaaaaaucacugaguuuaucuccaggaaag

SEQ ID NO: 24017 - RNA, 639 nt, Artificial Sequence
  derived and/or modified sequence opt3 from Vunakizumab_LightChain
gagaucgugcugacccagagccccgacuuccaauccgucacaccuaaggaaaaaguuacuauuacgugcucugccucaaguagcgugaacuacaugcacugguuucagcagaagccagaucaguccccgaaacucuggauauauagaaccucuaaucuugcuucgggcguacccucaagguucagcgggaguggauccgguacagacuacacucugaccaucaacucuuuggaggcagaagaugccgcgacauauuacugucaacagcggagcuccuauccuuggaccuuuggccaggggacuaaguuagagauuaaacgcacaguggcugccccaucagucuucaucuuucccccuagugacgaacagcuaaagagcggaaccgcaucugugguuugccugcucaauaacuucuacccacgagaggccaaggugcaauggaaagucgauaaugcucugcaguccggcaacucacaggagagcgugacggaacaggacaguaaggauucuacuuauucccuuagcucgacccugacauugucuaaagcagacuacgagaagcauaaaguauacgccugugaaguuacucaccaaggucucuccucacccgugaccaagaguuuuaaucguggggagugc

SEQ ID NO: 24018 - RNA, 1341 nt, Artificial Sequence; identical to SEQ ID NO: 23921
  derived and/or modified sequence opt3 from Xentuzumab_HeavyChain

SEQ ID NO: 24019 - RNA, 648 nt, Artificial Sequence; identical to SEQ ID NO: 23922
  derived and/or modified sequence opt3 from Xentuzumab_LightChain

SEQ ID NO: 24020 - RNA, 726 nt, Artificial Sequence
  derived and/or modified sequence opt3 from anti-rabies_SO57_LightChain
augagcgugcccaccauggccugggcucugcuccuucuguccuuguuaacacagggcacugggucuugggcacaaucagcccugacgcagccuagaagugucagcggauccccaggucagucuguuaccaucucgugcacaggcacuucaagcgacauugggggauacaacuucgugaguugguaucagcaacacccgggcaaggcgcccaaacuaaugauauacgaugcuaccaagaggccuuccgguguaccagaccgguuuucugggagcaaauccggaaauacagccucacucaccaucaguggccugcaggcagaggaugaagccgacuauuacuguugcagcuaugcuggcgauuacacucccgggguggucuucggagguggcacaaaacuuaccgugcuggggcagccuaaggcagccccaucuguuacguuguuucccccuuccucagaggaacuccaggcuaacaaggccacucuggugugucugauuagcgacuucuauccaggagcggucaccguggcauggaaggccgauaguucuccgguaaaagcuggcguugagacaacuacccccuccaagcaaagcaauaacaaauacgccgcaucgucuuaccucuccuuaacaccugaacaguggaagucacaucgcaguuauagcugccaggugacccacgaggguuccacggucgagaaaacuguggcuccaacagaauguucu

SEQ ID NO: 24021 - RNA, 1428 nt, Artificial Sequence
  derived and/or modified sequence opt3 from anti-rabies_SO57_HeavyChain
auggacuggaccuggagauuccuguuuguggucgccgcugcaacaggcguucagagccaagugcagcucguacaguccggggccgaggugaagaaacccggaucuucagucaaggugaguugcaaagcgagcgguggcacuuucaacagguacacgguuaauugggugcggcaggcuccugggcaaggacuugaauggaugggcgguaucauuccaauauuugggaccgccaacuaugcacagcgcuuccagggacgacugacaaucacugccgaugaguccaccucuacagcuuacauggaauugucgucauuacguagcgacgauaccgcagucuauuuuugugccagagagaaucuggacaacaguggcacuuacuauuacuucuccggcugguuugauccgugggggcagggaacucuagugaccguaucuagcgcuuccacgaagggucccucaguuuucccucucgccccaaguagcaaaucuacuuccggcgggaccgcggcacugggaugccuugugaaggacuauuuucccgaaccugucacagugucauggaauagcggcgcccugacaaguggugugcacaccuucccagcugucuugcaaucuuccgggcucuacagccugucgucuguugugacaguacccuccucaagucugggaacccagacguacauuuguaacgugaaucauaagccuagcaacacuaaagucgauaagaggguggagccaaaauccugcgacaagacacacaccuguccgcccugcccugccccagagcucuuaggcggccccucuguuuuucuguucccuccaaaacccaaggauacucuuaugaucagccggacaccggaagugaccugugucgugguagacguuucacaugaggauccugaagugaaguuuaauugguaugucgacgggguggagguccacaacgcaaaaacgaagccccgcgaggaacaguacaauaguaccuauagagugguuuccguguugacaguacugcaucaggauuggcuaaacggaaaagaguacaagugcaaagucagcaauaaggcucucccagccccuauugagaaaacuaucucuaaggcgaagggucaacccagggaaccacagguguauacccugcccccuucacgggaagagaugacuaaaaaccagguuagucuuacaugucuggugaagggcuucuacccaagcgacauagccgucgagugggaauccaaugggcaaccggagaacaacuauaaaaccacacccccuguguuggacucugauggaucguucuuucucuacagcaagcugaccguagacaaaucccgcuggcagcagggcaauguguucucaugcaguguuaugcacgaagcauuacacaaccauuacacucagaagucucugagccucuccccagguaag

SEQ ID NO: 24022 - RNA, 696 nt, Artificial Sequence
  derived and/or modified sequence opt3 from anti-rabies_SOJB_LightChain
auggccuggaccgugcugcuccuuggccuguugagccacugcacaggguccgucacuucuuacguuuuaacgcagcccccuucagugaguguagcuccaggaaagaccgcaagaaucaacugugguggcaauaacauugaguauaggagcgugcauugguaccaacagaaauccgggcaggccccggucgcggugauauaugacaauucugaucggcccucgggaaucccugaacgcuucucaggcagcaagagugguaacacagcuacucugaccauuucccgaguugaggccggggacgaagcagauuacuauugccaggugugggacaucucuagcgaugucguguuuggaggcggcacaaaacuaaccguacucgggcaaccaaaggccgcucccuccguuacucuguucccuccaucaagugaggaacuucaggcaaauaaagccacacugguguguuugauuagcgacuuuuaccccggagcugucaccguggccuggaaggcggauucuuccccugugaaggccggugucgagacgacuaccccaucaaaacagagcaacaauaaguaugcagcuaguucuuaccucucccugacaccggagcaguggaaaagccaccguucguacucuugccaaguuacucaugaaggcuccaccguggagaagacaguagcccccaccgaauguuca

SEQ ID NO: 24023 - RNA, 1554 nt, Artificial Sequence
  derived and/or modified sequence opt3 from anti-rabies_SOJB_HeavyChain
auggacacccugugcagcacacuccuucuguugacuauccccuccuggguguuaucucagauuacgcugaaggagaccggcccuacccuagucaaaccaacucaaacccucacacugaccuguacuuucucaggguuuagucuuagcacauccggaguuggugugggcuggauaagacagccgcccgggaaggcccuggaauggguaaccuugaucuacugggaugacgauaaaagguauucuccuucgcucgagaaccgggugacgauucgcaaggacacuucaaagaaucaggucgcucugaccaugacaaacauggauccacuggacacuggaaccuacuauugcgcacaccgacagcauaucagcaguuuccccugguuugauuccuggggccaagguacacucgugaccguuucuagcgccuccacgaaggggccuucaguguucccauuagcgcccuguagucguagcacuucuggaggcacagcugcccugggcugccuugucaaggacuacuuuccugaaccagugaccguauccuggaacucaggggcauugacuagcggaguucacacauucccggccgugcugcagaguucuggucuauauucccucagcucggucgugaccgugcccucuuccucacugggcacgcagaccuacacauguaaugucaaucauaaaccuaguaacacuaagguugauaaaagaguggagcuuaagaccccacugggggacacaacucauaccugccccagguguccugaaccaaaaagcugcgauacacccccgccuuguccccggugcccagagccuaaguccugugacacacccccacccugcccucgcugcccagagccgaagucuugugauacucccccuccaugccccagauguccugcuccagaauugcucggaggccccagcguauuucuguucccgccuaaaccaaaggacacguuaaugauuucaaggacacccgaggugaccugcgucgugguugacgugagucacgaagauccugagguccaguuuaaaugguauguggacgguguagagguucacaaugcaaagacuaaaccccgggaggaacaauucaacuccaccuuucgcguggucagcgugcugacaguccuccaccaggauuggcuuaaugggaaggaauacaaauguaaggugucuaacaaggcccugccagcuccuaucgagaaaaccauaucaaagacuaaaggacagccccgagaaccacagguuuacacauugccgccuaguagagaggagaugacgaagaaucaagugagccuaaccugccugguaaaaggcuucuaucccuccgacaucgccgucgaaugggagucuucgggccagccagaaaacaauuacaacacuacacccccuaugcucgauagcgacggguccuuuuuccuguauucaaaacuuaccguggauaagaguagguggcagcaaggaaauauuuucucuuguagcguuaugcaugaggcgcugcacaaccgguuuacacagaaauccuugucacucagcccagguaag

SEQ ID NO: 24024 - RNA, 702 nt, Artificial Sequence
  derived and/or modified sequence opt3 from anti-rabies_SOJA_LightChain
auggaggcccccgcucagcuccuguuccuucuguuguuauggcugccugacaccacaggcgaaaucgugcuaacucaaagcccagcaacgcucucccugucuccgggggagagagccacccuugcgugcagggcuucacagacagccagucgguaccuggcaugguaucagcagaagcccggacaagccccucgcuugcucauuuacgauacuagcaaccgagcuaccgguauaccagcacguuuuuccggcucugggucgggaacagacuucacccugucaaucagcagucuggaacccgaggauuuugccgucuauuacugucagcagagauucaauuggccuuggacuuuuggccaggguacaaaaguugaguucaagaggaccguggcugccccauccguauuuauuuuucccccuucugacgaacaacucaaaagcgggacggcguccguggucugcuuacugaacaauuucuauccacgggaggcaaaggugcaguggaaaguugauaacgcccuucagucaggaaauagucaggaaagcgugacugagcaagacucuaaggauuccaccuacucauugagcaguacacugacucuaucuaaggcugacuaugaaaaacacaaggucuacgccugugaggugacccaucagggccucuccagcccgguaacaaaaucguucaaccgcggcgagugc

SEQ ID NO: 24025 - RNA, 1422 nt, Artificial Sequence
  derived and/or modified sequence opt3 from anti-rabies_SOJA_HeavyChain
auggaguucggccugagcuggcucuuucuuguggccauccugaaggggguccagugcgaaguucaauuguuagaguccggagguggccuggugcagcccgggggaucucuaagacucucaugugcugcaaguggcuucaccuuuagcaacuacgccauguccuggguaaggcaggcgccugguaaagggcuggaaugggugucugcuauuucggccucaggacacagcacauaucuugcagacagugucaagggccgguucacuauaucccgcgauaauucuaaaaacacgcuguacuugcagaugaauagccuccgagccgaggacaccgcuguguauuacugcgcaaaggaucgugaaguuacaaugaucgugguccugaacggcggguuugacuauuggggacaagguacuagagugaccguauccucagccaguacaaaaggcccaagcguuuucccgcuggcucccucuuccaagucaaccagcgggggaacugccgcgcucggcuguuuagugaaggauuacuuuccugagccagucacagugaguuggaacucuggugcacugaccuccggggugcauacguuccccgccguccuucagagcucgggauuguauucucuguccucaguugugacuguaccuaguagcucccuaggcacccagacauacauuugcaaugugaaucacaaaccaucuaacacuaaggucgacaaaaggguggagcccaagagcugugauaaaacccauacaugcccuccauguccggcucccgaacuccugggcgggccuucaguuuuucuuuucccacccaagccuaaggacacccugaugaucagucggacgccagaggugacuugcgucgugguagauguuucccacgaagaccccgaggugaaauuuaauugguacgucgauggaguggagguccauaacgccaagacaaaaccgcgcgaggaacaguauaauagcaccuacagagugguuucuguguugacuguacuccaccaagacuggcugaacgguaaggaauauaaauguaaggucucaaauaaagcauuaccugcucccauugagaagacaaucaguaaggccaaaggccagccaagggaaccucagguguacacccugcccccaagccgggaggagaugacgaagaaccagguuucccuuaccugccucgugaaaggguucuaucccucugauauagcggucgaaugggagucgaauggacaaccugaaaacaacuacaagacaacuccaccggugcuggacagcgacggcuccuuuuucuuguauucaaaacuaaccguagauaagagucgcuggcagcaggguaauguguucucuuguagcguuaugcacgaggcccugcauaaccacuacacacaaaagucccucucacugagccccgggaaa

SEQ ID NO: 24026 - RNA, 321 nt, Artificial Sequence
  derived and/or modified sequence opt3 from anti-rabies_LightChain
gugaugacccagagccccgccacacugucccucucuccuggcgagagagcuacucuuucaugcagggcaagucaaagcguccggaacuaccuggccugguaucagcagaagccagggcaggcgccgcgcuuguuaaucuacggagcuuccaaucgagccacggguauucccgcacguuucucuggcucggggucaggaaccgacuuuacacugacuauaagcagucuagaaccugaggauuucgccguuuauuacugucaacagagauccgacuggccacucucuuuuggccaggguaccaaacuggaaaucaagaggaca

SEQ ID NO: 24027 - RNA, 333 nt, Artificial Sequence
  derived and/or modified sequence opt3 from anti-rabies_HeavyChain
ggccccgccugggaggugccugaaacccugccaguccagccgcucgacagccccuccguugcuauggcaugcacaggggugagacaagccccuggaaagggucuugaguggguagcggugaucucuuacgauggcucaaacaaauauuacgcugacagugucaaggggagguucacuauuagccgggauaauuccaaaaacacgcuguauuugcagaugaacucuuuacgcgccgaagacaccgcaguguacuauugugccaaggauucaaauucgggaagcuacuaugcucacgaccugggcuacuggggucaggggacucuaguuacagug

SEQ ID NO: 24028 - RNA, 342 nt, Artificial Sequence
  derived and/or modified sequence opt3 from anti-rabies_LightChain
gagcuggugaugacccagagcccccucucccuuccugucacacugggccaaccagccucuaucucaugcagaaguagccaguccuugauucacucuaacgggaauacuuacuuaaacugguuccagcagaggccgggacaaucgccccggcgccugauauauaagguuucagaccgagauagcggugugccugaccguuuuaguggcuccgggucuggaacggauuucacccuaaaaaucagcagaguagaagcugaggacgugggcgucuacuauugucuccaggguacacauuggccaaggacuuuugggcagggaaccaagcuggaaauuaaacggaca

SEQ ID NO: 24029 - RNA, 351 nt, Artificial Sequence
  derived and/or modified sequence opt3 from anti-rabies_HeavyChain
gugguccagcccggcagaagccugaggcucuccugcgccgcuucuggguucaccuuuucaaguuacgcaaugcacuggguucggcaagccccuggaaagggucuugaguggguggcgguaaucagcuaugacggcuccaacaaauacuaugcugauucugugaaggggcgcuucacaauuucgcgagacaauucaaagaacacucuguacuugcagaugaauagcuuacgugccgaagauacggcagucuauuacugugccagagacaaagcucuggcagccaggcggggauauuacuacuauuacggcaccgauguguggggucaggggacucuaguuacagugaguucc

SEQ ID NO: 24030 - RNA, 648 nt, Artificial Sequence
  derived and/or modified sequence opt3 from anti-RSV_5ITB_LightChain
agcgacauccagaugacccaaucccccucuacacugucagccagugugggcgauagagucacuauuacgugcagggcuagccaguccauaucuucguggcucgcaugguaccagcagaagccugggaaagccccaaaguugcugaucuaugacgcgucaagccuugagaguggaguuccgucccgguucucugguagcggcuccgggaccgaauuuacauuaacuauuucaagucugcaacccgaugacuucgcuaccuacuauugucagcaguacaacacauauagcugguggaccuuuggacagggcacuaaaguggauaucaagcgcacaguagccgcaccuucuguguucauuuuuccacccuccgacgagcaacuaaaaucagguaccgccagcgucgugugccuccugaauaacuucuacccucgagaagcuaagguucaguggaagguggauaaugcacuucagagugggaacucucaggaguccgucacggaacaagacagcaaagauucgacuuauucucuguccucaaccuugacacucaguaaggccgacuacgagaaacacaagguguacgcuugugagguaacucaucagggacugagcuccccaguuaccaaaucuuuuaaucguggcgaaugc

SEQ ID NO: 24031 - RNA, 660 nt, Artificial Sequence
  derived and/or modified sequence opt3 from anti-RSV_5ITB_HeavyChain
guggagagcggcgggggacugauccagcccgguggcucccucagacuuucuugcgccgucucaggguucaccguuaguagcaaguacaugacaugggugaggcaagcuccuggaaaaggccuggaauggguauccgugauuuauggugggggaucuacuuacuaugcagacucggucgugggccgguuuacgauaucacgcgauaacagcaagaauaccuuguacuuacagaugaacagucugcgagccgaggacacagcgguuuauuacugugcuucccgucuaggcgugagagccacuaccggggaucucgacuauuggggacaggguacacuggucaccgugucuagcgcauccacuaaaggcccaucaguauucccgcuugcccccaguagcaagucuacauccgggggaaccgcugcacugggcugcuugguuaaagauuacuuuccugaaccagugacggucucauggaauagcggugcccucaccaguggggugcacacuuuccccgcugugcugcagucuuccggacuguacagccucucgucugucguuacagugccuuccucaaguuuaggcacucaaaccuauaucuguaacguaaaucauaagccaagcaacacaaagguggacaaaagggucgagcccaaguccugc

SEQ ID NO: 24032 - RNA, 639 nt, Artificial Sequence; identical to SEQ ID NO: 23996
  derived and/or modified sequence opt3 from anti-alpha-toxin_4U6V_LightChain

SEQ ID NO: 24033 - RNA, 675 nt, Artificial Sequence
  derived and/or modified sequence opt3 from anti-alpha-toxin_4U6V_HeavyChain
gaggugcagcuggucgaaagcggcgggggacucguucaacccgguggcucccuuagacugucuugcgccgcuucaggguucaccuuuaguagccacgacaugcauugggugaggcaggcaacaggaaagggcuuggaguggguauccgguaucgggacugccggagauacguacuauccugacucugugaaaggccgguucaccauuucgcgcgaaaacgcgaaaaauucauuauaccugcagaugaacagccuacgagcuggcgauacagccgucuauuacugugcacgugacagauauaguccaacugggcacuacuauggaauggauguguggggucagggcaccacaguuaccguguccucugccagcacuaaggggccguccgucuuuccccucgcuccuucaaguaagagcacaucuggaggcaccgcagcccuggguugccuugugaaagacuacuucccagagcccguaacgguuuccuggaacucaggggcucugacuagcggagugcauaccuuuccugccgucuugcaaaguucuggccucuacucccugagcucgguggugacagucccaucuuccucacugggcacucagaccuauauauguaauguuaaucacaagcccaguaacacaaagguggauaaaaggguagaaccuaagagcugc

SEQ ID NO: 24034 - RNA, 879 nt, Artificial Sequence
  derived and/or modified sequence opt3 from anti-alpha-toxin_4U6V_Chain-A
gccgacagcgauaucaacauuaagaccggcacaacugacauaggguccaauacgaccgugaaaacaggagaucuggucacuuacgacaaggagaacgguaugcacaaaaagguuuucuauucuuuuaucgaugacaaaaaucauaacaagaagcuccuugugauuagaaccaaaggcacaaucgcugggcaguacaggguauauucagaagagggagcaaauaagaguggccuggccuggcccagcgcguucaaagugcaauugcaguuaccugauaacgaagucgcucagauuuccgacuacuauccacgcaauucuaucgauaccaaggaguacaugucgacucugacauaugguuuuaacgggaaugugaccggagacgauacgggcaaaauaggcgggcuaaucggagccaacguuucaauuggucacacucucaaguacgugcagccggacuucaagaccauccuggaaagccccacagauaaaaaggucggcuggaaagugauuuuuaauaacaugguaaaucaaaacugggggccuuacgaccgggacaguuggaauccaguuuauggaaaccagcuuuucaugaagacucgaaacggcuccaugaaagcagccgauaauuuucuggaccccaacaaggcuucuagcuugcucuccucagguuucaguccugauuuugcaaccgugaucacaauggaccguaaagccagcaagcagcagaccaauauagaugucauuuacgagagagugagggacgauuaucaacugcauuggacgucuacuaacuggaaggggacaaauaccaaagacaaguggaucgaucgguccucagagcgcuacaaaauugacugggaaaaggaggaaaugacuaac

SEQ ID NO: 24035 - RNA, 879 nt, Artificial Sequence; identical to SEQ ID NO: 24034
  derived and/or modified sequence opt3 from anti-alpha-toxin_4U6V_Chain-B

SEQ ID NO: 24036 - RNA, 642 nt, Artificial Sequence
  derived and/or modified sequence opt3 from anti-IsdB_5D1Q_Chain-A
gacauccagcugacccaaagccccuccucugugucagccagugucggcgauagaauuacaauaacuugcagggcuagccaggacaucuccaacuggguugcaugguaccagcagaaaccugggaaagccccaaagcuccuuauuuauucugcgucgucacugcaaagcggagugccgagucgguucuccgguucuggcagcgggacggauuuuaccuugacaaucuccucauuacagcccgaggacuucgcuacuuacuauugucagcaggccaauaccuuuccuuggacauucggacaaggcaccaaaguagaaauuaagcgcacuguggcagccccaagugucuuuaucuuucccccuagcgaugagcagcugaaaucugguacagcuuccgugguuugccuacucaacaauuucuacccacgagaagcaaaggugcaguggaaggucgacaacgcccugcagucagggaauagccaagagagugugaccgaacaggauucuaaagacuccacguauagccuuucgucuacucugaccuuguccaaggcugauuacgagaaacacaagguauaugccugugagguuacacaucagggacucucaagucccgugacuaagagcuucaaccguggcgaaugc

SEQ ID NO: 24037 - RNA, 783 nt, Artificial Sequence
  derived and/or modified sequence opt3 from anti-IsdB_5D1Q_Chain-B
caggugcaacugguccagagcggcgccgagguuaagaaacccgcuuccucugugaagguaucaugccaggcaagugggggaaguuucuccaccagaacaaucucuuggcucaggcaggccccuggucaaggccuugaauggaugggagggauuucgccaauauuuggcgcggcuaacuacgcccagcgguuccagggucgcgugacuaucacggcagacaaaucaaccagcacagccuauauggagcugacuagcuugaccuccgaagauacagcugucuacuauugugcacgagaccguccgcccggggcccaguuugauaccuggggacaaggcacuuuagugacaguuucuagcgcuuccaccaagggcccuucaguguucccacuggcccccaguagcaaaucuacguccgggggaacugcggcacuagguugccucgucaaggacuacuuuccugagccagugaccguaucauggaauagcggcgcccugacaagugggguucacacuuuccccgcugugcuucagucuuccggacuguauagcuugucgucugucgugaccgugccuuccucaagucucggcacacagaccuacauuuguaacgucaaucauaagccaagcaacacgaaaguugauaagaaaguggaaccgaaguccugcggugggggaucuggccaccaucaccaucaccaccaucaccaucacggcggggacuauaaagaucacgacggagauuacaaggaccaugauaucgacuacaaggaugacgacgauaaa

SEQ ID NO: 24038 - RNA, 822 nt, Artificial Sequence
  derived and/or modified sequence opt3 from anti-IsdB_5D1Q_Chain-C
gaggugcagcuggucgaaagcggcgggggacucguucaacccgguggcucccuuacccugucuugcgccgcuucaggguugaucuucagugacagcacaaugcacugggugagacaggcauccggaaggggcuuagaguggguagcccggauucgcucuaaggcgaacaauuacgcuacuucgucagauaaaagcgccacggcauaucuggccagugugaagggucgauuuaccauaucccgugacgauucuaaagacacaacuuuccuagaaaugagcucccucaagaucgaggauaccgcugucuacuauuguauugcaucaaguacaaccgggugguacgugagagaagacuuugauuauuggggacauggcacucugguuacagugagcucugccuccaccaaaggcccuucagucuucccacuugcuccgagcaguaagucuacguccgggggaacugccgcgcuggguugcuuggugaaggacuacuuucccgagccuguaaccguuagcuggaacucgggcgcacucacaucuggggugcacacuuucccagccguccugcaguccucaggacuguauagucucagcuccguggugaccguccccucuagcucauuaggcacacagaccuacaucuguaauguuaaccauaaaccuaguaauacgaagguggauaaaaagguagagccaaaauccugcggugggggaagcggccaccaucaccaccaucaccaucaccaccauggcggggacuacaaggaucacgacggagauuauaaggaccaugacauugauuacaaagacgaugacgauaag

SEQ ID NO: 24039 - RNA, 648 nt, Artificial Sequence
  derived and/or modified sequence opt3 from anti-IsdB_5D1Q_Chain-D
gagaucgugcugacccagagccccggcacacucucccuuucuccuggggaaagagccacucugucaugcagggcuagucaaagcgucuccucuucguacuuggcaugguaucagcagaaaccaggacaggccccgcgguuacugauuuacggugcgucaagccgcgcuacgggcauacccgaccgauucaguggguccggaucuggcaccgauuuuacacuaagcaucucccgucucgagccugaagacuucgccguuuauuacugucugcacuaugguacuucaccaauguacaccuuugggcaaggaacaaaacuugagauuaagagaaccguggcagcccccaguguauucaucuuuccuccaagcgaugaacagcugaaaucuggcacugcuuccguggucugcuugcucaacaauuucuaucccagggaggcaaaggugcaguggaaaguugacaacgcccugcagucaggcaauagccaagagagugugacagaacaggauucuaaggacuccaccuacagccugucgucuacgcucacuuuauccaaggcugauuacgagaaacauaaggucuaugccugugaagugacccaccaggggcugucaaguccuguaacaaagagcuuuaaccggggagagugc

SEQ ID NO: 24040 - RNA, 360 nt, Artificial Sequence
  derived and/or modified sequence opt3 from anti-IsdB_5D1Q_Chain-E
cccggcaagaugaccgaccugcaggauacaaaauacguggucuaugagagcguugaaaacaaugaguccaugauggacacuuucgugaagcacccuaucaaaacggggaugcucaacggaaagaaauacaugguaauggaaaccacaaaugaugacuauuggaaggauuuuaugguggagggucaaagagucaggacuauuucuaaggacgccaaaaacaauacccggacaauaaucuucccauacguggaaggcaagacccuuuaugaugcuauuguuaaagugcaugucaagacuaucgacuacgaugggcaguaucacgugcgcauuguagacaaagaggcauuuacaaaggccaac

SEQ ID NO: 24041 - RNA, 657 nt, Artificial Sequence
  derived and/or modified sequence opt3 from anti-IsdB_5D1X_Chain-A
gacaucgugaugacccagagcccccugucccucccugucacacuuggccaaccagccucuauuucaugcaguagcgcucagucccugguucacucugauggggacucguacuugacuugguuccaucagagaccgggacagucacccaggcgguuaauauauaaggugagcauccgcgaugcagggguaccugaccgauuuaguggcuccgggucuggaacggauuucacccugaaaauuagccguguggaggccgaagacgucggcguguacuauuguaugcaagcgacacacuggccauacacuuuuggucaggggaccaagcuagagaucaaaagaacaguugcugcccccuccguguucauuuuuccuccaucagaugaacagcucaagaguggaaccgcaagcgucgugugccugcuuaacaauuucuaucccagggaggccaaaguacaguggaagguugacaacgcucugcaaucuggcaauucccaggaaucagugacugagcaggauagcaaggacaguacauacucuuuguccagcacccucacgcugucgaaagcagauuaugagaagcauaaagucuacgccugugaagugacucaccagggccugucuuccccugugaccaagucauuuaaccggggugagugc

SEQ ID NO: 24042 - RNA, 777 nt, Artificial Sequence
  derived and/or modified sequence opt3 from anti-IsdB_5D1X_Chain-B
caggugcaacugguccagagcggcuccgagguuaagaaacccgggucuucagugacccucaguugcaaggccagcggagacacauucaacacucacacguacuccuggguaagacaggcuccuggucagaggcuugaauggaucggcgggauuaugccaauauuugcagccucuaaaucggcgccgcaucugcaagaucgguugaccaucacagcuaauaaggccacucgcaccgcauauauggaguuaacaucacugaccagcgacgauaguggaguguacuauugugcccgagacggccguggugcucuacaguacugggggcagggaacucucgucacaguguccucugcaagcaccaaaggccccuccguuuucccucuggccccaucaaguaagagcacgucuggcgggacugcugcccuuggaugccuggugaaggauuauuuucccgaaccugucaccguguccuggaacucaggugcguugacaagcggcguacacacuuucccagcaguucuccagaguucugggcuguacucccugagcucgguggucaccgugcccucuuccucacucggaacacaaaccuauauuuguaaugugaaccauaaaccuaguaauacgaaggucgacaaaaagguugagccaaaaagcugcggcgguggguccggacaccaucaccaccaucaccaucaccaccauggcggcgauuacaaggaccacgauggggacuacaaggaucaugacaucgauuauaaagacgacgaugacaag

SEQ ID NO: 24043 - RNA, 822 nt, Artificial Sequence; identical to SEQ ID NO: 24038
  derived and/or modified sequence opt3 from anti-IsdB_5D1X_Chain-C

SEQ ID NO: 24044 - RNA, 648 nt, Artificial Sequence
  derived and/or modified sequence opt3 from anti-IsdB_5D1X_Chain-D
gagaucgugcugacccagacacccgccacucucagccuuacgccuggcgaaagagcuacccugacaugcagggcaucccaaucugucucaaguagcuacuuggccugguaucagcagaagccagggcaggcgccgcgguuacugauuuacggagcuuccucucgcgccacugguauacccgaccgauucucgggcucagggagcggaaccgauuuuacacuaaguaucucccgucucgagccugaagacuucgcaguuuauuacugucugcacuauggcaccucuccaauguacuuuuucgguagagggacugugcuugauauuaaaaggacaguagccgcucccagcguguuuaucuucccuccauccgacgagcaacugaagucaggaaccgcaagugucgugugcuugcucaacaauuuuuauccccgggaagccaaaguucaguggaagguggauaacgcucugcagagcggcaauucucaggaguccgucacggagcaagacucaaaagauagcacuuacagucugucuuccacccucacauuaagcaaggccgacuacgaaaagcauaaaguguaugcgugugagguaacucaccagggccugucgucuccuguuaccaaguccuucaaccgcggggaaugc

SEQ ID NO: 24045 - RNA, 354 nt, Artificial Sequence
  derived and/or modified sequence opt3 from anti-IsdB_5D1X_Chain-E
aagaugaccgaccugcaggauacaaaauacguggucuaugagagcguugaaaacaaugaguccaugauggacacuuucgugaagcaccccaucaaaacgggcaugcucaacgggaagaaauacaugguaauggaaaccacaaaugaugacuauuggaaggauuuuaugguggagggacaaagagucaggacuauuucuaaggacgccaaaaacaauacccggacaauaaucuucccuuacguggaagguaagacccuuuaugaugcuauuguuaaagugcaugucaagacuaucgacuacgauggccaguaucacgugcgcauuguagacaaagaggcauuuacaaaggccaac

SEQ ID NO: 24046 - RNA, 792 nt, Artificial Sequence
  derived and/or modified sequence opt3 from anti-IsdB_5D1Z_Chain-B
gccgaggugcagcuggucgaaagcggcgggggaguugugcaacccgguggcucccucagacuuucuugcgcugcaucaggguucaccuuuaacaaguucuggaugaauuggguaaggcaggccccuggaaaaggccuggaguggguggcggacauccaggucgaugguagugaaaagaacuacguggacagcguuaaagggcgguuuacaauuucccgcgauaauggaaagaacucuuuguauuuacagaugaacucgcugcgagcugaggacacuggcguguacuauugugcccguggcagauacgauuauuggucaggguaccuaagcccauggggacaagguacgcucgucaccgugaguuccgcaucuacaaaaggcccgagcguauucccccuggccccuuccucaaagaguacuagcgggggaaccgcugcacuuggcugccugguuaaggacuauuuuccagaacccgugacagucucuuggaacuccggugccuugaccucaggggugcacacuuucccugcugugcuccagagcaguggacuguacucucuguccagcgucguuacagugccaucgucuucccucggcacccagacguacauauguaauguaaaucauaaacccucaaauacuaagguggauaaaaaggucgagccuaaaaguugcggcgggggaagcggucaccaucaccaucaccaccaucaccaucacggcggggacuauaaggaucacgacggagauuacaaggaccaugauaucgacuauaaagacgaugacgauaag

SEQ ID NO: 24047 - RNA, 642 nt, Artificial Sequence
  derived and/or modified sequence opt3 from anti-IsdB_5D1Z_Chain-C
gacauccagcugacccaaagccccuccuuccucucugccucaguggcugauagagucacaauuacuugcagggcaagucaggccguucggagcucccuugcgugguaccagcagaagccuggcaaagcuccacaacuguugauauauucugccucgacguuagagaacggggugucaagccgcuuuaguggauccgguccgggcaccgaguucacacugacuaucucuagccuacagcccgaagacguagggaccuacuauugucagcagcucaauacauacccuuuuaccuucggaccaggcacuaagguggaaauuaaacgaacagucgcagcccccuccguguuuaucuucccuccaucagaugagcaacugaagagugguaccgcuagcguugugugccuucugaacaauuuuuauccccgugaagcaaaaguccaguggaagguggacaacgccuugcagucuggaaauucccaggagucaguaacggagcaagauagcaaggacaguacuuacucucucuccagcacccugacacugucgaaagcugauuaugaaaagcacaaaguuuacgccugugaggugacucaucaggggcucucuuccccugucaccaagucauucaacagaggcgaaugc

SEQ ID NO: 24048 - RNA, 810 nt, Artificial Sequence
  derived and/or modified sequence opt3 from anti-IsdB_5D1Z_Chain-D
caggugcaacugcaggagagcggccccgggcucgucaagccuuccgaaacccuuucucugaucugcacaguuucaggagguaguauuagcuccucuucguacuauuggggcuggauaagacagacuccagagaggaacuuggaauggaucgggauuaucuacuucucaggaacgaccuauuacaauccgagcuuacagagucggguguccaugucucuggaccgcagcacaaaccgauuuucccuacgucucucaaguguaacugccgcugauaccgcaauuuauuacugugccaaacccaagagcagagacaggggcgguccuggggaugacuauuucggaauggauguguggggccaaggcaucauggucacagugucuuccgcgucaaccaaagggccaagcguuuuuccccuggcuccuaguucuaaguccacuagcggagguacagccgcacuuggcugccuggugaaagacuacuucccagagcccgucaccgugucguggaacucuggggccuugacguccggaguacacacuuuuccugcuguucuccagucaaguggccuguacagccuguccucuguggucaccgugccaagcucaagucucgguacacagacuuauauauguaaugugaaucauaagccguccaacaccaaggucgauaaaaagguugaacccaaaagcugcgggggaggcucuggccaccaucaccaucaccaccaucaccaucacgggggagacuacaaggaucacgacggugauuauaaagaccaugauaucgacuacaaggacgaugacgauaag

SEQ ID NO: 24049 - RNA, 810 nt, Artificial Sequence; identical to SEQ ID NO: 24048
  derived and/or modified sequence opt3 from anti-IsdB_5D1Z_Chain-F

SEQ ID NO: 24050 - RNA, 792 nt, Artificial Sequence; identical to SEQ ID NO: 24046
  derived and/or modified sequence opt3 from anti-IsdB_5D1Z_Chain-G

SEQ ID NO: 24051 - RNA, 642 nt, Artificial Sequence
  derived and/or modified sequence opt3 from anti-IsdB_5D1Z_HeavyChain
gacauccagaugacccaaagccccuccuuccugucugccucagugggcgauagggucacaauuacuugcagggcuagucaggggauaacgaccuaccucggaugguaucagcagcggccugguaaggcaccacaacuucugaucuacgccgcgagcuccuugcagucuggcguuccgccccgcuuuucggggucaggaagcggcacagaguucacuuuaaccauuaguucccugcagccugaagacuuugcuacauauuacugucagcaacuaaacaccuauccauacacuuucggucccgggacacgacucgagaucaaacguaccguggccgcaccuucuguauuuauuuucccacccagcgaugaacagcugaaguccggaacggccucaguggucugccuucugaauaacuuuuauccuagagaggcuaaagugcaguggaagguugacaaugcauugcagaguggcaacagccaagaaucugugacugagcaggauuccaaagacucaaccuacagccucaguucuacacugacucuguccaaggccgauuacgagaagcacaaagucuaugcuugugaagugacccaucagggccucagcucgccaguaacaaagucuuucaauagaggggagugc

SEQ ID NO: 24052 - RNA, 471 nt, Artificial Sequence
  derived and/or modified sequence opt3 from anti-IsdB_5D1Z_Chain-I
ggccccgccaaggcuaccaacaauacauacccuauccugaaccaggagcucagagaagcaauuaaaaauccagccauaaaggacaaagaucacagcgcgccgaacuccaggcccaucgacuucgagaugaagaaaaaggaugggacucaacaguuuuaucauuacgcuucuucagugaagccugcccgggucauuuucacggacaguaaaccagaaaucgagcuuggacugcagagcggucaguuuuggcgcaaguucgaaguuuaugagggcgauaaaaaguugcccauuaaauuaguguccuacgacaccguaaaggauuaugcauacauccgauuuucugugucgaaugggacaaaggccgucaaaauagugucaagcacucacuucaacaauaaggaggaaaaauaugacuacacccugauggaguuugcucaaccuaucuacaacagugcagauaaguucaaaaca

SEQ ID NO: 24053 - RNA, 324 nt, Artificial Sequence
  derived and/or modified sequence opt3 from anti-HIV_b12_LightChain
gagaucgugcugacccagagccccggcacacucucccuuucuccuggggaaagagccacuuucucaugcaggaguagccacuccauucggucucgccgagucgcuugguaccaacauaagccaggacaggcaccgcgucugguuauacacggugugucgaacagagccucaggcaucagcgacagguuuaguggguccggaucuggcacggauuucaccuugacaauuacucggguagagcccgaagacuuugcguuauauuacugucagguguauggugcuagcuccuacaccuucgggcagggaacaaaacuggagcgcaag

SEQ ID NO: 24054 - RNA, 381 nt, Artificial Sequence
  derived and/or modified sequence opt3 from anti-HIV_b12_HeavyChain
caggugcaacuggagcagagcggcgccgaagucaagaaacccggggcuuccguuaaggugucuugccaggcaucaggauacagauucagucacuuuaccguacauugggugaggcaggccccuggucaacgguucgaguggaugggcuggaucaacccauauaaugggaacaaagaauuuagcgcgaaguuccaggaccgcgucacauuuacugcugauacguccgccaauaccgcauacauggagcuccgaucucuucguucggccgacacagcuguguauuacugugcaagaguuggagaauggggcugggaugacucaccguaugauaacuacuauauggacgugugggguaaagggacuaccgucauugugagcagu

SEQ ID NO: 24055 - RNA, 633 nt, Artificial Sequence
  derived and/or modified sequence opt3 from anti-HIV_2G12_LightChain
guggucaugacccagagccccuccacacugucugccucaguuggcgacacuaucacgauuaccugcagagcuagucaaagcauagagacauggcucgcaugguaccagcagaagccugggaaagccccaaaacuucugaucuauaaggcguccacuuugaagaccggagugccgucuagguucucggguucaggcagcgggacagaauuuaccuuaacuauuaguggacugcaguucgaugacuuugcuacauaccacugucaacauuaugccggcuacuccgcaaccuucggucaggggacgcggguagagaucaaacgcacuguggccgcucccucugucuuuauuuucccuccaagcgaugaacagcuaaaguccggaaccgcaucagugguuugccuccugaacaauuuuuauccccgagaggccaaggugcaguggaaagucgacaacgcccuucaaaguggcaauagccaggaaucugugacagagcaggauuccaaggacucaacuuacagccugaguucuaccuugacacucuccaaagcugauuaugagaagcacaaaguauacgcgugugaaguuacccaucagggccugagcucgccugugacgaagucuuucaaccguggg

SEQ ID NO: 24056 - RNA, 672 nt, Artificial Sequence
  derived and/or modified sequence opt3 from anti-HIV_2G12_HeavyChain
gaggugcagcuggucgaaagcggcgggggacucguuaaggccgguggcucccuuauccugucuugcggggugucaaacuucagaauuagugcucacaccaugaauuggguaaggcgggugcccggaggcgguuuggagugggucgcaagcauauccacaucuucgacuuaccgcgacuaugccgaugcggugaaagggcgauuuacgguuucacgugacgauuuagaagacuucguguaccugcaaaugcauaagaugagagucgaggauaccgcuaucuauuacugugccaggaaaggaagcgaccggcuaagugauaacgacccuuuugaugcauggggcccaggcacagugguaacuguuuccccggccucuaccaaggggcccagcguguucccucucgcuccauccucaaaaaguacaagcggagguaccgcagcccugggcugccuugucaaggacuauuuucccgaaccugugacugugucuuggaacuccggggcucugacaucaggaguccacaccuucccagccguuuugcagagcaguggccucuacucucuguccagcgugguaacggugcccucgucuucccuggguacucagaccuauauuuguaaugucaaucauaagccuucaaacacaaaaguggauaagaaaguugagccaaag

SEQ ID NO: 24057 - RNA, 642 nt, Artificial Sequence
  derived and/or modified sequence opt3 from anti-HIV_4E10_LightChain
gagaucgugcugacccagagccccggcacacaaucccucucuccuggggaaagagccacucuuucaugcagggcuagucagagcgucggaaacaauaagcuggcaugguaccagcagcggccaggucaagccccgcgcuuguuaauuuauggcgcguccucucgacccucggggguugcugaccguuucucaggaagcggcagugguacggauuuuacccugacaauauccagacuagagccugaagacuucgccguguacuauugucagcaguacgggcagucucucagcacuuuuggacaaggcaccaaaguagaggugaagaggacagucgcagccccauccguguucaucuuucccccuucagaugaacagcugaaaaguggcaccgcuagcguugugugccuucugaacaauuucuauccacgggaggcaaagguccaguggaaaguggacaacgccuugcagucuggaaauucccaagagucaguaacugaacaggauagcaaggacaguacauacucucucuccagcacccugacgcugucgaaggcugauuaugagaaacacaagguuuacgccugugaagugacucaucaggggcucucuucccccgucaccaaaucauuuaaccgcggugag

SEQ ID NO: 24058 - RNA, 684 nt, Artificial Sequence
  derived and/or modified sequence opt3 from anti-HIV_4E10_HeavyChain
caggugcaacugguccagagcggcgccgagguuaagagacccggguccucugugaccguaucaugcaaagcuaguggagguagcuucuccacauacgcacucucuugggugaggcaggccccuggccgggggcuugaauggaugggaggcgucaucccacuguugacuauuacgaacuaugcgccgcgcuuucagggucgaauaaccaucacagcugaccguucgacuucaaccgccuacuuagagcugaauagccuaagacccgaagauacagcaguguauuacugugccagggaggggaccacuggauggggcuggcucggcaagccuauuggggcuuucgcacacuggggacaagguacacugguuaccgugaguuccgccucuacgaaaggcccaagcgucuuuccccuugcuccuuccucaaagaguacuagcgggggaaccgccgcgcugggcugcuuggugaaagacuauuucccagaacccguaacaguuucuuggaacuccggugcacucacuucaggggugcauaccuuuccugccguccugcagagcaguggacuguacucucucuccagcguggugacagucccaucgucuuccuuaggcacccagacguauaucuguaauguuaaccacaagccgucaaauacuaagguggauaaaaagguagagcccaaa

SEQ ID NO: 24059 - RNA, 312 nt, Artificial Sequence
  derived and/or modified sequence opt3 from anti-HIV_VRC01_LightChain
gaaaucgugcugacccagagccccggcacacucucccuuucuccuggggaaacugccauuauaucaugcagaacgagucaauacggaagccuggcuugguaucagcagaggccaggucaggcaccgcgguuggucaucuacuccggcucuacccgcgccgcggggauucccgaccgauucucgggaucacguuggggcccugauuauaacuuaacaaucagcaaucuggagaguggugacuuugggguuuacuauugucaacaguacgaguucuuuggacagggcacuaaggugcagguagauauuaaaaga

SEQ ID NO: 24060 - RNA, 363 nt, Artificial Sequence
  derived and/or modified sequence opt3 from anti-HIV_VRC01_HeavyChain
caggugcaacugguccagagcggcgggcagaugaagaaacccggagaguccaugagaaucucuugcagggccucagguuacgaguucauugacuguacccucaacuggauacggcuugcuccuggcaagcgcccagaauggaugggguggcugaaaccgcgaggaggcgcaguuaauuaugcccgucccuugcaggguagagugacaaugacuagggauguauacagugacacggcguuuuuagaacugcggagccuaaccguggaugacacagcugucuauuucugcacucgcgggaagaacugugauuacaauugggacuuugagcacuggggaagaggcaccccugugaucguuuccucu

SEQ ID NO: 24061 - RNA, 330 nt, Artificial Sequence
  derived and/or modified sequence opt3 from anti-HIV_PG9_LightChain
cagagcgcccugacccaacccgcuuccgugucuggcucaccugggcagaguaucacaauuagcugcaacggaacuuccaaugacgucgguggcuacgagucuguuucgugguaucagcagcacccagggaaggcaccgaaagugguaauauacgaugugucaaagagacccagcggagucaguaacagguucuccggcucuaaaagcgguaauacggccucccucaccaucucagggcuucaagcggaagacgagggagauuauuacuguaagagucugacaagcacucggcgccgaguguuuggcaccggcacaaaauugaccguuuua

SEQ ID NO: 24062 - RNA, 408 nt, Artificial Sequence
  derived and/or modified sequence opt3 from anti-HIV_PG9_HeavyChain
cagagacugguggagagcggcgggggagucguucaacccgguuccucucucaggcuuucaugcgccgcuaguggcuucgacuuuagccggcaggggaugcacugggugcgccaggcaccuggacagggccuggaauggguagccuucaucaaguacgaugguuccgagaaauaucaugcggacucugugugggggcgauugucgauuucacgugauaacagcaaggacaccuuauaccugcaaaugaauagucuaagagucgaagauacagcuacuuauuuuugugugagggaggccggaggcccagacuaccggaacggcuauaauuacuaugauuucuacgacggguacuauaacuaccacuauauggauguuuggggaaaagguacgaccgugacagucuccucu

SEQ ID NO: 24063 - RNA, 630 nt, Artificial Sequence
  derived and/or modified sequence opt3 from anti-HIV_VRC07_LightChain
gagaucgugcugacccagagccccggcacacucucccuuucuccuggggaaacugccauuauaucaugcagaacgagucaauacggaagccuggcuugguaucagcagaggccaggucaggcaccgcgguuggucaucuacuccggcucuacccgcgccgcggggauucccgaccgauucucgggaucacguuggggcccugauuauacauuaacuaucagcaaccuggagaguggugacuuugggguuuacuauugucaacaguacgaguucuuuggacagggcaccaaggugcagguagauauuaaaagaacaguggcugccccauccgucuucaucuuucccccuucugacgaacaacuaaagagcggcaccgcauccgugguuugccuccugaauaacuucuauccaagggaagccaaagugcaguggaaggucgauaaugcacuucagucagggaacagucaggagagcgugacugagcaagacucuaaagauuccacauacucacugagcaguaccuugacgcucucuaaggcugacuacgaaaagcacaaaguauaugccugugagguuacucaucagggacugcggucccccgugaccaagagcuuuaaucgcggugaaugc

SEQ ID NO: 24064 - RNA, 375 nt, Artificial Sequence
  derived and/or modified sequence opt3 from anti-HIV_VRC07_HeavyChain
caggugcaacugguccagagcggcgggcagaugaagaaacccggagaguccaugagaaucucuugcagggccucagguuacgaguucauugacuguacccucaacuggauacggcuugcuccuggcaagcgcccagaauggaugggguggcugaaaccgcgaggaggcgcaguuaauuaugcccgucccuugcaggguagagugacaaugacuagggauguauacagugacacggcguuuuuagaacugcggagccuaaccuccgaugacacagcuguguauuucugcacucgcgggaaguacuguaccgccagagauuauuacaacugggacuuugagcacuggggacaaggcacaccugucaucgugucuucg

SEQ ID NO: 24065 - RNA, 315 nt, Artificial Sequence
  derived and/or modified sequence opt3 from anti-HIV_3BNC117_LightChain
gacauccagaugacccaaagccccuccucucugucagccagugugggcgauacagucacuauuacgugccaggcuaacggguaccucaauugguaucagcagagaaggggaaaggcaccuaaacuucugauauacgacgguagcaaguuggaacggggcguuccaucccgcuucucugggcgacguuggggacaagaauauaacuuaaccaucaauaaccugcagccggaggauauugccacauacuuuugucagguguaugaguucguagugcccggcacuagacuagaccucaaaaggaccgucgcggcuccu

SEQ ID NO: 24066 - RNA, 387 nt, Artificial Sequence
  derived and/or modified sequence opt3 from anti-HIV_3BNC117_HeavyChain
caggugcaacugcuccagagcggcgccgcugucaccaagcccggggcauccguuagagugucuugcgaggccucaggauacaacaucagggacuauuucauucacugguggcggcaggcgccuggucagggccuucaauggguaggguggauaaauccaaaaacaggacagccgaacaauccccgccaguuucagggccgagugagucugacucgucaugcuagcugggauuucgacacguuuuccuucuacauggauuugaaggccuuaagaucugacgauaccgcagucuauuuuugugccaggcaacggucggacuacugggauuucgacgugugggguucagggacacagguuacugugagcagugcuuccaccaaaggaccu

SEQ ID NO: 24067 - RNA, 324 nt, Artificial Sequence
  derived and/or modified sequence opt3 from anti-HIV_10-1074_LightChain
agcuacgugagaccccuguccgucgcccucggcgagaccgcuaggaucucuugcgggcggcaggcacuuggaucacgcgccguucaaugguaucagcaccgaccuggucaggcgccaauucuguugauauacaacaaucaggaccguccgaguggcauccccgaaagauucagcgggacaccugauauuaacuuuggaacuagggcuacguuaaccaucuccggcguggaggccggugacgaagcagauuauuacugucauaugugggacucucggucgggguucucauggagcuuuggaggcgccacacgccugacuguacua

SEQ ID NO: 24068 - RNA, 396 nt, Artificial Sequence
  derived and/or modified sequence opt3 from anti-HIV_10-1074_HeavyChain
caggugcaacugcaggagagcggccccgggcucgucaagccuuccgaaacccuuucuguuacaugcucagugaguggagacagcaugaacaauuacuauuggacuuggaucagacaguccccagguaaaggccuggaguggauuggguacauaucugauagggaaucggccacguauaacccgucauugaauagccggguagugaucagucgcgacaccuccaagaaccaguuaucucugaaacuaaauagcgucacacccgcugauacugcaguguacuauugugccaccgcgcgacguggacaaagaauuuacggcguuguguccuucggugaguuuuucuauuacuacucaauggacgucugggggaagggaacaaccgugacuguaaguagc

SEQ ID NO: 24069 - RNA, 633 nt, Artificial Sequence
  derived and/or modified sequence opt3 from anti-HIV_PGT121_LightChain
agcgacaucuccguggcccccggcgagaccgcuagaauuucuugcggggaaaagucacugggaaguagggcaguccagugguaccaacaccgggccggucaggcgccuagccucauaaucuauaacaaucaggaucgcccauccggcauuccggagcgauucucugggucgcccgacucaccuuuuggaacaacugcuacgcuuaccaucacaagcguugaagccggcgaugaggcagacuacuauugucauauuugggauagucgugugccaacuaaauggguauucggugggggaaccacacugaccguguugggccagcccaaggccgcuccuuccgucacuuuauuuccacccucuagcgaagaacugcaagcaaacaaagccacccuagugugccucaucuccgacuucuacccuggcgcuguuacaguggccuggaaggcggauucaaguccagucaaagcagggguggagacgacuaccccgagcaagcagucuaauaacaaguaugccgcuuccucauaccugagccuuacacccgaacaguggaaaagucacaagucuuauuccugucagguaacucaugagggaagcaccguugagaaaacaguggccccuaccgagugcucg

SEQ ID NO: 24070 - RNA, 705 nt, Artificial Sequence
  derived and/or modified sequence opt3 from anti-HIV_PGT121_HeavyChain
cagaugcaacugcaggagagcggccccgggcucgugaagccuuccgaaacccuuucucugacaugcucagucaguggagccagcaucuccgacucuuacuggucguggauuagaaggucaccagguaaaggcuuggaguggauaggguauguucacaagagcggagauacuaacuacaguccguccuuaaaaucucgggugaaucugagccuagacacguccaagaaccagguaucacucagucugguggcugcaaccgccgcggauagcggcaaauauuacugugcucgcacacuucauggucgacguaucuaugggauugucgccuucaaugaaugguuuacuuacuucuauauggacguguggggaaacggcacccagguuacagugucuuccgcaucaaccaagggccccagcgucuuuccucuggccccaaguucuaaguccacuagcgggggaacagcugcauuggguugccucgugaaagauuacuuccccgagccuguaaccguuucguggaacucuggcgcccugacguccggggugcacacuuuuccagcuguccugcaaucaaguggacucuacagcuuauccucuguggugaccguccccagcucaagucugggcacacagacuuauaucuguaauguuaaucauaagccuuccaacaccaaaguggacaagagaguagaaccaaaaagcugc

SEQ ID NO: 24071 - RNA, 657 nt, Artificial Sequence
  derived and/or modified sequence opt3 from anti-HIV_PGDM1400_LightChain
gacuucgugcugacccagagcccccacucccucucugucacaccuggcgagucagccaguaucagcugcaaguccucucauucgcuuauucacggggaucggaacaauuaccuggcuugguauguucaaaaaccaggaaggucaccgcaguuguuaauauaccuggcaagcagucgggccuccggugugcccgaccgcuuuucuggcagcggguccgauaaggacuucacucuaaaaaucucacgaguagaaacggaggaugugggaaccuauuacuguaugcagggccgugaaaguccuuggacauuuggucaggggacuaaggucgacauuaaaagaaccguggcggcuccaagcguuuucaucuuucccccuucugaugagcaacucaaguccggaacagccucaguggucugccugcuuaacaauuucuauccaagggaagcaaaggugcaguggaaaguagacaacgcccugcagagcggcaauagucaggagucuguuaccgagcaagauuccaaggacagcacuuacucguugucuuccacacucacccugucaaaagcugauuaugaaaagcauaaaguguacgcaugugaggucacgcaccagggccugaguagccccgugacuaaguccuuuaacagaggggaaugc

SEQ ID NO: 24072 - RNA, 735 nt, Artificial Sequence
  derived and/or modified sequence opt3 from anti-HIV_PGDM1400_HeavyChain
caggcccaacuggugcagagcggccccgaggucagaaagccugggaccuccguuaaagugucuugcaaggcuccaggaaacacacucaaaacuuacgaccuucacuggguaaggucagugccgggucagggccugcaguggaugggguggaucagucaugaaggagauaagaaagucauuguggagcgguucaaggcaaagguuacgauagacugggaucgcagcaccaauacagccuauuugcaauuauccggccugacuucuggugacaccgcgguguacuauugugcuaaagggucgaagcaccgacuacgugauuacgcccucuaugacgaugacggagcacugaacugggccgucgauguggacuaccuuucaaaucuggaauuuuggggccagggcacagcuguaaccguuagcagugcauccacuaaagggcccucuguguucccuuuggccccaagcuccaagucaacaaguggagguaccgcugcccucggcugccuggucaaagauuauuuucccgagccugugacggugagcuggaacucuggggcgcugacuuccggaguccauaccuucccagcaguucuccagucaagcggcuuauacagucugucuuccgugguaacagugcccagcucgucucuugguacucagaccuacaucuguaaugucaaccacaagccuuccaauacaaagguggacaaaaagguugaaccaaaaucaugcgau

SEQ ID NO: 24073 - RNA, 630 nt, Artificial Sequence
  derived and/or modified sequence opt3 from anti-HIV_N6_LightChain
uacauccacgugacccagagccccuccucucugucagucaguauuggcgacagaguuacaauaaacugccaaacuagccagggggugggauccgaucuccauugguaucagcacaagccugguagggccccaaaacuucugauccaucacacgucuucgguagaggacggcgugccgucacgguucagcgggaguggauuucauaccuccuucaauuugacaauuucugauuuacaggcugacgauaucgcaacuuacuauugucaaguccugcaguuuuucggccgcgguagccgacuacacauuaagcguaccguggccgcgcccuccguuuuuaucuucccuccaucagacgaacagcucaaaagugggacagcuagcguggucugccugcuuaacaauuuuuaccccagagaggccaaggugcaguggaaaguagauaacgcacugcaaucuggaaauucccaggaaucaguuaccgagcaggacagcaaggauaguacuuauucuuuguccagcacacucacccugucgaaggccgacuacgaaaaacacaagguguaugcuugugaggucacgcaucagggccugucuuccccugugacuaaaucauucaacaggggcgagugc

SEQ ID NO: 24074 - RNA, 675 nt, Artificial Sequence
  derived and/or modified sequence opt3 from anti-HIV_N6_HeavyChain
agagcccaccuggugcagagcggcaccgcuaugaagaaacccggggcauccgucaggguuucuugccaaacaucaggauacacuuucacggcccauauccucuuuugguuccggcaggcgccuggucgcggccuugagugggugggguggauuaagccacaguauggagcuguaaacuuuggcgguggguuccgagaccgugugacccugacaagagaugucuacagggaaauagccuauauggacauccggggauugaaaccggaugacacugcaguguacuauugugcccgcgauagaaguuacggcgacagcuccugggcuuuagaugcauggggccaggggaccacaguuguggucucugccgcuucgaccaagggacccucaguguuuccucuggccccaagcaguaaauccacuucugguggcacagcggcacuagggugccucguaaaggacuauuuccccgagccuguuaccgugagcuggaacuccggagcccugacgucaggcguccacacuuuuccagcugugcuucaaaguagcggucuguacucuuuguccucaguggucaccguucccagcaguucucucgggacacagacuuacauuuguaaugugaaucauaagccuuccaacaccaaaguagauaagaaaguggaaccaaagagcugc

SEQ ID NO: 24075 - RNA, 1080 nt, Artificial Sequence
  derived and/or modified sequence opt3 from anti-HIV_N6_GChain
gccugggaggacgcugauaccacacuguucugcgcaagcgacgccaaggcguacuccacugaaaaacacaacgugugggcuacgcaugccuguguccccaccgauccugacccacaggagaucccgcucgaaaauguuacagagaacuuuaauauguggaagaacaauaugguggaacaaaugcacgaggauauuauaucucuuugggacgagucacugaaacccugcguaauguugacuggcgggaguaccaucaagcaggcauguccuaaagugacauucgaaccaauucccauccauuauugcgccccugcuggauuugcaauuuuaaaguguagagaugaggacuucaacgguaccggcccaugcaagaaugucagcacugugcaguguacacacgggaucaaacccguuguguccacccagcugcuacucaacggaucucuggccaagggcgauauagucaucaggucggaaaaucuuacgaacaaugcuaaagugauuaucguacaacugaacgagccuguucagauugugugcauccggccaaauaacggugggucaggaagcggcggcgacauacgccaggcccauuguaaugucacucgagggaagugggugaacauuaccaaaaacgugaaggagcaguuguggaagaucuuuaauaaaacaacuaacauuaccuucaauaacacaaucuuuaauaguccggcgggaggugaucucgaaaucaccacgcacuccuucaacugcggcggggaguuuuucuacuguaauacuucugaccuguuuaacgaaacaaaucugagcgcaaaccacaccgauacuaaugagaacauuacacuccaaugccguauaaagcagaucgucagaauguggcagaggguuggacaggccauguaugcucccccuauugccggcaauauaaccugcaucuccaacauuacggguuuacugcuuacccgggacggggugaaugacacacaugauaaagaaaacgagacuuuccgcccaaccggaggcgacaugagagauaacuggaggucagaguuguacaaguauaaaguaaucaagcugaaa

SEQ ID NO: 24076 - RNA, 645 nt, Artificial Sequence
  derived and/or modified sequence opt3 from anti-HIV_10E8_LightChain
agcuacgagcugacccaggaaacaggcguguccgucgcccucgggagaacuguuacgauuaccugcaggggagacucucuucggucacacuaugcuaguugguaccaaaagaaacccggucaggcaccuauccuguuguucuauggcaagaacaaucgcccaagcggggugccggaucgauuuuccggaucugccucgggcaaccgugcgucauuaacaauaagcggugcucaggccgaggacgaugcagaauacuauuguaguuccagagacaaaucugggagcaggcuguccguauucggaggcggcacuaagcuaaccgugcucucacagcccaaagccgcuccuagugucacacuguuuccacccagcucugaggaacuucaagcaaauaaggccacccuggugugcuugaucuccgauuucuacccuggggcuguuacuguggccuggaaggcggacucaagcccagucaaagcaggaguggagacaaccacgcccaguaagcagucuaacaauaaauaugccgcuuccagcuaccucucgcugacuccugagcaguggaagucucaucgguccuacucaugucagguaacccacgaagguaguacaguugagaaaacuguggccccaaccgaaugcagc

SEQ ID NO: 24077 - RNA, 708 nt, Artificial Sequence
  derived and/or modified sequence opt3 from anti-HIV_10E8_HeavyChain
gaggugcagcuggucgaaagcggcgggggacucguuaagcccgguggcucccuuagacugucuugcucagccaguggguucgacuuugauaacgcuuggaugaccugggugaggcaaccuccaggaaaaggcuuggaguggguaggucggaucacagggccgggagaaggcuggagcguggacuacgcagcccccgucgagggccgcuucacuauuucccgauuaaauucuauaaacuuucuguaucuagaaaugaauaaccuccguauggaggauucggggcuguacuucugugcgagaacgggaaaguauuacgacuuuuggucagguuauccuccaggcgaggaauacuuccaggauugggggaggggaacccuugugacaguuagcagugcuuccacuaaaggccccucuguguuuccucuggccccaagcuccaagucaaccaguggugggacagcagccuugggaugccucgucaaagacuauuuccccgagccugugaccguaagcuggaacucuggcgcucugacuuccggcguucacacauuuccagcagugcugcagucaagcgggcucuacaguuuaucuuccgucgugaccgugccgagcucgucucugggaacgcagacuuacaucuguaaugucaaucauaagcccuccaacaccaagguugauaaacggguggaaccuaagucaugcgacaaa

SEQ ID NO: 24078 - RNA, 333 nt, Artificial Sequence
  derived and/or modified sequence opt3 from anti-HIV_12A12_LightChain
gacauccagaugacccaaagccccuccucucugucagccagugugggcgauagagucacaauuacuugccaggcugggcagggaauagguagcucccuccagugguaccaacagaagccuggcaaagcaccaaaacuucugguucacggggccucuaacuugcauaggggagugccgucgcgguucucaggcagcgguuuucacacgaccuucaguuuaacaaucuccgggcugcagcgcgacgauuuugcgacuuauuucugugcuguacuagaguuuuucggacccggcaccaagguggaaauuaagcgaacagucgccgcaccuucugug

SEQ ID NO: 24079 - RNA, 381 nt, Artificial Sequence
  derived and/or modified sequence opt3 from anti-HIV_12A12_HeavyChain
agccagcaccuggugcaauccggcacccaggucaagaaacccggggccucuguuagaaucucaugccaggcuaguggauacagcuucacagacuaugugcuccauugguggaggcaggcaccuggucaaggccuugaguggaugggguggauuaagccaguauacggagcccggaacuaugcgcgccgauuucagggccguauaaauuucgauagagacaucuacagggaaauugcuuuuauggaucuguccgguuugcggucugacgauacugccuuauauuucugugcacgcgacgggucgggagaugacacgucauggcaccuggauccguggggccagggcacccuagugaucgucagcgccgcuaguacaaaaggg

SEQ ID NO: 24080 - RNA, 315 nt, Artificial Sequence
  derived and/or modified sequence opt3 from anti-HIV_12A21_LightChain
gacauccagaugacccaaagccccuccucucugucagccagugugggcgauagagucacaauuaacugccaggcugggcagggaauagguagcucccucaauugguaccagaagaaaccuggcagggcaccaaaacuucugguucacggggccucuaacuugcaacggggagugccgucgcgcuucucaggcagcgguuuucauacuacguucaccuuaacaaucaguucccugcagcccgacgauguagcgacuuauuuuugugcuguguuccagugguuugggccuggaaccaaggucgacauuaagcgaaca

SEQ ID NO: 24081 - RNA, 384 nt, Artificial Sequence
  derived and/or modified sequence opt3 from anti-HIV_12A21_HeavyChain
agccagcaccuggugcaauccggcacccaggucaagaaacccggggccucuguuagagugucaugccaggcuaguggauacacauucacuaacuauauccuccauugguggaggcaggcaccuggucaaggccuugaguggauggggcugauuaagccaguauuuggagccgugaauuacgcgcggcaguuccagggccgcauacaguugacgcgagacaucuaucgugaaauugcuuuucuggaucugagcggucuaagauccgacgauaccgccgucuacuauugugcaagggacgagucuggggaugaccucaaauggcacuuacauccguggggacaaggcacacaggugaucguuucgcccgccucaacuaagggcccu

SEQ ID NO: 24082 - RNA, 648 nt, Artificial Sequence
  derived and/or modified sequence opt3 from anti-HIV_35022_LightChain
cagagcgugcugacccaauccgccucugucucaggcagucucgggcagagcguuacaaucuccugcacuggacccaacucuguguguugcucgcacaagucaauuagcugguaccaguggccuccagguagagcuccgacgcuuauaaucuaugaggacaaugaaagggcacccggcauuaguccucgguucuccggguacaaaucuuauuggagcgccuaccugaccaucuccgauuugcgcccagaggacgaaacaacuuauuacuguugcucauauacccauaacaguggauguguauuuggcacagguaccaaggugagcgucuuagggcagucuaaagcgaaucccuccgugacucuguucccuccaucaagcgaggaacuacaagcuaacaaggccacacucguuugccugauuagugauuuuuaccccggagcagugaccgucgccuggaaagcugacucuuccccugugaaggcaggcguagagacgacuaccccaagcaagcagucgaauaacaaauacgccgcuucuuccuaucuuucacugacaccggagcaguggaagagucaccgaagcuacuccugucagguuacucaugaaggcucuaccguggagaaaacagucgcccccaccgaaugcagc

SEQ ID NO: 24083 - RNA, 729 nt, Artificial Sequence
  derived and/or modified sequence opt3 from anti-HIV_35022_HeavyChain
gagggccagcuggugcaaagcggggccgaacucaagaaacccggagcuuccgucaagaucucuugcaaaaccucagguuacagauucaacuuuuaucacauuaauuggauaaggcagacagcaggccgggggccugaguggaugggauggaucaguccauacagcggcgacaagaaccuugccccggcguuccaggaucgcguuauuaugacuacggacaccgaagugcccguaacauccuuuacuucuaccggugcugccuauauggagauccgaaaucugaaauucgaugacacagggaccuacuuuugugcaaagggauuguuacgugauggcucgucaacuuggcugccuuaucuauggggccaggggacacuccugaccgugagcagugccuccacgaagggaccaucugucuucccccuugcuccuagcuccaaaucaaccagugguggcacugcagcccuggggugcuuggugaaggacuacuuuccagaacccguuacagugagcuggaacucuggagcucucacuuccggcguccauaccuucccugccgugcugcaaucaagcggucuguauagucucucuuccguaguuacagugccaagcucgucuuuagggacccagacguacauuuguaaugucaaccacaaaccguccaauacuaagguggauaaaagaguggagcccaagucaugcgacaagggacuggagguccuuuuucag

SEQ ID NO: 24084 - RNA, 648 nt, Artificial Sequence
  derived and/or modified sequence opt3 from anti-HIV_3BC176_LightChain
cagagcgugcugacccaacccgccuccgucucugcuucaccuggccagaguaucacaguuagcugcacuggguccagaaacgacgugggagguuacgauuucguaucuugguaucagaggcacccaggcggggugccgaagcucauuauauacgagaucucgaaacggcccucaggcauuccucagcgcuuuagcggaagucgauccgguaauacggcaucucuuaccaucagcgggcugcaagacgaugacgaagccgauuauuacuguugcuccuaugcgucauacgaccguuugauuuucggaggcggcacaagagucaguguguuaaggcagccaaaggcugcccccagcguuacucuguuuccuccaucuuccgaggaacuacaggcaaacaaagccacccucgugugucugaucucagauuucuaucccggggcugucacaguggcauggaaggccgacggaagcccuguaaaagcugguguugagaccacuaagccaaguaagcagucuaauaacaaauacgccgcguccagcuaccuuucgcugacaccggaacaauggaagucucaucgguccuauucaugccaggugacccacgagggcaguacggucgagaaaacuguggcacccaccgaauguagc

SEQ ID NO: 24085 - RNA, 699 nt, Artificial Sequence
  derived and/or modified sequence opt3 from anti-HIV_3BC176_HeavyChain
gaacaggugcaacugaugcagagcggcgcccagcucagagaccccggggauucccuuaagaucucuugcaaggcuucaggauacaacuucauugacuaucacauacauugggucaggcuggcaccuggucggggcuuggaguggaugggguggaucgauccaguuggaggcauuaccaaauacgccggucaguuucaagggcgcuuaagucugacacgagacacuagcacgaauacccuauuccucgagcugucccgucuuacagcgggagauacugcuguguauuuuugugccagaucuaugaggccgguagaccacggcaucgauuacucgggccuguucguguuucauuucugggggcggggaucagacgucuuggugagcagugcauccaccaaaggucccucuguuuuuccucucgccccaagcuccaagucaacaaguggcgggaccgcugcacugggaugccuggugaaagauuauuuccccgaaccugucacugugagcuggaacucuggcgcccucacauccgguguacacaccuuuccagcuguuuuacagucaagcgggcuguacagucuuucuuccguggucacggugcccagcucgucuuugggaacucagaccuauauuuguaaugugaaccauaagccuuccaauacaaaggucgacaaaaagguugagccaaaaucaugcgau

SEQ ID NO: 24086 - RNA, 621 nt, Artificial Sequence
  derived and/or modified sequence opt3 from anti-HIV_3BNC55_LightChain
gacauccagaugacccaaagccccuccucucugucagccagugugggcgauaaggucacaauuacuugccagacgagcgcuggguaccucaacugguaucagcagagaaggggacgggcaccuaaacuucugauguacgacgguucccgcuugguuaccggcgugccaucucgauucucggggcguagauggggaacacaauauaauuuaacuauaggcucacugcagccggaggauaucgccaccuacuauugucagguauacgaauuuuucggucccgggacaaggcuagaccucaagcggaccguggcggcuccuagcgucuuuauuuucccacccagugaugagcagcugaaauccggaacugccucugugguuugccuucugaacaauuuuuauccucgcgaagcaaaggugcaauggaaagucgacaacgccuugcagagcggcaauucccaggagucagugacagaacaggauaguaaggacagcaccuacucucucuccucaacgcugacucugagcaaggcugauuacgagaaacacaagguauaugcaugugagguuacccaucaaggccucaguucuccagugacaaaauccuucaacagaggggaaugc

SEQ ID NO: 24087 - RNA, 675 nt, Artificial Sequence
  derived and/or modified sequence opt3 from anti-HIV_3BNC55_HeavyChain
caggugcaacugguccagagcggcaccgccguuaagagacccggggcuuccgugaggguaucuugccaggcaucaggauacacauucacugacuauuuuaucuacugguggcggcaggccccuggucaaggccucgaguggcuuggguggauuaacccacugacgagucagccgagcuaucccucccgcuuccagggacgauugaccuuaacacgugauacuuuugacgaaaugcuguacauggaucuaagaggccucaggucugacgauaccgguauauauuucugugcgcggcgccacucggacuacugcgauuuugacaucugggggucaggaacacagauuaucgugagcagugcuuccaccaaaggcccuucugucuucccacuggcccccagcuccaagucaacuucuggcgggacagcagcccuuggaugucuggugaaagauuauuuuccugagccaguuaccgugagcuggaauaguggugcuuugacguccggcguccauacuuuccccgcagugcuccaaucaagcgggcuguacagucugucuuccguaguuaccgugccuagcucgucucucggaacacagacuuacauuugcaacgucaaucacaagccauccaacaccaaaguggacaagagaguggaaccgaagucaugugauaaaaca

SEQ ID NO: 24088 - RNA, 618 nt, Artificial Sequence
  derived and/or modified sequence opt3 from anti-HIV_3BNC60_LightChain
gacauccagaugacccaaagccccuccucucugucagccagagugggcgauacagucacuauuacgugccaggcuaacggguaccucaauugguaucagcagaggcggggaaaggcaccuaaacuucugauauacgacgguaguaaguuggagcgcggcguuccagcccgauucagcgggcguagauggggacaagaauauaacuuaaccaucaauaaccugcagccggaggauguggcgacauacuuuugucagguauaugaguucauugugcccggcacuaggcuagaccucaaacggaccgucgcugccccuuccguguuuaucuucccacccucugaugaacagcugaagucggguacagcaucaguugugugccuucugaauaacuuuuacccucgcgaagccaaaguccaauggaagguggacaaugcuuugcagagcgggaacagucaggaguccguaaccgagcaggauucuaaggacagcacuuauucccucucaaguacacugacccugagcaaagcagauuacgaaaagcacaaaguuuacgccugugaggugacgcaucaaggacucucuuccccagucacuaagucauucaauagaggcgaaugc

SEQ ID NO: 24089 - RNA, 687 nt, Artificial Sequence
  derived and/or modified sequence opt3 from anti-HIV_3BNC60_HeavyChain
caggugcaccugagccaauccggcgccgcugucaccaagcccggggcaucuguuagagugucaugcgaggccaguggauacaaaaucagcgaccauuucauucacugguggaggcaggcgccuggucagggccuccaguggguaggguggauaaacccaaagacaggacaaccgaauaacccccggcaguuucagggccgcgugucccuuacucgacaggcuucuugggauuucgacacguauucguuuuacauggaucugaaagccguccguucagacgauaccgcaaucuauuucugugccagacaaaggagcgacuuuugggauuucgacgugugggguagugggacacagguuacuguguccucugcuagcaccaagggaccuuccgucuuuccauuggcacccucaaguaaaagcacaucuggcggcaccgccgcuuuagggugccuggugaaggauuacuucccugaaccaguaacuguuuccuggaacucaggagcccuaacaagcggugugcauaccuuucccgcgguccuccagaguucuggccuguauucccuuagcucgguggugacggucccuucuuccucacuggggacucagaccuacauuuguaauguuaaucacaagccaaguaacacaaaaguggacaagcggguagagccgaaaagcugcgauaagacu

SEQ ID NO: 24090 - RNA, 687 nt, Artificial Sequence
  derived and/or modified sequence opt3 from anti-HIV_3BNC60_HeavyChain
gaggugcaccugagccaguccggcgccgcugucaccaagcccggggcaucuguuagagugucaugcgaagccaguggauacaaaaucagcgaccauuucauucacugguggaggcaagcgccuggucagggccuccaguggguaggguggauaaacccaaagacaggacagccgaauaacgcucggcaauuucagggccgcgugucccuuacucgacaggccucuugggauuucgacacguauucguuuuacauggaucugaaagcaguccguucagacgauaccgccaucuauuucugugcuagacagaggagcgacuuuugggauuucgacgugugggguagugggacacaaguuacuguguccucugcaagcaccaagggacccuccgucuuuccuuuggccccaucaaguaaaagcacaucuggcggcaccgcugccuuagggugccuggugaaggauuacuuccccgagccuguaacuguuuccuggaacucaggagcgcuaacaagcggugugcauaccuuuccagcaguccuccagaguucuggccuguauucccuuagcucgguggugacgguccccucuuccucacuggggacucagaccuacauuuguaauguuaaucacaagccuaguaacacaaaaguggacaagcggguagaaccaaaaagcugcgauaagacu

SEQ ID NO: 24091 - RNA, 648 nt, Artificial Sequence
  derived and/or modified sequence opt3 from anti-HIV_447-52D_LightChain
cagagcgugcugacccaacccccuuccgucucugccgcuccaggccagaagguuacaaucucaugcagugggagcuccucuaacauuggaaauaacuacgugcucugguaucagcaguucccggguacugcacccaaacuucugauauacggcaauaacaagagaccuucggggaucccagacagguuuucaggaagcaaaaguggcacguccgccaccuuggguauuacaggguuacaaacuggagaugaggcggacuauuucugugcuaccugggauucuggccugagcgccgacuggguauuuggcgggggaacaaagcuaaccgugcucucccagcccaaagcagccccuucagucacucuguucccacccaguagcgaggaacuucaggcuaauaaggcaacacuggugugcuugaucucugauuuuuacccuggugccguuaccguggcuuggaaggccgacuccucaccagucaaagcgggcguggaaacgacuaccccgagcaagcagaguaacaauaaauaugcagccucuuccuaccucagccugacacccgagcaauggaagucgcaccggucuuauuccugucagguaacucaugaagggucaaccguugagaaaacaguggcuccuaccgagugc

SEQ ID NO: 24092 - RNA, 693 nt, Artificial Sequence
  derived and/or modified sequence opt3 from anti-HIV_447-52D_HeavyChain
gaggugcagcuggucgaaagcggcgggggacucguuaagcccgguggcucccuuagacugaccugcguggccucuggguucacauuuucagacguaugguugaacugggugaggcaagcuccuggaaaaggcuuagagugggucggucggaucaagagucgcacugaugggggaacgaccgacuacgcagccagcgugaaaggccgauucacaauuucccgugaugacucuaagaauacucuguaucuacagaugaacucgcucaaaaccgaagauacagcgguuuacucauguaccacugacggcuuuauaaugaucagaggggugagcgaggauuauuacuauuacuauauggacgucuggggaaaggguacaaccgugacgguaaguuccgcuucuacuaagggcccaagcguuuucccgcuggcccccugcuccaggucaaccagugggggaacagcagcccuuggcugucuggugaaagauuacuuuccugaaccagucacugugagcuggaacucuggugcuuugaccuccggggugcacacauuccccgcaguccuccagucaagcggacuguacagucugucuuccguugugaccguaccuagcucgucucucggcacgcagacuuauacaugcaaugugaaucauaagccauccaacaccaaagucgacaagcggguggaguua

SEQ ID NO: 24093 - RNA, 645 nt, Artificial Sequence
  derived and/or modified sequence opt3 from anti-HIV_447-52D_LightChain
cagagcgugcugacccaacccccuuccgucucugccgcuccaggccagaagguuacaaucucaugcagugggagcuccucuaacauuggaaauaacuacgugcucugguaucagcaguucccggguacugcacccaaacuucugauauacggcaauaacaagagaccuucggggaucccagacagguuuucaggaagcaaaaguggcacguccgccaccuuggguauuacaggguuacaaacuggagaugaggcggacuauuucugugcuaccugggauucuggccugagcgccgacuggguauuuggcgggggaacaaagcuaaccgugcucucccagcccaaagcagccccuucagucacucuguucccacccaguagcgaggaacuucaggcuaauaaggcaacacuggugugcuugaucucugauuuuuacccuggugccguuaccguggcuuggaaggccgacuccucaccagucaaagcgggcguggaaacgacuaccccgagcaagcagaguaacaauaaauaugcagccucuuccuaccucagccugacacccgagcaauggaagucgcaccggucuuauuccugucagguaacucaugaagggucaaccguugagaaaacaguggcuccuaccgag

SEQ ID NO: 24094 - RNA, 705 nt, Artificial Sequence
  derived and/or modified sequence opt3 from anti-HIV_447-52D_HeavyChain
gaggugcagcuggucgaaagcggcgggggacucguuaagcccgguggcucccuuagacugaccugcguggccucuggguucacauuuucagacguaugguugaacugggugaggcaagcuccuggaaaaggcuuagagugggucggucggaucaagagucgcacugaugggggaacgaccgacuacgcagccagcgugaaaggccgauucacaauuucccgugaugacucuaagaauacucuguaucuacagaugaacucgcucaaaaccgaagauacagcgguuuacucauguaccacugacggcuuuauaaugaucagaggggugagcgaggauuauuacuauuacuauauggacgucuggggaaaggguacaaccgugacgguaaguuccgcuucuacuaagggcccaagcguuuucccgcuggcccccugcuccaggucaaccagugggggaacagcagcccuuggcugucuggugaaagauuacuuuccugaaccagucacugugagcuggaacucuggugcuuugaccuccggggugcacacauuccccgcaguccuccagucaagcggacuguacagucugucuuccguugugaccguaccuagcucgucucucggcacgcagacuuauacaugcaaugugaaucauaagccauccaacaccaaagucgacaagcggguggaguuaaaaacucccaca

SEQ ID NO: 24095 - RNA, 624 nt, Artificial Sequence
  derived and/or modified sequence opt3 from anti-HIV_5H/I1-BMV-D5_LightChain
gacauccagaugacccaaagccccuccacacugucugccucaauuggcgauagagugacuauaacgugcagggcuagugaggggaucuaccacuggcucgcaugguaucagcagaagccuggaaaagccccaaaacuucugauuuacaaggcgagcuccuuggcuucuggugccccgucgcgguucucaggcagcgggaguggaaccgacuuuacauuaacuaucuccucucugcagcccgaugacuucgcaaccuauuacugucaacaguauagcaacuacccucuaacauuuggcggugggaccaagcucgaaauuaaacgcacugucgccgcuccauccguuuucaucuuucccccuucagaugagcagcugaagaguggaacagcaagcgugguaugccuucugaauaacuucuauccacgagaagccaaggugcaguggaaagucgacaaugcuuugcaaucuggcaacucccaggagucagugaccgaacaggauagcaaggacaguacguacucucucuccagcacucugacccugucgaaagccgauuacgagaagcauaaaguuuaugcgugugaggugacacaccagggccucucuucccccgucacuaaguca

SEQ ID NO: 24096 - RNA, 651 nt, Artificial Sequence
  derived and/or modified sequence opt3 from anti-HIV_5H/I1-BMV-D5_HeavyChain
caggugcaacugguccagagcggcgccgagguuagaaagcccggggcuuccgugaaaguaucuugcaaggcaucaggagacaccuucaguagcuacgccaucuccugggugaggcaggcgccuggucagggccucgaauggaugggagggauuauaccaaucuuuggcacagcuaacuaugcccaagcauuccagggucgggucacuauuacggccaaugagucuaccucgacagcuuacauggaacuuucaagccugcgcagugaggauacugcaaucuauuacugugcccgagacaacccgaccuuguuaggguccgauuauuggggagcuggcacacuggugaccguuucuagcgccuccacuaaaggccccucaguguuuccucuagcgccaugcagucguagcacaucugggggaaccgcagcccucgguugucuggucaaggacuacuuccccgaaccugugacgguauccuggaacucaggcgcucuuacuagcgggguucacaccuuuccagccgugcugcagaguucuggauuguauucccucagcucggucgugacagugcccucuuccucacugggcacucagaccuacauuugcaaugucaaucauaaaccuaguaacacaaagguugauaagagagug

SEQ ID NO: 24097 - RNA, 657 nt, Artificial Sequence
  derived and/or modified sequence opt3 from anti-HIV_5H/I1-BMV-D5_A-Chain
augcagcugcucagcggcaucgugcaacagcagaacaaucuucugagagccauugaggcucagcaacacuuguuacagcugaccgucugggggauaaagcagcuacaggcaaggauccucgccggagguuccggcgggcauacaacuuggauggaaugggaccgggagauuaacaauuacacgucucugauccacucacuuauugaagagagucaaaaccagcaggagaaaaaugaacaggagcuguuggaaggaagcuccggcggucaacuccugucugggaucguucagcagcaaaacaaucugcuccgcgcgauagaggcucagcagcauuuacugcagcuuaccguguggggaaucaagcaauugcaggcccguauucuggcaggcggcucagggggacacacaacuuggauggaaugggaucgagagaucaacaauuauaccucgcuaauucauagccucaucgaggaaagucagaaccagcaagagaaaaaugaacaggagcugcuugaagguuccucuggcgggcagcuguugagcggaauaguacagcaacagaacaaucuccugagagccauugaggcucagcagcacuuacugcaacucacaguguggggcaucaagcagcuucaggcaaggauucuggccgguggg

SEQ ID NO: 24098 - RNA, 390 nt, Artificial Sequence
  derived and/or modified sequence opt3 from anti-HIV_8ANC195_LightChain
gacauccagaugacccaaagccccuccacacugucugccucaauuggcgauacugugagaauaaguugcagggcuagccaguccaucacggggaacugggucgcaugguaccagcagcggccuggaaaggccccacgccuccuuauuuaucgaggugcggcucuguugggcgggguuccgucucguuucucgggaucagccgcaggcaccgacuuuacauuaacuaucgguaaucugcaagccgaggauuucgggaccuuuuacugucagcaguaugacacauaccccggaaccuucggccagggcacuaaaguggaaguaaagagaacaguggcugcaccuagcgucuuuauuuucccacccagugaugagcaacuaaaauccgggacc

SEQ ID NO: 24099 - RNA, 423 nt, Artificial Sequence
  derived and/or modified sequence opt3 from anti-HIV_8ANC195_HeavyChain
cagauccaccuggugcaaagcggcaccgaggucaagaaacccggguccucuguuacagugucaugcaaggccuacggaguaaacacuuucggucucuaugcugugaauugggucagacaggcaccuggccagagucuugaauacauugggcagauauggagguggaaaagcuccgccucucaucacuuucggggacgcgugcugaucucggcgguugacuugacgggcucaagcccaccgauuaguuccuuagagaucaagaaccugaccucugaugacacagcuguguauuucuguacuaccacaagcaccuacgauaaaugguccggucuacaucacgacggggucauggccuuuucaaguuggggacaaggcacucucauuagcgugucugcagccuccacaaagggccccucaguauuc

SEQ ID NO: 24100 - RNA, 333 nt, Artificial Sequence
  derived and/or modified sequence opt3 from anti-HIV_CAP256-VRC26.01_LightChain
cagagcgugcugacccaacccccuuccgucucugccgcuccaggccagaagguuacaaucucaugcagugggagcuccucuacuauuggaaacaauuacgugucgugguauagacuccuuccggguacggcacccaaacuguugauauacaagaacgacaauaggccuucaggcaucccagaucgguucagcgggaguaaauccggaaccucugccacauuaggcauuagcggucugcagacuggggacgaggcggauuauuacuguggaaccugggacacaucccuaucaggcggcgggguauuuggaaccgguacuaaggugacaguccuc

SEQ ID NO: 24101 - RNA, 432 nt, Artificial Sequence
  derived and/or modified sequence opt3 from anti-HIV_CAP256-VRC26.01_HeavyChain
gaggugcaggucguugaaagcggcgggggagugguacaacccgguagaucccugaggcucucuugcaccgccucaggcuucacauuuaguaacuucgcuauggggugggugcggcaggcaccuggaaagggccuugagugggucgccuuuaucagcuccgacgguucuaauaaaaacuacggggauucggugaagggacgcuucacuauuucacgagacaauagcaaaaacacgguuuuucugcagaugaauaguuugcguguggaagauaccgcguuauauuacugugcuaaggacgucggcgauuauaaauccgacgaguggggcacagaauacuaugauauaucuaucagcuacccaauucaggacccgagagccauggugggggcauucgaucuguggggacaagguacuaugguaaccguuuccccc

SEQ ID NO: 24102 - RNA, 324 nt, Artificial Sequence
  derived and/or modified sequence opt3 from anti-HIV_CAP256-VRC26.02_LightChain
cagagcgugcugacccaacccccuuccgucucugccgcuccaggccagaagguuacaaucucaugcagugggagcaacuccaauauuggaaacaaagacgugucuugguaccagcagauaccggcaacugcccccaagcuccuuaucuaugagaauaacaaaagaccuucggguauuucagauagguucagcggcaguaaguccgggacgucugcgacccuggcuaucacaggauugcaaacuggcgacgaagccgauuacuauugugcaaccugggacggucggguaagcgugauugggacaggaaccaaugucaucguguua

SEQ ID NO: 24103 - RNA, 432 nt, Artificial Sequence
  derived and/or modified sequence opt3 from anti-HIV_CAP256-VRC26.02_HeavyChain
gaggugcagcuggucgaaagcggcgggggaguugugcaacccgguagaucccucaggcuuucuugcgccgcuucacaguucaguuuuggcaacuacgggaugcacuggguacggcaggcaccuggaaagggccuggaguggguggccgcgaucagcuucgcugguaccaaaacaaauuaugccgacuccgucaaggggcgcuuuacuauuucucgagauaacucgaaaaauacgguguacuugcagaugaacucauuacgugcagaagacaccgcccuguauuucugugcuaaggauauaagagaguacgaaugcgaguauuggacaagcgacuacuaugauuuuggaaggccacaaccguguaucgacagucggggcguugugggcacuuucgaugucugggggcagggaaccauggugacaguauccucu

SEQ ID NO: 24104 - RNA, 333 nt, Artificial Sequence
  derived and/or modified sequence opt3 from anti-HIV_CAP256-VRC26.03_LightChain
cagagcgugcugacccaacccccuuccgucucugccgcuccaggccagaagguuacaaucucaugcagugggagcuccucuaacauuggaaauaacuucgugucgugguaccagcagagaccggguacugcacccaaaauacucaucuaugagaauaacaagaggccuucagaaacgccagaccgguuuagcggcaguaaauccgggaccucugccacacuugcgauuacuggacugcaaaccgcugaugaggccgaauacuauugugcaacauggagcgccuccuugucaagugcucgcguauucggcaccgguacucgaaucacaguguua

SEQ ID NO: 24105 - RNA, 432 nt, Artificial Sequence
  derived and/or modified sequence opt3 from anti-HIV_CAP256-VRC26.03_HeavyChain
gaggugcagcuggucgaaagcggcgggggaguugugcaacccgguaagucccucagacuuucuugcgccgcuucaagguucaguuuuaaccgguacggcaugcacuggguacgccaggcaccugggaaaggacuggaguggguggccgcgaucagcuaugacggcaccgauaaguaccaugcugacaaagucuggggucgauucacaauuucccgugauaauucuaagaacacuuuguauuuacagaugaauagccugagagccgaagacacggcacuauacuauugugccaaagaucucagggaggacgaaugcgaggagugguggucagauuacuaugacuuugggaagcagcugccaugucggaagucgcgcggaguggcuggcauauucgauggcugggggcaaggaaccaugguuacagugaguucc

SEQ ID NO: 24106 - RNA, 333 nt, Artificial Sequence
  derived and/or modified sequence opt3 from anti-HIV_CAP256-VRC26.04_LightChain
cagcccgugcugacccaaccuccaagcgucuccgccgcuccgggccagaagguuacaaucucuugcucagggaguagcuccaacauuggaaauaacuucgugucuugguaccagcagagacccgguacugcaccuucgcuccuuauauaugagacgaauaaaaggccaucaggcauccccgaccgguuuagcgggaguaaguccgccaccucugcgacacuggcuauuacuggauugcaaaccggcgaugaagccgacuacuauugugcaacaugggccgcuagcuuaaccuccgcacgcguauucgguacugggacaaaagugaucgucuca

SEQ ID NO: 24107 - RNA, 432 nt, Artificial Sequence
  derived and/or modified sequence opt3 from anti-HIV_CAP256-VRC26.04_HeavyChain
gaggugcagcuggucgaaagcggcgggggaguugugcaacccgguaagucccucagacuuucuugcgccgcuucacaguucaguuuuaacagguacggcaugcacuggguacggcaggcaccugggaaaggacuggaguggguggccgcgaucagcuaugacggcaccgauaaguaccaugcugacaaagucuggggucgcuucacaauuucccgagauaauucuaagaacacuuuguauuuacagaugaauagccugcgugccgaagacacggcacuauacuauugugccaaagaucucagagaggacgaaugcgaggagugguggucagauuacuaugacuuugggaagcaacugccauguaggaagucgcggggaguggcuggcauauucgauaaauggggccaggggaccaugguuaucgugaguucc

SEQ ID NO: 24108 - RNA, 324 nt, Artificial Sequence
  derived and/or modified sequence opt3 from anti-HIV_CAP256-VRC26.05_LightChain
cagagcgcccugacccaacccccuuccgugucugcugcaccaggccagaaggucacaaucucaugcagugggaacauuggaaauaacuacguuagcugguaucaacaggugccggguacugcccccaaacuccuuauauacgagaauaacaagagaccuuccggcaucccagacagguucucugggucgaaaucaggaacgagcgcgacccugguaauuacaggcuugcagacuggugaugaagcugacuuuuauugugggaccuggggaggcaguuuacggacaggcggggugcugggaaccgguacucgcgucacagugcua

SEQ ID NO: 24109 - RNA, 432 nt, Artificial Sequence
  derived and/or modified sequence opt3 from anti-HIV_CAP256-VRC26.05_HeavyChain
gaggugcagcuggucgaaagcggcgggggaguugugcaacccgguagaucccucaggcuuucuugcgccgcuucacacuucagucugagcuccuacggcaugcauuggguacggcaggcaccugggaagggauuggagugggugaccggcaucucuuuugccgguacaaaaacuuauuacggggacucgguccgcggacgauucacggugucacgugauauuagcaagaacaccuuauuucugcagaugaauagucuaagaccagacgauacagcgauguauuacugugcuagggaccagcgguauuacgaaugcgaggaaugggccuccgauuauuacgacuucggccgcgagcaaccgugucucgaucccagaggcguuguggggauauuugaccuguggggacaggguacuauggucaccgugucuagc

SEQ ID NO: 24110 - RNA, 324 nt, Artificial Sequence
  derived and/or modified sequence opt3 from anti-HIV_CAP256-VRC26.06_LightChain
cagagcgugcugacccaacccccuuccgucucugccgcuccaggccagaagguuacaaucucaugcagugggagcacuuccaaaauuggacagaacucugugucgugguaccagcaacucccggguacggcacccaaacuucugauauaugagaaugacagaaggccuucaggcaccccagaucgguucagcgggaguaaguccggaacaucugccacuuuggcgaucaccggcuuacagacaggugacgaagcugaguacuauugugaaaccugggaugggagcggaggcguauuuggcacugggacaaaggugaccguccug

SEQ ID NO: 24111 - RNA, 435 nt, Artificial Sequence
  derived and/or modified sequence opt3 from anti-HIV_CAP256-VRC26.06_HeavyChain
gaggugcagcugaucgaaagcggcgggggagucguucaacccgguagaucccucaggcuuucuugcggcgccucaggguucaguuuuaacaauuacggaaugcacugggugcggcaggcuccuggcaagggucuggaguggguagcagggauuagcuucgccggaaucaaaaaguauuacggcaccuccgugaaaggccgcuuuacaauaucucgagacaacucgaagaauaacuucuauuugcagaugaacucauuacgugucgaagauacugcgcuguacuauugugcuagagaccuaagggagcucgaaugcgaggaguggacgcuguacaauuauuacgauuuugggagccggggaccauguguggacccgcgcgguguugccggcaguuucgaugugugggggcagggaaccauggucacaguguccucu

SEQ ID NO: 24112 - RNA, 333 nt, Artificial Sequence
  derived and/or modified sequence opt3 from anti-HIV_CAP256-VRC26.07_LightChain
caggccgugcugacccaacccccuagcgucuccgcugcaccaggccagaacguuacaaucucuugcucagggaguggaagcaauauugguaacaauuucguguccugguaccagcagagaccgggcacugcccccaagcuccuuauauaugagucuaacaaaaggccuucggggaucccagaccgguuuucaggaagcaagaguggcacguccgcgacccuggcuauuacagguuugcaaacuggggaugaagccuacuauuacugugcaaccugggccgcucgcuuaaauucugcacgaguauucggaacaggcaccauggugacuguccug

SEQ ID NO: 24113 - RNA, 432 nt, Artificial Sequence
  derived and/or modified sequence opt3 from anti-HIV_CAP256-VRC26.07_HeavyChain
gaggugcagcuggucgaaagcggcgggggaguugugcaacccgguagaucccucaggcuuucuugcguaggcucacaguucaguuuuaaccgguacgggaugcacugggugcgccaggccccuggaaagggccuggagugggucgcugguaucagcuucgacgggaccgaucgauaucaugcagacaauguguggggacguuuuacaauuuccagagauaacucuaaaaauacuuuguacuuacagaugucgucacugagggccgaagacacggcgcuauauuacugugcuaaggaucuccgggaggacgaaugcgaggagugguggagcgauuauuacgacuucggcaaaaagcugccaugucgcaaaaguagaggcguugccgggguguuugauaaguggggacaagguaccauggucacaguguccucu

SEQ ID NO: 24114 - RNA, 333 nt, Artificial Sequence
  derived and/or modified sequence opt3 from anti-HIV_CAP256-VRC26.08_LightChain
cagagcgcccugacccaacccccuuccgugucugcugcaccaggccagaaggucacaaucucaugcagugggaacagcuccaauauuggaaacaauuucguuucuugguaccaacaggugccggguacugcccccaaacuccuucuguaugagacguacagaaggccuucgggcauaccagaccgguuuucagggagcaagaguggaaccuccgcgacauuggcuaucacuggcuuacagaccggugaugaagccgacuauuacuguacaguauggggagugcgcaaaggggucggcgcaguguucggcaccgggacuaagguuacagugcug

SEQ ID NO: 24115 - RNA, 438 nt, Artificial Sequence
  derived and/or modified sequence opt3 from anti-HIV_CAP256-VRC26.08_HeavyChain
gaggugcagcuggucgaaagcggcgggggaguugugcaacccgguagaucccucacccuuucuugcgccgcuucacaguucacauuuaguaacuacggcaugcacuggguaaggcaggcaccugggaagggacuggaguggguggccagcgucuccaaugacggcacuaaaaaguaucauggugauucugugugggggcgguucacgaucucgcgcgacaacagcaaaaauaccuuguuuuuacagaugucaagucugcgagcggaagauacagcuguuuacuucugugugcgugaccaaagagaggaugaaugcgaggaguggugguccgacuauuacgauuuuggaagggaacuaccaugucggaaguuccgcggccucggccuggccgggauuuuugacauauggggacacgguacuauggucaccgugucuagc

SEQ ID NO: 24116 - RNA, 333 nt, Artificial Sequence
  derived and/or modified sequence opt3 from anti-HIV_CAP256-VRC26.09_LightChain
cagagcgcccugacccaacccccuuccgugucugcugcaccaggccagaaggucacaaucucaugcagugggaacagcuccaauauuggaaacaauuucguuucuugguaccagcagcucccggguacugcccccaaacuucugauauaugagaacaauagaaggccuucgggcaucccagaccgguuuucagggagcaagaguggaacguccgcgaccuuggcuauuucuggcuuacaaacaggugaugaagccgacuacuggugugcaguguggggaguacgccgaggggccggcgcuguguucggcgcagggacuaaagucaccgugcug

SEQ ID NO: 24117 - RNA, 438 nt, Artificial Sequence
  derived and/or modified sequence opt3 from anti-HIV_CAP256-VRC26.09_HeavyChain
gaggugcagcuggucgaaagcggcgggggaguugugcaacccgguagaucccucacccuuucuugcgccgcuucacaguucaacuuugcaaauuacggcaugcacuggguaaggcaggccccugggaagggacuggaguggguggcgaguaucagcaacgacggcacuaaaaaguaucaugaagaguccgucuggggucgguucacaauuucuaaagauaauucgaagucaacguuguuuuuacagaugaacagccugcgcauagaagacaccgcucuauacuucugugugaaagaucaacgagaggacgagugcgaagagugguggagugauuauuacgacuuugggcgugaacucccauguagaaaguccaggggacugggccuugccggcaucuucgauaugugggggcacggaacaaugguuacugugucuagc

SEQ ID NO: 24118 - RNA, 333 nt, Artificial Sequence
  derived and/or modified sequence opt3 from anti-HIV_CAP256-VRC26.10_LightChain
cagagcgugcugacccaacccccuuccgucucugccgcuccaggccagaagguuacaaucucaugcagugggagcuccucuaacauuggagacaauuacgugucgugguaucagcaccucccggguacugcacccaaacuucugauauacgagaacacgagaaggccuucaggcaucccagaucgguucagcgggaguaaguccggaaccucugccacauuggcgauuacuggcuuacagaccggugacgaagcugauuauuacugugggacaugggacguacgccccaaucgaggagccguguuuggcaccggcacuaaagucacagugcug

SEQ ID NO: 24119 - RNA, 432 nt, Artificial Sequence
  derived and/or modified sequence opt3 from anti-HIV_CAP256-VRC26.10_HeavyChain
caggccauccugguggagagcggcgggggagucguucaacccgguagaucccucaggcuuucuugcgcugcaucacaguucaccuuuaguggccacgggcugcauugggugcggcaggccccuggaaagggcuuggaauggguagcgagcauuuccuucgcugguacaaaaauggacuacgccgauucugugaaggggcgcuuugcaauaucgcgagacaacagcaaaaauacuuuauaucugcagaugaacucacuacgugucgaggauacggcccucuacuauugugcuaaggacaugagagaauacgagugcgaauauuggaccagugauuacuaugacuucggaaggccacaaccguguaucgaucggcgcggcgugguuggcauuuuugacaugugggggcagggaacaauggugacugucuccacc

SEQ ID NO: 24120 - RNA, 321 nt, Artificial Sequence
  derived and/or modified sequence opt3 from anti-HIV_CAP256-VRC26.11_LightChain
cagagcgugcugacccaacccccuuccgucucugccgcuccaggccagaacguuacaaucucaugcagugggccgcccagccacauugagaagaaugacguguccugguaccagagacucccuggaauggcaccaaaaaugguaauauaugaaucuaagaggcggccccuugguaucccugugcgcuucucggccucacgaagcggcaguuccgcgacucuggucauuacgggguugcagaccgcugaugaggccgacuacuauuguggaacaugggauggccguaugaacuuugguacugggaccacagugucuguuuua

SEQ ID NO: 24121 - RNA, 429 nt, Artificial Sequence
  derived and/or modified sequence opt3 from anti-HIV_CAP256-VRC26.11_HeavyChain
gaggugcagcuggucgaaagcggcgggggaguugugcccccugguaagucccucacccuuucuugcguagccucaagguucacauuuagugcuuucggcaugcacugggugaggcaagcaccagggaaaggacuggagugggucgccagcaucuccuuugcgggcauuaagaaauacuaugcugacucugugaagggucgguucucgauaucacgcgauaacagcaauacuuuguuuuuacagaugaacgggcugcgaggagaagacacgggccuauaccauuguguuaaagauaugcgugagcucgaaugcgaggagugggccagugacuauuacgauuucggcaagccgcagcccugucuggacagaagagggguguccggaaucucugcauggugggguccuggcaccauggucacagugagcucc

SEQ ID NO: 24122 - RNA, 321 nt, Artificial Sequence
  derived and/or modified sequence opt3 from anti-HIV_CAP256-VRC26.12_LightChain
cagagcgugcugacccaacccccuuccgucucuacagccccaggccagacuguuacggugucaugcagugggggaaccagcaacacagguaauaacuucguauccugguaccagcaccucccgggcacugcucccaaacuucugaucuaugagaauaacaagagaccuuugggggugccagacagguuuucuggagcaaagucgggcaccucagccacauuagcgauuaccggucugcagacuggggaugaaggagacuacuauugugcuacauggagcggcagucuaaauauaggcaccgggacgaaagucuccgugcuc

SEQ ID NO: 24123 - RNA, 432 nt, Artificial Sequence
  derived and/or modified sequence opt3 from anti-HIV_CAP256-VRC26.12_HeavyChain
gaggugcagcugguccaaagcggcgggggaguugugcagcccgguagaucccucaggcuuucuugcgccgcuccuuacuucgaauuuggccgguauggguuccacuggguacgccaggcaccaggaaagggccuggaguggguggccucaaucaguuuugcgggucgagacuacuaucauagcccguccgucugggggcguuucaccauuucuagagauaacucgaaaaauacauuguacuuacagaugaacucacugaggauagaagacacugcucuauauuuuugugcccgggaucuccgcgagagcgaaugcgaggagugggaaagugacuacuaugauuucggaaagaaaggccccugugugaagccuagaggcguugcagggggacuggaccuuuggggucaaggcacgauggugaucgucuccucu

SEQ ID NO: 24124 - RNA, 333 nt, Artificial Sequence
  derived and/or modified sequence opt3 from anti-HIV_CAP256-VRC26.I1_LightChain
cagagcgugcugacccaacccccuuccgucucugccgcuccaggccagaagguuacaaucucaugcagugggagcuccucuaacauuggaaauaacuacgugucgugguaucagcagcucccggguacugcacccaaacuucugauauacaagaauaacgagagaccuucaggcaucccagacagguucagcgggaguaaauccggaacgucugccaccuugggcauuacagguuuacaaacuggggaugaagcggacuauuacuguggaaccugggauacaagccuguccgcuggcggcguauuugggaccggaacuaaggugacaguccua

SEQ ID NO: 24125 - RNA, 432 nt, Artificial Sequence
  derived and/or modified sequence opt3 from anti-HIV_CAP256-VRC26.I1_HeavyChain
caggugcaacuggucgagagcggcgggggaguugugcagcccgguagaucccucaggcuuucuugcgccgcuucaggcuucaccuuuaguaacuacgcaauggacuggguacggcaggccccugggaagggacuggaauggguggcggucaucagcuccgauggcucuaauaaaaacuaugcugacucggugaagggucgcuucacaauuucacgagauaauagcaaaaacacuuuguacuuacagaugaauagucugcgugccgaggacacggcaguuuauuacugugccaaggaucuaggggaaaacaaaaaugacgagugggcuaccgauuauuacgaccucuccauagcauauccagugcaagauccgagagccgucgugggagcuuuugacaucuggggccagggcacaaugguaacuguuucuagc

SEQ ID NO: 24126 - RNA, 333 nt, Artificial Sequence
  derived and/or modified sequence opt3 from anti-HIV_CAP256-VRC26.I2_LightChain
cagagcgugcugacccaacccccuuccgucucugccgcuccaggccagaagguuacaaucucaugcagugggagcuccucuacuauuggaaacaauuacgugucgugguaucagcuccuuccggguacggcacccaaacuguugauauacaagaacgacaaaagaccuucaggcaucccagauagguucagcgggaguaaguccggaaccucugccacauuaggcauuacuggucugcagaccggggacgaggcggauuauuacuguggaacaugggacaccagccuauccgcuggcggcguauuugggacuggaacaaaagugaccguccuc

SEQ ID NO: 24127 - RNA, 432 nt, Artificial Sequence
  derived and/or modified sequence opt3 from anti-HIV_CAP256-VRC26.I2_HeavyChain
caggugcaacuggucgagagcggcgggggaguugugcagcccgguagaucccucaggcuuucuugcgccgcuucaggcuucaccuuuaguaacuucgcaaugggguggguacggcaggccccuggaaagggccuggaauggguggcguuuaucagcuccgacgguucuaauaaaaacuacggggauucggucaagggacgcuucacaauuucacgagacaauagcaaaaacacuuuguuuuuacagaugaauagucugcgugcugaggauacggcccuauauuacugugcaaaggacgugggcgaauauaaauccgaugagugggccaccgacuacuaugaucucucuauagcuuacccaauccaagacccgagagcaaugguuggcgccuucgauauuugggggcagggaacaauggugacugucagcucc

SEQ ID NO: 24128 - RNA, 333 nt, Artificial Sequence
  derived and/or modified sequence opt3 from anti-HIV_CAP256-VRC26.UCA_LightChain
cagagcgugcugacccaacccccuuccgucucugccgcuccaggccagaagguuacaaucucaugcagugggagcuccucuaacauuggaaauaacuacgugucgugguaucagcagcucccggguacugcacccaaacuucugauauacgagaauaacaagagaccuucaggcaucccagacagguucagcgggaguaaauccggaacgucugccaccuugggcauuacagguuuacaaacuggggaugaagcggacuauuacuguggaaccugggauagcucccugucagcuggcggcguauuugggacaggaaccaaggugacuguccua

SEQ ID NO: 24129 - RNA, 432 nt, Artificial Sequence
  derived and/or modified sequence opt3 from anti-HIV_CAP256-VRC26.UCA_HeavyChain
caggugcaacuggucgagagcggcgggggaguugugcagcccgguagaucccucaggcuuucuugcgccgcuucaggcuucaccuuuaguagcuacgggaugcacuggguacggcaggcaccuggaaagggccuggaauggguggccgucaucuccuaugacgguucuaacaaauacuaugcggauucggugaaggggcgcuucacaauuucacgagacaauagcaaaaacacuuuguacuuacagaugaauagucugcgugcugaggauacggccguuuauuacugugcaaaggaccuaggagaauccgagaacgaagagugggccaccgauuauuacgacuuuucuauaggcuacccaggccaagauccgagagggguggucggagcuuucgacaucuggggucagggcacaauggugacuguaagcucc

SEQ ID NO: 24130 - RNA, 324 nt, Artificial Sequence
  derived and/or modified sequence opt3 from anti-HIV_CH01_LightChain
gagaucgugcuggcccagagccccggcacccucucccuuucuccuggggaaagagcuacacugucaugcagggcaagucacaacguccauccaaaguacuucgccugguaucaacagaaaccgggacagagcccccgguuguuaauuuacgguggcuccacucgcgcggcugggauaccuggaaaguuuucuggcucggguucagggacggacuucacccugacaaucagccgaguugauccagaggacuuugccguguauuacugucagcaauauggaggcagucccuacacuuucggccaggggaccaaaguagaaauuaag

SEQ ID NO: 24131 - RNA, 399 nt, Artificial Sequence
  derived and/or modified sequence opt3 from anti-HIV_CH01_HeavyChain
gaggugcagcuggucgaaagcggcgccaacguugugagacccgggggaucccucaggcuuucuugcaaggcuucagguuucaucuuugagaauuucggcuuuaguuggguacggcaagcaccugggaaaggacugcaguggguggccggcuugaacuggaaugguggggacacacgcuacgcggauagcgucaagggacgauuccguauguccagagacaacucuaggaauuuuguguauuuagauauggacaaaguuggcguggaugacacagcuuucuacuauugugcccggggcacugauuacacgauugacgaugcagggauacacuaucagggaucggguaccuuuugguacuucgaccuguggggccgcgggacccuagucucagugagcagu

SEQ ID NO: 24132 - RNA, 324 nt, Artificial Sequence
  derived and/or modified sequence opt3 from anti-HIV_CH02_LightChain
gagaucgugcugacccagagccccgccacacucuccgucucuccuggcgaaagagcuacucuuucaugcagggcaagucaaaacguucacccacgguacuucgccugguaucagcagaagcgcgggcagagcccgcgacuguugauucauuccggaucuacgcgugcggcugguauagccgacagauuuucgggcgggggaucaggcaugcacuucaccuuaacaaucacuaggguggagcccgaagauuuugcaguauacuucugucaacaguauggugggagcccuuacaccuuuggacagggcacacggguggagcugcgc

SEQ ID NO: 24133 - RNA, 399 nt, Artificial Sequence
  derived and/or modified sequence opt3 from anti-HIV_CH02_HeavyChain
gaggugcagcuggucgaaagcggcggguccguugugagacccggagguucucucaggcuuucaugccgggccaguggcuucaucuuugagaacuacgggcugaccuggguacgccaagugccuggaaagggcuugcacugggucagcgguaugaauuggaacgggggagacacacgauaugcugauuccgugcguggcagauucucuaugucgagggacaauucaaacaauauugcauacuuacagaugaacaaucugcggguugaagauacugcccuauauuacugugcgcgcggcacggacuauaccauagaugaccaggggagauuuuaccagggaagcgguacauucugguauuuugauuucuggggcagggggacucucgugaccgucaguucc

SEQ ID NO: 24134 - RNA, 324 nt, Artificial Sequence
  derived and/or modified sequence opt3 from anti-HIV_CH03_LightChain
gagaucgugcugacccagagccccgccacacucucccuuucuccuggcgaaagagcuacucugucaugcagggcaagucaaagcguccacccaaaguacuucgccugguaucagcagaaaccggggcagucuccccgguuguuaauuuacuccggaucgacgcgcgcggcugguauagccgaccgauuuucaggcgggggaagcggcauccauuucacccugacaauuacucguguugagccugaagauuuugcaguguauuucugucaacaguacggugggaguccauauaccuuuggacagggcacaaagguagagcuaaga

SEQ ID NO: 24135 - RNA, 399 nt, Artificial Sequence
  derived and/or modified sequence opt3 from anti-HIV_CH03_HeavyChain
gaggugcagcuggucgaaagcggcgggggaguugugagacccgguggcucccucaggcuuucuugcgccgcuucaggguucaucuuugagaacuacggacugaccuggguacggcaagugccuggcaaggguuugcacugggucagugggaugaauuggaacggaggcgacacacgcuaugcagauagcgugcgaggccguuucuccaugucuagagacaauucgaacaauauugccuacuuacagaugaaaaaccugaggguugaugacacugcgcuauauuacugugcucgggggacggauuauaccauagacgaucagggaaucuuuuacaaggguucaggcacauucugguauuuugaccucugggggcgcggaacucuggugaccgucagcagu

SEQ ID NO: 24136 - RNA, 324 nt, Artificial Sequence
  derived and/or modified sequence opt3 from anti-HIV_CH04_LightChain
gagaucgugcugacccagagccccgacacacucucccuuucuccuggcgaaagagccacucugucaugcagggcuagucaaagcguccacucccgguacuucgcaugguaucagcauaagccagggcagccgccccgcuuguuaauuuacggagguucuacgcgagccaccggcauaccuaaccguuuuucggcugggggaucaggcacacaguucacucugaccguuaauagacuagaggcggaagauuuugccguguauuacugucaacaguaugguaggagcccauacacauucgggcagggaaccaaaguagagauccgg

SEQ ID NO: 24137 - RNA, 399 nt, Artificial Sequence
  derived and/or modified sequence opt3 from anti-HIV_CH04_HeavyChain
gaggugcagcuggucgaaagcggcgggggacucaucagacccgguggcucccuuaggcugucuugcaaggggucaggauucauuuuugagaacuucggcuuugguuggguucggcaagggccuggaaaaggcuuggaaugggugaguggcaccaauuggaacgggggagacagccgcuacggugauuccguaaagggccgauucacaauaucucgugacaauucgaacaauuuuguguauuuacagaugaacucacugagaccagaggauacugccaucuacuauugugcuagggggacggacuacaccauugaugaccagggaauccgguaucagggcagcgguacauucugguacuuugaugucugggggcgcggaacucuagugaccguuaguucc

SEQ ID NO: 24138 - RNA, 627 nt, Artificial Sequence
  derived and/or modified sequence opt3 from anti-HIV_CH103_LightChain
uacgagcugacccagcccccuagcguguccgucucuccaggccaaacagccacuaucacgugcucaggggcuaguaccaacguuuguugguaucaggugaagccgggacagagccccgaaguagugauuuucgagaauuacaaaagaccuuccgguauaccagacagguuuucuggcucgaagucagggagcacagcaacucucaccauccggggaacacaggccauugaugaagcggacuauuacugccaagucugggauaguuucuccaccuuuguguucggcucugguacucagguuacagugcuucgccagcccaaagcuaacccuaccgucacgcuguuuccacccagcuccgaggaauugcaggccaauaaggcaacuuuagugugucugaucucagacuucuauccuggggccguaaccguugcuuggaaagcagauaguagcccagugaaggccggagucgagacaacuaccccgucuaagcaauccaacaauaaauacgcugccucaagcuaucuaagucucacacccgagcaguggaagucucaccgauccuacagcugccaggugacccaugaaggcucgacgguggagaaaacugucgcgccuacagaauguucu

SEQ ID NO: 24139 - RNA, 678 nt, Artificial Sequence
  derived and/or modified sequence opt3 from anti-HIV_CH103_HeavyChain
caggugcaacugcaggagagcggccccggggucguuaaguccucugaaacccucucacuuacaugcacugugaguggagguagcaugggcgggacguacugguccuggcugagauugucuccuggaaaaggcuuagaguggaucgguuauauuuuccacaccggggaaacaaacuacucgccaucacugaagggaaggguaagcauaaguguggacacuuccgaggaucaguuuucucuacggcuccgcagcgucaccgccgcugacacagcaguguauuucugugccucccugccgcgaggccagcuuguuaaugcguacuuucguaacuggggcagagggucacuggugagugucaccgcugccagcacuaaaggacccucuguguucccuuuggcaccauccucaaagagcacaagugguggcaccgccgcucucgggugccugguaaaagauuauuuucccgaaccuguuacggugucuuggaacuccggagcacugacuagcggcguccauaccuucccagccgugcuccaaucgucugguuuauacucccugucaaguguggucacaguucccagcuccucucuugggacucagaccuauaucuguaaugugaaucacaagccuagcaacacaaagguagacaaaaagguggagccaaaaucaugcgauaag

SEQ ID NO: 24140 - RNA, 321 nt, Artificial Sequence
  derived and/or modified sequence opt3 from anti-HIV_M66.6_LightChain
gacauccagcugacccaaagccccuccucucucucagccagugugggcgauagagucacaauuacuugcagggcuagccaguccauagggucuuaccuuaacugguaucagcagaagccuggaaaagcaccaaagcuguugaucuacgccgcgucgacguuacaaucagguguuccgagccgguucaguggcuccgggucuggaaccgacuuuacacugacuauuagcucccuacagcccgaggauucagcuaccuauuacugucagcagaguuauagcacaccuuucaccuuuggcccagguacuaaaguggacauccgc

SEQ ID NO: 24141 - RNA, 390 nt, Artificial Sequence
  derived and/or modified sequence opt3 from anti-HIV_M66.6_HeavyChain
caggugcaacugguccagagcggcgccgagguuaagaaacccggggaaucccucaagaucucuugcaaagugucaggauacaacuucgcuagugaguggauugguuggguaagacagaugccuggcaaggggcuugaauggaugggaauaaucuauccaggcgacagcgauaccaaauacuccccgucuuuucagggucaagugauuaucucggcagacaagucaauuaauacagccuaucugcaguggagcaguuugaaggcguccgauacugcuaucuacuauugugccaggcagaaccacuacgggucuggaagcuauuucuaccggacggcauacuauuacgccauggacgucuggggccagggcaccacagugacuguuuccuca

SEQ ID NO: 24142 - RNA, 327 nt, Artificial Sequence
  derived and/or modified sequence opt3 from anti-HIV_NIH45-46_LightChain
gaaaucgugcugacccagagccccgccacacucucccuuucuccuggcgaaacugcuauuauaucaugcagaacgagucaaagcgggucccuggcaugguaccagcagaggccaggacaggccccgcgguuggucaucuauucugguucgacccgcgcggcuggcauucccgaccgauucucagggagccguuggggagccgauuacaacuuaaguaucuccaaucuggagucuggcgacuuugguguuuauuacugucaacaguaugaguucuuugggcagggaacaaaggugcagguagauauuaaaagaacuguggcagccccu

SEQ ID NO: 24143 - RNA, 399 nt, Artificial Sequence
  derived and/or modified sequence opt3 from anti-HIV_NIH45-46_HeavyChain
caggugagacugagccaauccggcgggcagaugaagaaacccggagagucuaugaggcucucaugccgggccagugguuacgaguuccuuaacuguccuaucaauuggauucgccuggcuccaggccgacguccggaauggauggggugguugaagcccagaggaggcgcagucaacuaugccaggaaauuucagggucggguuaccaugacacgcgacguguacagcgauacugcguucuuagaacugagaucccuaacgucugacgauaccgcuguauauuuuugcacaagggggaaguacuguacugcccgggacuauuacaauugggauuucgagcacuggggacgcggcgcaccugugaccgucucgucagccagcacaaaaggcccaagugug

SEQ ID NO: 24144 - RNA, 330 nt, Artificial Sequence
  derived and/or modified sequence opt3 from anti-HIV_PG16_LightChain
cagagcgcccugacccaacccgcuuccgugucuggcucaccugggcagacaaucacuauuaguugcaacggaacgagcuccgacgucgguggcuucgauucuguuucgugguaccagcagucaccagggaaggcaccgaaagugaugguauuugacgugagccacagacccaguggaauauccaauagguucucuggcagcaaguccgguaacaccgccucacucacaaucagugggcuucauauugaggaugaaggagacuauuuuuguagcucucugacugaucggucccaccgcaucuucggcggcgggaccaaagucacaguguug

SEQ ID NO: 24145 - RNA, 411 nt, Artificial Sequence
  derived and/or modified sequence opt3 from anti-HIV_PG16_HeavyChain
caggagcaacugguggaaagcggcgggggagucguucagcccgguggcucccucagacuuucuugccuggccucaggguucaccuuucacaaguacggaaugcauugggugaggcaggcuccuggcaaagguuuggaguggguagcauuaaucagugacgaugggaugcggaaguaucacagcgacuccauguggggacgcgugacaauuucucgagauaacucgaaaaauacucuguaccuacaguucucaagccucaaggucgaagacacggccauguuuuucugugcgcgugaggcuggcggcccaauauggcaugaugacgugaaauauuacgauuuuaacgacggguauuacaauuaucacuacauggauguuuggggaaaggguaccacagugacugucaguucc

SEQ ID NO: 24146 - RNA, 315 nt, Artificial Sequence
  derived and/or modified sequence opt3 from anti-HIV_PGT122_LightChain
accuucgugagcgucgcccccggccagacagcuagaaucacuugcggggaggaaucccugggaucuaggucaguuauuugguaccaacagcggccuggucaggcaccaagucucauaaucuauaacaauaacgaccgcccgagcggcauucccgaucgauuuuccgggucuccuggaucgacguucggcaccacagccacucuuaccaucacaucaguggaggcgggugacgaagcugauuacuauugucacauuugggacagccguagaccaaccaauuggguauuuggggagggaacuacacugaucguguug

SEQ ID NO: 24147 - RNA, 396 nt, Artificial Sequence
  derived and/or modified sequence opt3 from anti-HIV_PGT122_HeavyChain
caggugcaucugcaagagagcggccccgggcucgucaagccuuccgaaacccuuucucugacaugcaacguuucaggaacuuuggugagagacaauuacuggaguuggaucaggcagccauuagguaaacagccggaguggauuggcuauguacacgauagcggggacacgaacuacaaucccucccugaagucucgggugcaccuaucgcucgauaaaucaaagaaccuggucagccuucgccugaccggagugacagccgcugacagugcaauauauuacugugccacuaccaaacauggccgacguaucuaugguguuguggcguucaaggaaugguuuacauacuucuauauggaugucugggggaagggaaccuccgugacuguaucuagc

SEQ ID NO: 24148 - RNA, 315 nt, Artificial Sequence
  derived and/or modified sequence opt3 from anti-HIV_PGT123_LightChain
agcuccaugucugugucacccggcgagaccgccaagaucaguugcgggaaagaaagcauuggauccagagcuguccagugguaccaacagaagccuggucagccaccgucucugauaaucuauaacaaucaggacaggcccgcaggcguuccugagcgguucucggccucaccagauuuucgccccgggacaacugcgacgcucaccauuacaaacguggacgcugaagaugaggccgacuacuauugucacaucuacgaugcacgaggaggcacuaauuggguauucgaccgugguaccacacuuaccgugcug

SEQ ID NO: 24149 - RNA, 396 nt, Artificial Sequence
  derived and/or modified sequence opt3 from anti-HIV_PGT123_HeavyChain
cagcugcaccuccaagagagcggccccgggcuugugaagccuccagaaacccuguccuugacaugcucugucucaggagccaguaucaacgacgcuuacuggagcuggauuagacaguccccggguaaaaggcccgaguggguuggcuaugugcaucacucuggggauacuaauuacaacccuucguuaaagcggcgcguaacguucucacuggacaccgccaaaaaugaagugagccuaaagcucgucgaucugacagcagcggacagugcuacuuauuuuugugcccgagcacuucauggaaaacguauauacggcaucguggcccugggugaguuguucaccuauuuuuacauggauguuugggggaagggaacagcugugaccgucuccucu

SEQ ID NO: 24150 - RNA, 315 nt, Artificial Sequence
  derived and/or modified sequence opt3 from anti-HIV_PGT125_LightChain
cagagcgcccugacccaacccccuuccgcuucuggcucaccagggcagaguaucacaauuagcugcaacggaacugcaacgaauuucguguccugguaccagcaguuuccggacaaggcccccaaacucauaaucuucggugucgauaagagaccuccaggcguucccgacagguuuucugggucgcggucaggaaccacagcgagccuuacugugagucgccugcaaaccgaugacgaggcuguauauuacuguggcuccuugguggguaacugggaugucauuuucgggggaggcacaaccuuaacugugcug

SEQ ID NO: 24151 - RNA, 411 nt, Artificial Sequence
  derived and/or modified sequence opt3 from anti-HIV_PGT125_HeavyChain
cagagccaacugcaggaguccggccccagacucguggaagccucugagacccuuucacugacaugcaacgucaguggggaaagcacuggagcuuguacguacuucugggguuggguuaggcaggcaccuggcaagggguuggaguggaucggauccuuaucucacugccagucguuuuggggcucagguuggaccuuccauaauccaagccugaaaagucggcuaacaauuucccucgacacuccgaagaaccaaguguuucugaaacuuaccucucugacagccgcggauaccgcuacuuauuacugugcccgcuucgacggggaaguauugguguauaaucacuggcccaagccugcaugggucgaucucuggggacgaggcauaccagugacaguuaccgugagcucc

SEQ ID NO: 24152 - RNA, 315 nt, Artificial Sequence
  derived and/or modified sequence opt3 from anti-HIV_PGT126_LightChain
cagagcgcccugacccaacccccuuccgcuucuggcucaccagggcagaguaucagcauuuccugcacaggaacuucuaacagauucgugucgugguaccagcagcacccggguaaggcacccaaacucgucauauauggcguuaauaagaggccuucaggggugccagaccgguuuagcggaaguaaauccggcaacacggccucucuuaccguaagcggucugcaaacagaugacgaggcgguguacuauuguuccucauuggucgggaauugggaugugaucuucggaggcggcacuaaguuaaccguucug

SEQ ID NO: 24153 - RNA, 411 nt, Artificial Sequence
  derived and/or modified sequence opt3 from anti-HIV_PGT126_HeavyChain
cagccccaacugcaggagagcggcccugggcucguggaagccuccgagacccuuucucugacaugcacugucucaggagacaguacggcugcaugugauuacuucugggguuggguuagacagccaccgggcaagggguuggaauggaucggaggcuuaagccacugcgccgguuauuacaacaccggguggacauaucauaaucccucccugaaaucuaggcuaacuauuucgcucgacaccccuaagaaccagguguuucugaaacuuaauucaguaacagcggcugauaccgccauauacuauugugcacgguucgacggagaggugcuggucuaccacgauuggccaaagcccgccuggguggacuuguggggccgcggcacucucguuacagugaccgucagcagu

SEQ ID NO: 24154 - RNA, 315 nt, Artificial Sequence
  derived and/or modified sequence opt3 from anti-HIV_PGT127_LightChain
cagagcgcccugacccaacccccuuccgcuucuggcucaccagggcagaguaucacaauuagcugcacuggaacguccaacaauuucgugucuugguaccagcaguauccggguaaggcacccaaacucgucauauacgagguuaacaagagaccuucgggcgugccagacagguuuucagggagcaaaaguggauccaccgccucucuuacaguaagcggccugcaagcggaugacgaagguguguauuacuguuccucauuggucgggaauugggaugugaucuucggaggcggcacuaaguuaaccguucug

SEQ ID NO: 24155 - RNA, 405 nt, Artificial Sequence
  derived and/or modified sequence opt3 from anti-HIV_PGT127_HeavyChain
cagccccaacugcaggagagcggcccugggcucguggaagccuccgagacccuuucucugacaugcacugucucaggagacaguacggguagauguaacuacuucuggggcuggguuaggcagccaccggggaagggauuggaauggaucggcagcuuaucccacugccggucuuauuacaauaccgauuggacauaucauaaccccucgcugaaaucacgccuaacuauuagccucgacaccccuaagaaucagguguuucugcgacuuacaaguguaaccgcugcagauacugccacauacuauugugcgcguuucgguggggaggugcuggucuacagagacuggccaaaacccgcuuggguggauuuguggggaaggggcacccucguuacgguguccucu

SEQ ID NO: 24156 - RNA, 315 nt, Artificial Sequence
  derived and/or modified sequence opt3 from anti-HIV_PGT128_LightChain
cagagcgcccugacccaacccccuuccgcuucuggcucaccagggcagaguaucacaauuagcugcacuggaacguccaacaauuucgugucuugguaccagcagcacgcagguaaggccccgaaacucgucauauaugacguuaacaagagacccucgggcgugccugauagguuuucagggagcaaaaguggaaauaccgcgucccuuacaguaucuggccugcaaacugacgaugaggcuguguacuauugugguagcuuggucgggaacugggacgugaucuucggaggcggcaccaaguuaacaguucug

SEQ ID NO: 24157 - RNA, 405 nt, Artificial Sequence
  derived and/or modified sequence opt3 from anti-HIV_PGT128_HeavyChain
cagccccaacugcaggagagcggcccuacccucguggaagccuccgagacacuuucucugacuugcgcugucucaggggacaguacggcagccuguaacagcuucuggggauggguuagacagccaccggguaagggcuuggaaugggugggguccuuaucucacugcgcgucguacuggaauaggggauggaccuaucauaaccccucacugaaaagccggcuaacacucgcucuggauacuccuaagaaucuuguauuucugaaauugaacagugugaccgccgcagacacagccaccuacuauugugcucgcuucggcggugagguccuccgauacacugauuggccaaagcccgcauggguggaccugugggggcguggaacacugguuaccguguccucu

SEQ ID NO: 24158 - RNA, 330 nt, Artificial Sequence
  derived and/or modified sequence opt3 from anti-HIV_PGT130_LightChain
cagagcgcccugacccaacccccuuccgcuucuggcucacucgggcagagugugacaaucagcugcaacggaacuuccucugacauugguggcuggaauuucgucucgugguaccagcaguuuccagggagagcaccgaggcuuauaaucuucgagguuaacaagcggcccucaggagugccuggccgcuuuagcgguaguaaauccggaaauucugccagccugacgguauccggguugcaaucagaugacgaaggccaguauuucuguaguagcuuauuuggccgaugggauguggucuucgggggagguaccaagcugacagugcua

SEQ ID NO: 24159 - RNA, 387 nt, Artificial Sequence
  derived and/or modified sequence opt3 from anti-HIV_PGT130_HeavyChain
caggugcaacugcaggagagcggccccgggcucgucaagccugccgaaacccuuucccugacaugcucuguuucaggagagaguaucaacacuggucacuacuauuggggcugggugagacagguaccagggaaaggauuggaauggauuggccauauacacuacacgaccgcuguguuacauaauccgagccugaaguccaggcuaacaaucaaaauuuauacucuccggaaccagaucacccugcgccuuucuaaugucacagcagccgacaccgcgguguaccacuguguucgaucggguggggauauucuguauuacuaugaguggcaaaagccccauugguucucaccuuggggaccaggcauccacgugacugucagcagu

SEQ ID NO: 24160 - RNA, 330 nt, Artificial Sequence
  derived and/or modified sequence opt3 from anti-HIV_PGT131_LightChain
cagagcgcccugacccaacccccuuccgcuucuggcucacucgggcagagucuuacaaucagcugcuccggaacugguucugacauuggcucguggaacuucgugucaugguaccagcaguuuccagggagagcaccgaaucugauaaucuucgaggucaacaggcggcgcagcggaguucccgaucgauuuaguggcuccaagucugguaauacggccagcuugaccguguccggguuacguucagaagacgaggcggaauauuucuguaguagccugucuggaagaugggauauuguauuuggcggcgggacaaaagugacuguccua

SEQ ID NO: 24161 - RNA, 387 nt, Artificial Sequence
  derived and/or modified sequence opt3 from anti-HIV_PGT131_HeavyChain
caggugcaacugcaggagagcggccccgggcucgucaagccuuccgaaacccuuucucugacaugcacuguuucaggagacaguaucaacacgggucaccauuacuggggcugggugagacagguaccagggaaaggaccggaguggauugcccacauacauuauaauaccgcuguguugcacaaccccgcauuaaagagcagggucacaaucuccauuuucacucugaaaaaucuaaucacccucucucugucgaacgugacagccgcggauaccgcuguuuacuuuugugugcggucaggcggugacauucuuuauuacaucgaauggcagaagccucauugguucuauccaugggggcccggaauacuggucacugugagcagu

SEQ ID NO: 24162 - RNA, 321 nt, Artificial Sequence
  derived and/or modified sequence opt3 from anti-HIV_PGT135_LightChain
gagaucgugaugacccagagccccgacacacuguccgucucuccuggcgaaacuguuacgcucucaugcagagccagucaaaacauuaauaagaaccuugcuugguaccaguauaaaccagggcagagcccgaggcuggugauauucgagaccuacuccaagaucgcagccuuucccgcgcgguucguagcuucuggaucggguacagaauuuacuuugaccauuaauaacaugcagucagaggauguggccgucuauuacugucaacaguaugaagaguggccucgcacauucggccaggggaccaaaguggacaucaag

SEQ ID NO: 24163 - RNA, 399 nt, Artificial Sequence
  derived and/or modified sequence opt3 from anti-HIV_PGT135_HeavyChain
cagcugcaaaugcaggagagcggccccgggcucgugaagccuuccgaaacccuuucucugucaugcacagucaguggagacagcaucagagguggcgaguggggagauaaagacuaccacuggggguggguuaggcauuccgccggcaaggguuuggaauggauugggucuauacacuggcggggaacuacgcauuauaaagagucguuacgccgacgugugucaaugagcaucgauaccaguagaaacugguucucccugaggcuagcuucuguaacagcagccgacacugcgguguacuuuugugcucggcaccgccaucacgaugucuucaugcucgugccaauugccggcugguuugacguuuggggcccgggggugcaggucaccgugagcucc

SEQ ID NO: 24164 - RNA, 321 nt, Artificial Sequence
  derived and/or modified sequence opt3 from anti-HIV_PGT136_LightChain
gagaucgugaugacccagucacccccuacacuguccgucucuccaggcgaaacugccacgcucucaugcagagcuagucaaaacguuaagaauaaccuugcaugguaccagcugaaaccggggcaggcccccagguuguuaauuuucgacgcgagcucccgggcuggagguauaccugaucgcuuuucuggcucgggguauggaaccgacuucacacugacugugaauagcguacagagcgaggauuuuggcgacuacuucugucaacaguaugaagaguggccacgaaccuuuggucaggggacaaagguggauaucaaa

SEQ ID NO: 24165 - RNA, 402 nt, Artificial Sequence
  derived and/or modified sequence opt3 from anti-HIV_PGT136_HeavyChain
cagcugcaacuccaggagagcggccccgggcuugugaagccuuccgaaacccugucuuugacaugcacugucucaggagguaguaugagaggcacggacuggggagagaacgauuuccacuacggguggaucaggcagagcuccgccaaaggcuuagaauggauugguucuauacauuggcgggggcgcaccacacacuauaagacuucguuucgaucacgugcuacccugagcaucgacacaaguaauaacagauucucccuaaccuuuucuuucguuacugcagccgauacagcgguguacuauugugcuaggcauaaauaccacgacauuuuucggguagugccagucgccggaugguucgauccguggggccagggccuccuggugaccguuagcucc

SEQ ID NO: 24166 - RNA, 321 nt, Artificial Sequence
  derived and/or modified sequence opt3 from anti-HIV_PGT137_LightChain
gagaucaugaugacccagagccccgccauucuguccgugucuccuggcgacagagcuacacucucaugcagggcaagucaaagcgucaagaacaaucuugccugguaccagaaacggccagggcaggcgccgcgccuguugauauucgauacuuccucucgagcuucgggaauccccgcccguuuuucagguggcgggagcggaacggaguucaccuuaacaguuaacaguaugcaguccgaagacuuugcaacuuauuacugucaacaguaugaagaguggccuagaaccuucggccaggguacaaagguggaaauuaaa

SEQ ID NO: 24167 - RNA, 399 nt, Artificial Sequence
  derived and/or modified sequence opt3 from anti-HIV_PGT137_HeavyChain
gaggugcaccuggaagagagcggccccgggcuggucagaccuuccgaaacccuuucucugacaugcacugccucaggagguaguaucaggggcggggaguggggagacagcgauuaccauuggggcuggguucggcacuccccagaaaaggguuuggaguggauugggucuauacauuggcgcggaacgacccacuauaacgcuccguuccgaggccguggcagauuaucgaucgaccugucaaggaaucaguuuagccuacggcucacaagugugacugcagaggauaccgccguauacuauugugugaaacauaaguaccacgacauugucauggugguucccaucgcggggugguucgauccuuggggacaaggucuccaggugacagucuccucu

SEQ ID NO: 24168 - RNA, 336 nt, Artificial Sequence
  derived and/or modified sequence opt3 from anti-HIV_PGT141_LightChain
gacaccguggucacacagagcccccugucccucccuguuacuccaggcgaggccgcuucuaugucaugcaguagcacgcaaucccuuagacacucuaacggggcaaauuaccuggccugguaucagcauaagccgggacagucgcccagguuguuaauccggcuggguucacagcgcgcgagcggcgugccugaucgauucaguggguccggaucuggcacccacuuuacacuaaaaauuagccguguagaagcugaggacgccgcaauauacuauuguaugcaaggucucaacagaccauggacuuucgggaagggaaccaaacuggaaaucaag

SEQ ID NO: 24169 - RNA, 423 nt, Artificial Sequence
  derived and/or modified sequence opt3 from anti-HIV_PGT141_HeavyChain
caggugcaacugguccagagcggccccgagguuaagaaaccuggguccucugugaagguaucaugcaaagccaguggaaacaccuucagcaaguacgacgugcacugggucagacaggcuacaggucagggccucgaaugggugggguggaugucccaugagggagauaaaacugaaucugcacaaagguuuaagggccggguuacguucacccgcgacacaucggccucaacugcguauauggagcuucgaggucugaccagcgaugacacagcuaucuacuauuguacccgugggaguaagcacagauugagggauuacguguuauaugacgauuacggacugauuaauuaucaggaauggaacgacuaccuagaguuucucgaugucuggggccauggcacugccgugacaguauccucu

SEQ ID NO: 24170 - RNA, 336 nt, Artificial Sequence; identical to SEQ ID NO: 24168
  derived and/or modified sequence opt3 from anti-HIV_PGT142_LightChain

SEQ ID NO: 24171 - RNA, 423 nt, Artificial Sequence
  derived and/or modified sequence opt3 from anti-HIV_PGT142_HeavyChain
caggugcaacugguccagagcggccccgagguuaagaaaccuggguccucugugaagguaucaugcaaagccaguggaaacaccuucagcaaguacgacgugcacugggucagacaggcuacaggucagggccucgaaugggugggguggaucucccaugagagggauaaaacugaaucugcacaacgguuuaagggacgcguuacguucacccgagacacaucggccacuaccgcguauauggagcuucguggccugacaucagaugacaccgcuauuuacuauuguacuagagguagcaagcacagguugcgggauuacguguuauaugacgauuacgggcugauaaauuaucaggaauggaacgacuaccuagaguuucucgaugucuggggacauggcacagccgugaccguaaguucc

SEQ ID NO: 24172 - RNA, 336 nt, Artificial Sequence
  derived and/or modified sequence opt3 from anti-HIV_PGT143_LightChain
gacaccguggucacacagagcccccugucccucccuguuacuccaggcgaggccgcuucuaugucaugcacgaguacccaaagccuuagacacuccaacggggcaaauuaccuggccugguaucagcauaagccgggacagucucccagguuguuaauccggcuggguucgcagcgcgcgucaggcgugccugaucgauucagcgggaguggauccggcacacacuuuacucuaaaaauuucucguguagaaccagaggacgcugccauauacuauuguaugcaaggucucaacagacccuggaccuucgggaagggaacaaaacuggaaaucaag

SEQ ID NO: 24173 - RNA, 423 nt, Artificial Sequence
  derived and/or modified sequence opt3 from anti-HIV_PGT143_HeavyChain
caggugcaacuggagcagagcggcgccgaagucaagaaacccggguccucuguuaaggugucaugcaaagcuaguggaaacaccuucagcaaguacgacguacacugggugagacaggcaacaggucagggccucgagugggucggguggaugucccaugaaggagauaaaacugagucugcccaaagguuuaagggccgggugacguucacccgcgacacaucggcgucaacugcuuauauggaacuucgaggucugaccagcgaugacacagccaucuacuauuguacccgugggaguaagcacagauugagggauuacguuuuauaugacgauuacggacugauuaauuaucaggaguggaacgacuaccuagaguuucucgauguguggggccauggcacugcagucacaguguccucu

SEQ ID NO: 24174 - RNA, 336 nt, Artificial Sequence
  derived and/or modified sequence opt3 from anti-HIV_PGT144_LightChain
gacaccguggucacacagagcccccugucccucucuguuacuccuggcgaggccgcuucaaugaguugcacgagcacccaaucccuuagacacucuaacggggcaaauuaccuggccugguaucagcauaagccaggacagucgccgagguuguuaauccggcuggguucacagcgcgcgagcggcgugcccgaucgauucaguggguccggaucuggcacacacuuuacucuaaaaauuagccguguagaagcugacgaugccgcaauauacuauuguaugcaaggucucaacagaccuuggaccuucgggaagggaacaaaacuggagaucaag

SEQ ID NO: 24175 - RNA, 423 nt, Artificial Sequence
  derived and/or modified sequence opt3 from anti-HIV_PGT144_HeavyChain
caggugcaacugguccagagcggcgccgagguuaagaaacccggguccucugugaagguaucaugcaaagcuaguggaaacaccuucagaaaguacgacgugcacugggucaggcaggcaacaggucagggccucgaaugggugggguggaugagccaugagggagauaaaacugaauccgcccaacgguuuaagggccgcguuucuuucacgcgagacaauucggcgucaaccgcuuauaucgagcuucguggucugacaagcgaugacacugccauuuacuauuguaccgggggaaguaagcacagauugagggauuacguguuauaugacgauuacggccugauaaaccagcaggaauggaaugacuaucuagaguuucucgaugucuggggccaugggacagcagugaccguauccucu

SEQ ID NO: 24176 - RNA, 336 nt, Artificial Sequence
  derived and/or modified sequence opt3 from anti-HIV_PGT145_LightChain
gagguggucaucacccagagcccccuguuccucccuguuacaccaggcgaagccgcuucccuuucuugcaaguguucacacagucugcaacauagcacuggggcaaacuacuuggccugguauuuacagagaccgggacagacgcccaggcugcuaauucaccucgcgacccaucgggcuuccggugugccugaccgcuuuucuggcucggggucaggaacagauuucacucugaaaauaagccgaguagagagugacgaugugggcaccuacuauugcaugcagggucuucacuccccauggacauuugggcaaggaaccaaggucgaaaucaaa

SEQ ID NO: 24177 - RNA, 420 nt, Artificial Sequence
  derived and/or modified sequence opt3 from anti-HIV_PGT145_HeavyChain
caggugcaacugguccagagcggcgccgagguuaagaaacccggguccucugugaagguaucaugcaaagcuaguggaaacagcuucuccaaucacgacgugcauugggucagacaggcaaccggucagggccucgaauggaugggguggaugucucacgagggagauaagacaggccuugcccaaaaauuucaggguagggugacuaucacgcgggacucgggggcgucaaccguuuacauggaacugcgcggauugacagcugaugacacugccauuuauuacuguuuaaccggcagcaagcaucgacugcgugauuauuuccuauacaacgaguauggcccuaauuacgaagaguggggagacuaucucgcaacacuggaugugugggggcacgguaccgccgucacugugaguucc

SEQ ID NO: 24178 - RNA, 657 nt, Artificial Sequence
  derived and/or modified sequence opt3 from anti-HIV_PGT151_LightChain
gacaucgugaugacccagacaccccugagccucuccgucacuccuggccaaccagccucuauuucaugcaagaguagcgagucccuuagacagucuaacgggaaaacgucgcuguacugguauaggcagaagccgggacagucaccccaauuguuaguuuucgaagugagcaaucgguuuagugguguauccgaucgcuucgugggcucugggagcggaaccgacuuuacacugcgaauaucccgugucgaggcugaagaugugggcuucuacuauuguaugcagucaaaagacuuuccucuaacuuucggugggggaaccaagguugaucucaaaagaacaguggcagccccaagugucuuuaucuuucccccuagcgacgagcagcugaagucuggcaccgcguccgugguaugccuucugaacaauuucuacccaagggaagcuaagguucaguggaaaguggauaacgccuugcaaucaggcaauagccaggagagugucacugagcaggacucuaaggauuccacauauagccucucgucuacccugacgcuguccaaagcagacuacgaaaagcacaaaguguaugccugugaggugacucaucaggggcucucaagucccgucaccaagagcuucaaccggggagaaugc

SEQ ID NO: 24179 - RNA, 720 nt, Artificial Sequence
  derived and/or modified sequence opt3 from anti-HIV_PGT151_HeavyChain
agagugcagcuggucgagagcggcgggggaguugugcaacccgguaaguccguaaggcucucuugcguggucucagacuucccuuuuaguaaauacccaauguauugggugcggcaggccccgggcaaggggcuugaauggguugcugcaaucagcggagaugccuggcacguggucuacuccaacucugugcagggccgcuuccugguaucgcgagacaauguuaaaaacaccuuguauuuagagaugaacucacugaagauugaagauacagcgguguaccguugugcuagaauguuucaggagagcggucccccuaggcuagaccgguggagugggcgcaauuauuacuauuacuccggaauggaugucuggggccaaggcacuacggugaccgugucuagcgccuccacaaaagggccaucagucuucccccucgcaccuaguagcaagucuacuuccggagguaccgccgcucugggcugccuuguuaaggacuacuuuccagaacccgugacaguaucauggaauagcggggcacugaccaguggagugcauacuuucccugccgucuugcagucuuccggccucuauagccugucgucugugguuacagugccauccucaagucuggguacccagacguacauauguaacgucaaucacaaaccgagcaacacuaagguggauaaaagaguagagcccaaguccugcgacaaa

SEQ ID NO: 24180 - RNA, 657 nt, Artificial Sequence
  derived and/or modified sequence opt3 from anti-HIV_PGT152_LightChain
gacaucgugaugacccagacaccccugagccucuccgucgauccuggccaaccagccucuauuucaugcaagaguagccagucccuuagacagucuaacgggaaaacuucgcuguacugguaucagcaaaagccgggacagucaccccaguuguuaauauucgagguuagcaauagguuuagugguguguccgaccgguucguaggcucugggagcggaacggauuuuacccugcgcaucucccgaguggaagcugaggacgucggcuucuacuauuguaugcagucaaaagauuuuccucuaacauucggugggggaacuaagguggaccucaaacguaccguugcagccccaaguguguuuauuuuucccccuagcgaugaacaacugaagucuggcacagcguccgucgugugccuucugaacaauuucuacccaagagaggcuaagguacaguggaaaguugacaacgccuugcagucaggcaauagccaggaaagugugaccgagcaagauucuaaggacuccacuuauagccucucgucuacacugacccuguccaaagcagauuacgagaagcacaaagucuaugccugugaagugacgcaucaggggcucucaagucccgugacuaagagcuucaacaggggagagugc

SEQ ID NO: 24181 - RNA, 720 nt, Artificial Sequence
  derived and/or modified sequence opt3 from anti-HIV_PGT152_HeavyChain
agagugcagcuggucgagagcggcgggggaguugugcaacccgguaaguccguaaggcucucuugcguggucucagacuucccuuuuaguaaauacccaauguauugggugcggcaggccccgggcaaggggcuugaauggguugcugcaaucagcgccgaugcguggcacguggucuacuccggaucugugcagggccgcuuccugguaucgcgagacaacagcaaaaauauuuuguauuuagagaugaacacccugaagauagaagauacagcuguuuaccguugugccagaauguuucaggagucaggucccccuagguucgacaguugguccgggcggaauuauuacuauuacucuggaauggauguguggggccaaggcacuacggucaccgugagcuccgcaucaacaaaagggccaaguguguuuccccuagccccuagcucuaaguccacuucaggagguaccgcugcacucggcugccuggucaaggacuacuucccagaacccguuacagugagcuggaacaguggggcccuuaccucuggaguacauacuuuuccugcugugcugcaguccagcggcuuguauucgcucucuuccgucgugacaguuccaucaaguagccuggguacccagacguacaucuguaaugugaaccacaaaccguccaauacuaaggucgauaaacgcguggagcccaagucuugcgacaaa

SEQ ID NO: 24182 - RNA, 309 nt, Artificial Sequence
  derived and/or modified sequence opt3 from anti-HIV_VRC-CH30_LightChain
gacauccagaugacccaaagccccuccucucugucagccagucucggcgauagagugacaauuacuugccaggcuagcagggggauaggaaaggaccuuaacugguaccagcagaaaccugguaaggcaccaaaacuguuggucuccgaugccucuaucuuagagggcgggguuccgucgcgguucucaggaagcggcuuucaccaaaauuucagucugacgauuuccucucuacagcccgaagacguggcgaccuauuuuugucagcaguacgagacauucggucaagggacuaagguagauaucaaa

SEQ ID NO: 24183 - RNA, 393 nt, Artificial Sequence
  derived and/or modified sequence opt3 from anti-HIV_VRC-CH30_HeavyChain
caggugcaacugguccagagcggcgccgcuguuagaaagcccggggcauccgugaccguaucuugcaaauucgccgaggacgaugacuacucaccucacugggugaacccagcgccggaacauuauauccacuuucucaggcaggcucccggacagcaacuugaguggcuggccuggaugaauccuacaaacggugcagucaauuacgccuggcaguugcauggccgguuaacugcuacgcgcgaugggaguaugaccacagcauuccuggaagugcgaagccuacguuccgacgauacugccguuuauuacugugcuagagcccagaagaggggacggucugagugggcguaugcacacuggggccaggguaccccaguggccgucucguca

SEQ ID NO: 24184 - RNA, 309 nt, Artificial Sequence
  derived and/or modified sequence opt3 from anti-HIV_VRC-CH31_LightChain
gacauccagaugacccaaagccccuccucucugucagccagucucggcgauagagugacaauuacuugccaggcuagcagggggauaggaaaggaccuuaacugguaccagcagaaagcagguaaggccccuaaacuguuggucuccgaugcgucuacguuagagggcgggguuccaucgcgguucucaggaagcggcuuucaccaaaauuucagucugaccaucuccucucuacaggcugaagacguggccacauauuuuugucagcaguacgagacuuucggucaagggaccaagguagauauuaaa

SEQ ID NO: 24185 - RNA, 393 nt, Artificial Sequence
  derived and/or modified sequence opt3 from anti-HIV_VRC-CH31_HeavyChain
caggugcaacugguccagagcggcgccgcuguuagaaagcccggggcauccgugaccguaucuugcaaauucgccgaggacgaugacuacucaccuuauugggugaacccagcgccggaacacuuuauccauuuccucaggcaggcucccggacagcaacuugaguggcuggccuggaugaauccuacaaacggugcagucaauuacgccugguauuugaacggccgggugacugcuacgcgcgaucgaaguaugaccacagcauuuuuagaaguuaagagccugcguuccgacgauacugccguguacuauugugcuagagcccagaaaagggggcggucugagugggcguacgcacacuggggacagggcaccccagucgugguaucguca

SEQ ID NO: 24186 - RNA, 309 nt, Artificial Sequence
  derived and/or modified sequence opt3 from anti-HIV_VRC-CH32_LightChain
gacauccagaugacccaaagccccuccucucugucagccagucucggcgauagagugacaauuacuugccaggcuagcagggggauaggaaaggaccuuaacugguaccagcagaaaccuggucgggcaccaaagcuguuggucuccgaugccucuaucuuagagggcgggguuccgacgcgcuucucgggaucaggcuuucaccaaaauuucagccugaccauuaguucccuacaggcggaagacguggcuacauauuuuugucagcaguacgagacuuucggucaagggaccaaaguagauaucaag

SEQ ID NO: 24187 - RNA, 393 nt, Artificial Sequence
  derived and/or modified sequence opt3 from anti-HIV_VRC-CH32_HeavyChain
caggugcaacugguccagagcggcgccgcuguuagaaagcccggggcauccgugaccguaucuugcaaauucgccgaggacgaugacuuuucaccucacugggugaacccagcgccggaacauuacauccacuuccucaggcaggcucccggacagcaacuugaguggcuggccuggaugaagccuacaaauggugcagucaacuaugccuggcaguugcagggccgggugacuguuacgcgcgaucgaagucagaccacagcauuuuuagaagugaaaaaucugcguagcgacgauacugcugucuacuauugugccagagcucaaaagagggggcgguccgagugggccuacgcgcauuggggacagggcaccccagugguaauuucugca

SEQ ID NO: 24188 - RNA, 309 nt, Artificial Sequence
  derived and/or modified sequence opt3 from anti-HIV_VRC-CH33_LightChain
gacauccagaugacccaaagccccuccucucugucagccagucucggcgauagagugacaauuacuugccaggcuagcagggggauaggaaaggaccuuaacugguaccagcagaaacggggucgcgcaccucgacuguuggucuccgaugccucuguuuuagagggcggggugccaucgcguuucucaggaagcggcuuucaccaaaauuucagucugacgaucuccacccuacagccggaagacguagcgacauauuuuugucagcaguacgagacuuucggucaagggaccaagguggauauuaaa

SEQ ID NO: 24189 - RNA, 393 nt, Artificial Sequence
  derived and/or modified sequence opt3 from anti-HIV_VRC-CH33_HeavyChain
caggugcaacugguccagagcggcgccgcuguuagaaagcccggggcauccaucucugugucaugcaaauucgccgacgcggaugacuacaguccucacuggaugaacccagcuccggagcauuauauucacuuucucaggcaggcccccggacagcaacuugaauggcuggcauggaugaauccuaccaacggugccguaaauuacgcuugguauuugaacggccgggugacagcaacucgcgaucgaagcaugacgaccgccuucuuagagguccguucccugagaucugacgauacagcuguguacuauugugccagggcgcagaagcgggcacgcucggaaugggccuacgcucauugggggcagggaacuccaguuguggucucaagc

SEQ ID NO: 24190 - RNA, 309 nt, Artificial Sequence
  derived and/or modified sequence opt3 from anti-HIV_VRC-CH34_LightChain
gacauccagaugacccaaagccccuccucucugucagccagucucggcgauagagugacaauuacuugccaggcuagcagggggauaggaaaggaccuuaacugguaccagcagaaagcagguaaggccccuaaacuguuggucuccgaugcgucuaucuuagagggcgggguuccaucgcgguucucaggaagcggcuuucaccaaaauuucagucugacgauuuccucucuacagccggaagacguggcuaccuauuuuugucagcaguacgagacauucggucaagggacuaagguagauaucaaa

SEQ ID NO: 24191 - RNA, 393 nt, Artificial Sequence
  derived and/or modified sequence opt3 from anti-HIV_VRC-CH34_HeavyChain
caggugcaacugguccagagcggcgccgcuguuagaaagcccggggcauccgugaccguaucuugcaaauucgccgaggacgaugacuggucaccucacugggugaacccagcgccggaacauuacauccacuuucucaggcaggcucccggacagcaacuugaguggcuggccuggaugaauccuacaaacggugcagucaauuaugccuggcaguugaacggccgguuaacugcuacgcgcgauaccaguaugacaacugcauuccuggaaguuaagagccuacgauccgacgauaccgccguguacuauugugcucgugcccagaaaagagggaggucugagugggcguacgcacauuggggacagggcacaccaguggucgugucguca

SEQ ID NO: 24192 - RNA, 306 nt, Artificial Sequence
  derived and/or modified sequence opt3 from anti-HIV_VRC-PG04_LightChain
gagaucgugcugacccagagccccggcacacucucccuuucuccuggggaaacugccucacugaguugcacggcugcaagcuacggacacaugaccugguaucaaaagaaaccaggucagccgcccaaguuguuaauuuucgccacauccaaaagagcgucuggcauaccugacagguuuucggggucacaguucggaaagcaguacacucugaccaucacacggauggagccagaagauuuugcucgcuauuacugucaacagcuagaguucuuuggccaggguacccgacucgaaauucguaga

SEQ ID NO: 24193 - RNA, 375 nt, Artificial Sequence
  derived and/or modified sequence opt3 from anti-HIV_VRC-PG04_HeavyChain
caggugcaacugguccagagcggcuccgggguuaagaaacccggagccucugugagaguaucaugcuggaccagugaggacaucuucgaaaggacagagcucauucacugggugcggcaggcuccuggucagggccuugaauggauagggugggucaagacugugacgggagcaguuaacuuuggcagcccagauuuccgccaacgagugucccugacccgugacagagauuuguuuacagcccauauggacaucagggguuuaacucagggggauaccgcgacauacuucugugcucggcagaaauuuuauaccggaggccagggcugguacuucgaccugugggggcgcggaacucuaauugucgugucuucg

SEQ ID NO: 24194 - RNA, 303 nt, Artificial Sequence
  derived and/or modified sequence opt3 from anti-HIV_VRC-PG04b_LightChain
gagaucgugcugacccagagccccggcacacucucccuuucuccuggggaaacugccucacugaguugcacggcugcaagcuacggacacaugaccugguaucaaaagaaaccaggucagccgcccaaguuguuaauuuucgccacauccaaaagagcgucuggcauaccugacagguuuucggggucacaguucggaaagcaguacacucugaccaucacacggauggagccagaagauuuugcuggcuauuacugucaacaggucgaguucuuuggucaggggacccgccuagaaauucga

SEQ ID NO: 24195 - RNA, 375 nt, Artificial Sequence
  derived and/or modified sequence opt3 from anti-HIV_VRC-PG04b_HeavyChain
caggugcaacugguccagagcggcuccgggguuaagaaacccggagccucugugagaguaucaugcuggaccagugaggacaucuucgaaaggacagagcucauucacugggugcggcaggcuccuggucagggccuugaauggauagggugggucaagacugugacgggagcaguuaacuuuggcagcccaaauuuccgccaucgagugucccugacccgugauagagacuuguuuacagcccacauggauaucagggguuuaacucaaggggacaccgcgacauacuucugugcucggcagaaauuugagcgcggaggccagggcugguauuucgaucugugggggagaggaacccuaauugucgugucuucg

SEQ ID NO: 24196 - RNA, 612 nt, Artificial Sequence
  derived and/or modified sequence opt3 from anti-HIV_VRC-PG20_LightChain
cagagcgcccugacccaacccccuuccgugucuggcucaccagggcagaguaucacacucagcugcacuggagcuuccacgucugucgcaugguaccagcaguaugccgacaaggcgccgagacuuauuguuuucgaugguaacaaaaggcccucggacauaucaagccgguuuaguggcucccaaucugggggaaccgcuagccugacaaucuccggcuugcagucagaggaugaagccuacuaucacuguaaugcauucgaguuuuucggugggggaacuaaguuaaccgugcugagucagccuaaagccgcuccaagcguaacacuauuucccccuucuuccgaggaacuccaggcaaacaaggccacccuggugugccuuauuucagacuucuacccaggcgcugucacuguggccuggaaagcggauagcagucccguuaaggcaggcguggaaacaaccacgccuucuaagcaauccaauaacaaauaugccgcuagcucguaccugucuuugacuccagagcaguggaagucccauaaaucauauaguugucaggucacccacgaggggagcacaguggaaaagacuguagccccgaccgagugc

SEQ ID NO: 24197 - RNA, 681 nt, Artificial Sequence
  derived and/or modified sequence opt3 from anti-HIV_VRC-PG20_HeavyChain
gaggugcaccugaugcagagcggcaccgaaaugaagaaacccggggccuccgucagaguuacaugccaaacuucuggauacacguucucagacuauuuuauccauuggcucaggcaagugccuggucggggcuucgaguggaugggguggaugaacccacaguggggacagguaaauuacgcucgcaccuuucagggccgagugacaaugacucgugaugucuauagagaaguggcauaccuugaccugaggaguuugaccuucgccgauacagcgguuuauuuuugugcucggcgcaugagaagccaggacagggagugggauuuccagcacuggggucaggggacccggauuauaguguccucugccucgacuaagggaccgucagucuuucccuuagcaccuagcaguaaauccacaucuggcggcaccgccgcucuggggugccuagugaaggacuacuucccagaacccguaacgguuagcuggaacuccggagcacucacuucaggugugcauaccuuuccugccguccugcaaaguagcggccuuuauucucuguccucaguggugacagucccaagcaguucuuuggggacucagaccuacaucuguaauguuaaccacaaacccuccaauacaaagguggauaagaaaguagagccuaagagcugcgacaaa

SEQ ID NO: 24198 - RNA, 1059 nt, Artificial Sequence
  derived and/or modified sequence opt3 from anti-HIV_VRC-PG20_G-Chain
guguggaaggacgccgauaccacacuguucugcgcuagcgacgcaaaagcccacgagacugaaguccauaacguuugggcgacgcacgcuugugugcccaccgauccuaauccacaggagauccaucucgaaaacguaacagagaauuuuaacauguggaagaauaacaugguggaacaaaugcaggaggacgucauuucccuuugggaucagucucugcagccgugcgugaaauugacuggcgggucaguuauaaagcaagccugucccaaaaucaguuucgacccuauuccaauccacuacugcacccccgcaggauaugugauuuuaaaguguaaugauaagaacuuuaaugguacaggcccuugcaaaaacgucagcuccgugcaguguacccaugggaucaagccaguaguuucuacucagcugcuacucaauggaucgcuggccgaggaagagauaaucauuagaucagaaaaccuuacaaauaacgcuaaaaccaucauugugcaccugaauaagagcgucgagaucaacugcacgaggcccaguaacggcgguuccgggucuggaggcgacauacggaaagcauacugugagauuaauggcacuaaguggaacaagguguugaaacaggugaccgaaaagcucaaagagcacuucaauaacaagacaaucauuuuucaaccuccaagcgggggagaucuggaaaucacuaugcaucacuucaauugccgcggugaguuuuucuauuguaacaccacacagcuguuuaauaauaccugcaucggcaacgaaacgaugaaagggugcaacggaacuauuacacucccguguaagauaaaacagaucauuaauauguggcagggcaccggucaagccauguacgcucccccuaucgacgggaagauaaacugcgucuccaauauuacuggaaucuuacugacacgagauggcggcgccaacaauaccucaaacgagacguuccguccagggggagguaacaucaaggacaauuggagaagugagcuuuauaaauacaagguugugcagauugaa

SEQ ID NO: 24199 - RNA, 312 nt, Artificial Sequence
  derived and/or modified sequence opt3 from anti-HIV_VRC02_LightChain
gaaaucgugcugacccagagccccggcacacucucccuuucuccuggggaaacugccauuauaucaugcagaacgagucaauacggaagccuggcuugguaucagcagaggccaggucaggcaccgcgguuggucaucuacuccggcucuacccgcgccgcggggauucccgaccgauucucgggaucacguuggggcccugauuauaacuuaacaaucagaaaucuggagagcggugacuuugggcuauacuauugucaacaguacgaguucuuuggacagggcacuaagguucagguggauauuaaaagg

SEQ ID NO: 24200 - RNA, 363 nt, Artificial Sequence
  derived and/or modified sequence opt3 from anti-HIV_VRC02_HeavyChain
caggugcaacugguccagagcggcgggcagaugaagaaacccggagaguccaugagaaucucuugccaggccucagguuacgaguucauugacuguacccucaacuggguuaggcuugcuccuggccggcgcccagaauggaugggguggcugaagccgcgaggaggcgcagugaauuaugcccgucccuugcaagguagaguaacaaugacuagggauguguacagugacacggcguuuuuagaacugcggagccuaaccgcugaugacacagccgucuauuacugcacucgcgggaaaaacugugauuauaauugggacuucgagcacuggggaagaggcaccccugugacaguuuccucu

SEQ ID NO: 24201 - RNA, 309 nt, Artificial Sequence
  derived and/or modified sequence opt3 from anti-HIV_VRC03_LightChain
gagaucgugcugacccagagccccggcauucucucccuuucuccuggggaaacagccacucuguucugcaaggcuucacaaggagguaacgcaaugacgugguaccagaaaagaaggggccaggucccacgguuguuaauauaugacaccagucgccgagccagcgggguuccggaucguuuugugggauccggcucugguacagacuucuuucugacuaucaauaagcuagauagagaggacuucgcgguauacuauugucagcaauuugaguucuuugggcucggaucggaacuggaagugcacagg

SEQ ID NO: 24202 - RNA, 390 nt, Artificial Sequence
  derived and/or modified sequence opt3 from anti-HIV_VRC03_HeavyChain
caggugcaacugguccagagcggcgccguuaucaagacccccggguccucugugaaaauuucaugcagagcuaguggauacaacuucagggacuauagcauacacuggguacggcucaucccugauaaggguuuugaguggauuggcuggaucaaaccacuuuggggagcaguguccuacgcccgccagcugcaggggcgagucucuaugacacgucaauugucgcaggacccggaugaccccgauuggggcguggcguauauggaguucucagguuuaacuccugcugacacggccgaauacuuuuguguuagaagggggagcugcgauuauuguggagacuucccauggcaguacuggggccagggcaccguggucgugguaaguucc

SEQ ID NO: 24203 - RNA, 630 nt, Artificial Sequence
  derived and/or modified sequence opt3 from anti-HIV_VRC23_LightChain
gagaucgugaugacccagagccccgucacaguuuccgugucuagaggcgggacugccacgcugucaugcagggcuagucaaggaguagguagcgacguggcaugguaccagcacaagccuggccagaccccacggcuccuuauuuauggggccuccacacgcgcgucuggagucccggaacgauucucgggcucagguuuucauguggauuucacucugagcauaaguggguugcagcccgaggacguugcuaucuacuauugucaacaguacgaaaccuuuggacagggcacaaaaguggagauuaagcguaccgucgccgcaccuuccguguucaucuuuccacccucugaugaacaguuaaaaagcggcacugccuccguaguuugccugcuaaacaauuucuauccuagagaggcuaaggugcaauggaaagucgacaacgcacuccagucagggaauagucaggagagcgugacagaacaggauucuaaggacuccaccuacucacugagcaguacgcuuacucugucuaaggccgauuaugagaaacacaagguguacgcuugugaagucacccaucaaggauuguccagcccaguuacaaaaucguuuaacaggggugagugc

SEQ ID NO: 24204 - RNA, 672 nt, Artificial Sequence
  derived and/or modified sequence opt3 from anti-HIV_VRC23_HeavyChain
gaggugcaguucguccaaagcggcgccgaaguuaagaaacccggggcuuccgugagaguaucuugcgaggcaucaggauacaguuuuaccgacuaugugcugcaguggaucaggcaggccccuggucagcggccagaauggaugggcuggauuaagccggagcgcggggcggucagcuacgcuccccaauuccagggacgacucacacuuacucgugaucuguauacggaaaccgccuacaugcacuuuaaaaacuugagauccgacgauacagcaauauauuacugugccaggggcgugcggcgcgacgcuucuuggugguuacaguucuggggucaggggacucugguuaccgugucgucagcaagcacaaagggaccuagugucuuuccacuagcccccuccucuaaaagcaccuccggcggcacugcugcccucgggugccuggugaaggauuauuucccugagccaguaacaguuucauggaauaguggagcgcuuaccagcggugugcauacguuucccgcaguccugcaaucuuccggcuuguacucacucagcaguguggugacugucccuucuuccagccuggggacccagacauacaucuguaacguuaaucacaagccaucgaacacuaaaguggacaagaaaguagagccgaagucuugc

SEQ ID NO: 24205 - RNA, 1077 nt, Artificial Sequence
  derived and/or modified sequence opt3 from anti-HIV_VRC23_G-Chain
guguggagagacgccgauaccacacuguucugcgcuagcgacgcaaaggccuacgagacugaaaaacacaacgucugggcgacgcaugcuuguguucccaccgauccuaauccacaggagauccaccucgacaacgugacagaaaaguuuaauauguggaaaaacaauaugguagagcaaaugcauacugauauuauaucccuuugggaccagucucugaagccgugcgugaaauugaccggcgggucagccaucacacaggcaugucccaaggucaguuucgaaccuauuccaauccacuauugcacccccgccggauuugcuauuuuaaaguguaaagaugaggguuucaacggcacugggcugugcaagaaugugagcacaguucaguguacccauggaaucaaaccuguggucuccacgcaacuacuccugaacggcucucuugcagagaagaauauaacuaucaggucggaaaacauuaccaauaacgccaaaaucauuaucgugcagcugguacagccaguuacaauaaagugcauucggcccaauaacggugggucaggaagcggcggcgacauccgccaggcucacuguaaugugacucgaagucguuggaacaagaccuugcaagaggucgccgaaaaacucagaacauacuuugggaacaagaccauuaucuucgcaaauuccucuggaggugaucuggagaucacgacucacagcuuuaacugcggcggggaguucuuuuauuguaauacauccggacuguucaacucaaccugguacgugaauaguacuuggaacgacacagauagcacccaggaaucuaaugacacgauuacccucccuugcaggauaaaacagaucauuaacauguggcagcgggcgggccaagccauguaugcuccaccgauccccggugugauaaagugcgaguccaauauuacaggguuacugcuuacucgcgauggaggcaaagacaacaaugucaacgaaaccuuuagaccuggcgggggagacaugagggauaauuggcggucagaguuguacaaguauaaaguuguggaaaucgag

SEQ ID NO: 24206 - RNA, 648 nt, Artificial Sequence
  derived and/or modified sequence opt3 from anti-HIV_5CCK_LightChain
cagagcgcccugacccaacccgcuuccgugucugcaucaccuggccagaguaucacaauuagcugcuccgggacuagaucugacgucggagguuacgauuucguuucgugguaucagcagcacccaggcaaggugccgaaacucauaaucuacgagguaacgaagaggcccucagggauuccucaacgguuuagcggaaguaaauccggcaacaccgccucucuuacaaucagcggucugcaggcggacgaugaagcugacuauuacuguugcuccuaugccaauuacgauaaguugauuuuagggggaggcacuaaacugaccgugcuaggccagccaaaggcaaaccccacagucacccucuucccuccaucaagugaggaacugcaggccaauaaggcuacucuugugugucugaucagcgacuuuuaucccggggcaguuacaguggccuggaaagcugauggaucuccugucaaggccgguguggagaccacgaaaccauccaagcaaucaaacaauaaauacgcggcaagcaguuacuugucucucacuccggaacaguggaagucccaucgcagcuauucgugccagguaacccacgagggcucuacaguugagaagacuguggcccccaccgaauguucc

SEQ ID NO: 24207 - RNA, 696 nt, Artificial Sequence
  derived and/or modified sequence opt3 from anti-HIV_5CCK_HeavyChain
caggugcaacugguccagagcggcgccgagaugaaggaccccggggcuuccguuaaagugucuugcagagcaucaggauacaaguucaccgauuauuacaugcacuggguaaggcaggccccuggucagggccucgaauggguggggugggucaacacaaauggaggcuuuacuaaauauggugcgaaguuccaagggcgggugacgguuacccgcgacacaaguacuaacaccguguuucuugagcugagccgauugacauucggagauaccgcuauguacuuuugugcccguccaaugagaccggucucccauggcaucgacuauucuggcuuauucguguuucaguucugggggaggggaacuaugguaacaguuucgucagcaagcaccaaaggucccaguguguuuccucuggccccauccucuaagagcacguccggcgggacugcugcacuaggaugccucgucaaggauuacuuccccgaaccugugaccgugucauggaauaguggcgcccugacaagcgguguccacacuuuuccagcuguucuucagucuuccgggcuguauucauugagcagugugguaaccgugcccucuuccagccucggaacacagaccuacauuuguaacgucaaucauaaaccuucgaacacgaagguggacaaaaagguugagccaaaaucuugcgau

SEQ ID NO: 24208 - RNA, 648 nt, Artificial Sequence; identical to SEQ ID NO: 24084
  derived and/or modified sequence opt3 from anti-HIV_5AWN_LightChain

SEQ ID NO: 24209 - RNA, 696 nt, Artificial Sequence
  derived and/or modified sequence opt3 from anti-HIV_5AWN_HeavyChain
caggugcaacugaugcagagcggcgcccagcucagagaccccggggauucccuuaagaucucuugcaaggcuucaggauacaacuucauugacuaucacauacauugggucaggcuggcaccuggucggggcuuggaguggaugggguggaucgauccaguuggaggcauuaccaaauacgccggucaguuucaagggcgcuuaagucugacacgagacacuagcacgaauacccuauuccucgaacugucccgucuuacagcgggagauacugcuguguauuuuugugccagaucuaugaggccgguagaccacggcaucgauuacucgggccuguucguguuucauuucugggggcggggaucagacgucuuggugagcagugcauccaccaaaggucccucuguuuuuccucucgccccaagcuccaagucaacaaguggcgggaccgcugcacugggaugccuggugaaagauuauuuccccgagccugucacugugagcuggaacucuggcgcccucacauccgguguacacaccuuuccagcuguuuuacagucaagcgggcuguacagucuuucuuccguggucacggugcccagcucgucuuugggaacucagaccuauauuuguaaugugaaccauaagccuuccaauacaaaggucgacaaaaagguugaaccaaaaucaugcgau

SEQ ID NO: 24210 - RNA, 645 nt, Artificial Sequence
  derived and/or modified sequence opt3 from anti-HIV_3QEG_LightChain
gagaucgugaugaugcagagccccggcacccugucccucucuccuggggaaagagccacacuuucaugcagggcuagucaaagcgucuccucuucguaccuggcaugguaucagcagaaaccaggacaggccccgcgguuguuaauuuacggugcgucaagccgcgcuacuggcauacccgaccgauucaguggguccggaucuggcacggauuuuacccugacaaucagccgucuagagccugaagacuucgccguuuauuacugucaacaguaugguuccucaccagagacuuuugggcagggaaccaaaguggaaauuaagagaacaguagcagcccccaguguguucaucuuuccuccaagcgaugagcagcucaaaucuggcaccgcuuccgucgugugccugcuuaacaauuucuaccccagggaggcaaagguucaauggaaaguggacaacgcccugcagucaggcaauagccaggaaagugucacugagcaggauucuaaggacuccacauauagcuugucgucuacccucacgcuguccaaggcugauuacgaaaaacacaagguguacgccugugagguaacucaucaagggcugucaaguccuguuaccaagagcuuuaaccggggagagugc

SEQ ID NO: 24211 - RNA, 717 nt, Artificial Sequence
  derived and/or modified sequence opt3 from anti-HIV_3QEG_HeavyChain
caggugcaacugguccagagcggcgccgagguuaagaaacccggguccucugugaagguaucaugcagagcuaguaggggaaccuucagcuccuacgguaucacaugggugcggcaggcaccuggccaggggcucgaauggaugggaggcauuauaccaaucuuugacgucacuaacuaugcccaaaauuuccagggucgcguggcgauuacgaccgaugcugagaugucuacagccuacauggaacuucgaucgcugaaaucagaggacagcgcaguuuauuacugugccagugauucccgugacuuuucuuauuacgaaccggggacuagcuauucccacuacuacaacaucauggauguguggggacagggcaccacagucaccgugucaagugcuagcacuaagggccccucuguauucccuuuggcaccauccucaaaaagcacaagugggggaaccgccgcuuuagguugccugguuaaggacuauuuucccgagccugugacggucucuuggaacuccggcgcccuaacuagcggggugcauaccuucccagcggugcuccagucgucuggacuguacucccuuucaagugucguuacagugcccagcuccucucugggcacucaaaccuauauuuguaauguaaaucacaagccuagcaacacaaaaguggauaagagagucgagccaaaaucaugcgacaagacccau

SEQ ID NO: 24212 - RNA, 690 nt, Artificial Sequence
  derived and/or modified sequence opt3 from anti-HIV_1N0X_K-Chain
caggugcaacugguccagagcggcgccgagguuaagaaacccggggcuuccgugaagguaucuugccaggcaucaggauacagauucaguaacuuugugauccacugggucaggcaggccccuggucaacgguucgaauggaugggcuggauuaauccauauaacgggaauaaagaguuuagcgcgaaguuccaggaccgcgugaccuuuacagcugauacuuccgccaacacggcauacauggaacuccgaucucuucguucggccgacaccgcuguuuauuacugugcaagagugggaccguauucaugggaugacagcccccaggauaauuacuauauggacgucuggggcaaagguacaacugugauaguaaguuccgccucuaccaaggggccuagcguuuucccacuggcucccuccucaaagaguacaagcggaggcaccgccgcguugggcugcuuagugaaagauuacuuuccugagccagucacugugucuuggaacuccggggcacugacaucaggagugcauaccuuccccgccguccuacagagcaguggucucuacucucuguccagcguugugacgguaccuucgucuucccuuggcacucaaaccuauaucuguaaugugaaccacaagccaucaaauacaaaagucgacaagaaaguggaaccgaagaguugc

SEQ ID NO: 24213 - RNA, 645 nt, Artificial Sequence
  derived and/or modified sequence opt3 from anti-HIV_1N0X_M-Chain
gagaucgugcugacccagagccccggcacacucucccuuucuccuggggaaagagccacuuucucaugcaggaguagccacuccauucggucucgccgagucgcuugguaccaacauaagccaggacaggcaccgcgucugguuauacacggugugucgaacagagccucaggcaucagcgacagguuuaguggguccggaucuggcacggauuucaccuugacaauuacucggguagagcccgaagacuuugcguuauauuacugucagguguauggugcuagcuccuacaccuucgggcagggaacaaaacuggagcgcaagagaaccgucgccgcaccuucaguguuuaucuucccacccagugaugaacaacuaaaaagcggcacugccucuguugugugccuccugaauaacuuuuauccuagggaggcuaagguccaguggaaaguggacaaugcacuucaguccggcaacucacaggagagcguaacagaacaagauaguaaggacucuaccuacucccugagcucgacguugacucucucuaaggccgauuaugagaaacauaagguuuacgcuugugaagugacccaccaggggcugcgguccccagucacaaaaucauucaaucgcggagagugc

SEQ ID NO: 24214 - RNA, 654 nt, Artificial Sequence
  derived and/or modified sequence opt3 from anti-HIV_3QEH_HeavyChain
gacaucgugaugacccagagcccccugucccucccugucacaccaggcgaggccgcuucuauuucaugcagaaguagccaaucccuucugcacacuaacggguuccaguacuuggauugguauuuacagaagccgggacagucuccccaacugcuaauauaccucgguucgaauagggcaacgggcguuccucaucgguuuucagggagcggaaguggcaccgaguucacacugaaaaucucccgcguggaagccgaagacguagguguguauuacuguaugcaggcgaaggagucuccaacuuuugggcagggaaccaaagucgaaauuaagcgaacaguggcugcccccagcguuuucaucuuuccuccauccgaugagcagcuuaaaucaggcaccgcaaguguggucugccuguugaacaauuucuauccccgugaggccaaggugcaauggaagguagacaacgcucuccagagcggcaauucucaggaauccguuacugagcaggauucaaaagacagcacauacagucugucuuccacccugacgcucagcaaggcagauuaugaaaaacacaagguguacgccugugaggucacucaucaaggguuaucgucuccugugaccaaauccuuuaacagaggagagugc

SEQ ID NO: 24215 - RNA, 696 nt, Artificial Sequence
  derived and/or modified sequence opt3 from anti-HIV_3QEH_G-Chain
caggugcaacugguccagagcggcgccgagguuagaaagcccggggcuuccgugaccguaucuugcaaaacaucaggauacacuuucgugaacuuuuauaucgucugggugaggcaggcaccuggucagggccucgaauggauggggguuauuaauccauuccggggagacacguacuuugcccaaaaguucaaaggccgcgugacccuuacacgagauaccaguacuagcacagucuuuauggagcuguccucuuugcguucggacgauaccgcgauauauuacugugcuagagacuuagaaaugagggaugguaacaaucacgggucacaucuggaguucuggggacagggcacucuagugacaguaagcagugccuccaccaagggcccgucuguuuuuccccucgcaccuagcuccaaaucaacgagugggggaacugccgcucuggguugccuugugaaggacuauuucccagaacccgucaccgugagcuggaacucuggcgcacugacauccggggugcacacuuuuccugccgucuugcagucaagcggacucuacagucugucuuccguugugaccguaccaagcucgucucugggcacacagaccuauaucuguaaugugaaccauaagcccuccaauacgaaagucgauaagcggguggagccuaaaucaugcgacaagacucac

SEQ ID NO: 24216 - RNA, 678 nt, Artificial Sequence
  derived and/or modified sequence opt3 from anti-HIV_2B1H_HeavyChain
gagauccagcuggaacaaagcggcgccgaggugaagaaauccggggaaucucucaagauuucaugccagaccaguggauacagcuucuccgacuauuggauagguugggucagacagaugcccggcaaagggcuugaguggaugggaaucuuuuacccuggcgauucugacucgagguauucaccgagcuucgaaggucagguuacaaugagugcugaucgguccacuaacacggcacaucugcaauggucuagcuugaagccauccgacaccgccuuauacuauugugcgcgccuagggggagauuacgaggacucaggcgcugaugccuuugacuucuggggccaggggacacuggugacuguaaguagcgcaucuaccaaaggacccuccguguuuccucucgccccaucaagcaagaguacaucugguggcaccgcugcacuggggugccuugucaaggauuauuuccccgagccugugacuguuuccuggaauagcggagcccugacaucgggcgugcacaccuuuccagcugucuugcagucuuccggucucuacucacugaguagcgugguaacgguucccuccucuagccuggggacucagaccuacauuuguaacgugaaucacaaaccuucaaacacaaaggucgacaaaaagguggaaccaaaaagu

SEQ ID NO: 24217 - RNA, 645 nt, Artificial Sequence
  derived and/or modified sequence opt3 from anti-HIV_2B1H_LightChain
cagagcgugcugacccaacccccuuccgccucuggcacaccagggcagagaaucucaauuaguugcagcggaacuuccucuaacgucgagaauaacuacguuuauugguaccagcaccucccggguacggcucccaaacuucugauauauaggaaugaccaucggucgucaggcaucccugaucgcuucagcgcaaguaaguccgggaccucugccagcuuggcgauuuccggauuacgaccagaagacgagggcgauuacuauugugcugccugggacgauucacguggugggcccgacuggguguuuggaggcggcacaaagcugacuguacuagcacagccuaaagccgcuccaagugugacccucuuucccccuagcucugaggaacugcaagcaaacaaggccacacuugucugccugaucuccgauuucuacccaggggcugugaccguugccuggaaagcggacucaagcccggugaaggcaggagucgaaacuacaacccccaguaagcagucuaauaacaaauaugccgcuuccagcuacuugucgcucacgccugagcaguggaagucucacaaauccuacucaugucaggugacucaugaggguaguaccguagaaaagacaguugccccaacu

SEQ ID NO: 24218 - RNA, 648 nt, Artificial Sequence
  derived and/or modified sequence opt3 from anti-HIV_3TNM_B-Chain
cagagcgugcugacccaacccccuuccgccucuggcucaccagggcagagugucacaaucagcugcacuggaacguccucugacguugguggcuacaacuaugugucgugguaccagcaccauccggggaaggcucccaaacucauuauaucagagguaaauaacagaccuagcggagugccagauagguucaguggcuccaagucugguaauaccgcaagccuuacagucuccgggcugcaggccgaagacgaggcggaauauuacuguucaaguuauacugauauccacaacuuuguguucggaggcggcaccaaauugacaguuuuagggcaacccaaggcugccccuagcgugacccuguuuccacccucuuccgaggaacuacaggcaaauaaagccacucucgucugccugauuucagacuucuacccuggagcugugacaguagcauggaaggccgauagcaguccaguuaaggcugguguggagaccacgacuccgucuaaacaguccaacaauaaguaugccgcgagcucguaccuuucucugacccccgagcaguggaaaucccaucggucauacaguugucaagucacacacgaaggcagcacuguggagaagaccguggcaccuacagaaugcucc

SEQ ID NO: 24219 - RNA, 693 nt, Artificial Sequence
  derived and/or modified sequence opt3 from anti-HIV_3TNM_A-Chain
caggugcaacugcaggagagcggccccgggcucgucaagccuucccagacccuuucucugucaugcacaguuaguggagguagcuccucuucgggcgcccacuacuggucauggaucagacaguauccagggaaaggauuggaauggauuggcuacauacauuauagcgguaacacuuacuauaauccgaguuuaaaguccaggaucacgauuucucaacacaccagcgagaaccaguucucccugaaacuaaauucagugacaguagcugacacugcaguguacuauugugcccgggggacccgccuccgaacacugcguaacgcguuugauaucuggggacagggcaccauggucacugugaguagcgcuucuacaaagggccccuccguuuucccucuugccccaucaagcaaaaguaccucugggggaacggcagcccuggguugcuuggugaaggacuacuuucccgaaccugucacuguguccuggaauagcggcgcucucaccucggggguacauacauucccagcaguucugcagucuuccggacuguacucacucaguagcguggucacugugcccuccucuagcuuaggcacccaaacauauauuuguaacgugaaucacaagccuucaaacaccaaagucgauaagagaguugagccaaaaaguugcgacaagacgcauacu

SEQ ID NO: 24220 - RNA, 690 nt, Artificial Sequence
  derived and/or modified sequence opt3 from anti-HIV_3UJJ_HeavyChain
gaggugcagcugguccaaagcggcgccgaaguuaagaaacccggggagucccucaagaucucuugcaaagcuucaggauacaguuucagcuccuauuggauugcaugggugagacagaugccugguaagggccuugaauggaugggguuuauauacccagccgacucugauaccagguauucgccgucauuccagggacagggcacaaucagcgcggacaaaaguauuuccacugcuuaccugcaauggucuagcuugaaggccuccgauacggcaauguauuacugugccaucuuagguuuuuggggggcuaaccggggaggcggcgggauggacguauggggacaggguaccacagugauugucucaagugcaagcacuaagggccccucuguguucccucuggccccauccucaaaaagcaccagugggggaacagcugcccuaggcugccucguuaaggauuauuuucccgagccugugaccgucucuuggaauuccggugcgcugacuagcggggugcacacauucccagcaguacuucagucgucuggacuguacuccuugucaaguguugugaccguccccagcuccucucucggcacgcagacuuacaucuguaacgugaaucauaaaccuagcaacaccaagguggacaaaaaggucgaaccaaagucaugcgauaaaaca

SEQ ID NO: 24221 - RNA, 639 nt, Artificial Sequence
  derived and/or modified sequence opt3 from anti-HIV_3UJJ_LightChain
agcuacgagcugacccagcccccuuccgugucugucucaccaggccaaacagccagaaucacuugcaguggggacgcucucccggaaaaguaugcauacugguaucagcagaaaagcggacaggcccccguucuuauuauauacgaggauuccaagaggccuucugguaucccagaacgguucucgggcucacgcagcgggacgauggcgacccugacaauuaguggagcucaaguggacgaugaggccgacuauuacuguuauuccacuaacucuggcgguaccuuuuucguauuugggacaggaaccaaagugacugucuugggccagcccaaggcaaauccuacagugaccuuauucccacccagcuccgaggaacugcaggccaacaaagcuacgcuaguuugccucaucucagauuuuuacccuggcgcagugacugucgccuggaaggcugacaguagcccagugaaggccgggguagagaccacaacuccgucuaaacaguccaauaacaaguacgcggcaucaagcuaucugagucuuacccccgaacaauggaaaucucaccgauccuacagcugucagguuacacaugagggaucgaccguggaaaagacggucgccccuacugagugc

SEQ ID NO: 24222 - RNA, 669 nt, Artificial Sequence
  derived and/or modified sequence opt3 from anti-HIV_3UJI_HeavyChain
caggugcaacugguccagagcgccgcugagguuaagaaacccggcgaagcacucaagaucuccugcaaagggucuggauacucauucaguaacuauuggauugccugggugagacagaugccugguaagggccuugaguggauggggauaguauacccagacgauagcgacuccucuuauaauucgucauuucagggacaaaucaccuucagcgcggauaaaaguauuuccacagcuuaccugcacuggacuucuuugcaggccagcgacacggcaauguauuacugugccagguuaggcuuugaaggugauuauuccgggucauucuuugacuacuggggacagggcacccugcuaaucgugaguagcgcuucuacaaagggcccguccgucuucccccucgcaccuucaagcaagaguacuucugggggaaccgccgcucuggguugccuugugaaagauuacuuuccagagcccguuacaguguccuggaacagcggcgcccugaccucggggguccauacuuucccugcgguguugcagucuuccggacucuauucacugaguagcguaguuacagugccauccucuagccugggcacccaaacguacauuuguaaugucaaccacaagcccucaaauacuaaaguggacaagaaaguggaaccu

SEQ ID NO: 24223 - RNA, 627 nt, Artificial Sequence
  derived and/or modified sequence opt3 from anti-HIV_3UJI_LightChain
agcuacgagcugacccagcccccuuccgugucugucucaccaggccaaacagccaguaucacuugcagcggggacauucucggagauaaguauguuuccugguaccagcagaaaucuggucagucgccgcuucuggugauauaugaagacacgaagagacccucaggcaucccugauagguucagcgggaguaaauccggaaacaccgcuacauugacuauuucuggcacccaagcaauggacgaggccgauuacuauugucaggcgugggacagcacauuagguguaguguuugggggaggcaccaaggucacugugcugggccagccaaaagcugcccccuccguuacacuauucccuccaucaagugaggaacuccaggcaaauaaggccacccuggugugccuuaucagcgauuuuuaccccggggcugucacgguggcauggaaggccgacucuuccccuguaaaagcuggaguugaaacuaccacaccaucaaagcaaagcaacaauaaauaugccgcgaguucuuaccuguccuugacuccggagcaguggaaaagccacaagucguacucuugucaggugacccaugaggguuccacagucgaaaagaccguggcaccc

SEQ ID NO: 24224 - RNA, 666 nt, Artificial Sequence
  derived and/or modified sequence opt3 from anti-HIV_2QSC_HeavyChain
caggugcaacugguccagagcggcgggggacucguucagcccgguggcucccuuagacugucuugcgccgcuuucggguuuaacuucucaaguuacgugaugcacuggguaaggcaggcaccuggacaaggcuuggaguauuuaagcgccaucuccucugacggugaaaccacauaccaugcuaauucggugaaggggcgguuuacuucaagccgcgauaacaguaaaaauacgcuguuccuacagaugggaucccuccgaaccgaggacgucgcgguguauuacugugcccgugauagauauuacgaaacaucuggcagcaacgcauuugacguuuggggccaggggacuaugguggucguguccucagccaguaccaagggaccaagcguauucccgcuggcucccugcucuagguccacaucagagagcaccgcagcccuugguugucugguuaaagauuauuuuccugaaccagugacugucaguuggaacucuggcgcuuugacauccggggugcacaccuuccccgccgugcuccagagcucgggacuguacucucuguccucagucguuacggugccuaguagcaauuuuggcacucaaaccuacacaugcaauguagaccauaagccauccaacacuaaaguggauaagaccgucgag

SEQ ID NO: 24225 - RNA, 645 nt, Artificial Sequence
  derived and/or modified sequence opt3 from anti-HIV_2QSC_LightChain
aacagcgugcugacccagucccccucuucacucagugccagcgucggcgacagaguuacaaucacuugccaggcuucccaagauauuucuaauuaccuuaacugguaucagcacaagccugggaaagcaccaaagcuguugauauacacggccucgaauuuagagaccggagugccgucaagguucagcgguggcgggaguggaacacauuuuuccuucacuaucaccucucugcagcccgaagacgcggcuacauauuuuugucaacaguacgauaaccuaggcgaccucagcuucggugggggaaccaaaguagagauuaagcggacuguggccgcaccuuccgucuuuaucuucccacccucagaugaacagcugaaaaguggcacagccagcgugguuugccuucugaauaacuuuuauccucgcgaggcuaaggugcaguggaaggucgacaaugcauugcaaucuggcaacucccaggaaucagugaccgagcaggauagcaaagacaguacguacucucucuccagcacucugacccugucgaaggccgauuaugagaaacacaagguauacgcuugugaaguuacacaucaggggcucucuuccccagugacuaaaucauucaaucgaggagagugc

SEQ ID NO: 24226 - RNA, 690 nt, Artificial Sequence
  derived and/or modified sequence opt3 from anti-HIV_3MLZ_HeavyChain
caggugcaacugcaggagagcggccccgggcucgucaagccuuccgaaacccuuucucugacaugcacuguuucaggagguaguaucagcggcuuccacugguccuggauuagacagccaccggggaaaggauuggaguacauaggcuauaucuacuauucugguucgacgucauacaaccccagcuuaaagaguaggguguccaugucuguagacaccagccggaaucaguuuucccuggaacuaucaagugugacagccgcugauacugcagucuauuacugugcccgcgacuucggggaguaucauuacgauggacgaggcuuucaaugcgaaggcuucgaccucugggggcagggaacccuggugacaguuagcucugcguccaccaaagguccuucaguguuuccacuugcucccagcaguaagucuacuuccggcgggacagccgcacugggauguuuggucaaagauuacuucccugagccagugaccguaagcuggaacucgggcgcccucacgucugguguucacacuuuucccgcugugcugcaguccucagggcuguauagucucagcuccgucgugaccgugccuucuagcucauuaggaacacagacuuacauuugcaaugucaaccauaagccaaguaauaccaagguugacaaaaagguggagccgaaauccugu

SEQ ID NO: 24227 - RNA, 642 nt, Artificial Sequence
  derived and/or modified sequence opt3 from anti-HIV_3MLZ_LightChain
cagagcgugcugacccaacccccuuccgucucugccgcuccaggccagaagguuacaaucucaugcagugggagcuccucuaacauuggaaauaacauggugucgugguaccagcagcacccggguacugcacccaaacuccuuauauaugaaaauucaaagagaccuagcggcaucccagacagguucagugggucccggucuggaacgagcgccacccugggcauuaucgguuugcaaacaggggaugaagcggaguacuauugugcuacuugggacggauccuuacgcaccguauuuggcggcgggacaaaacugaccgugcuaucacagcccaaggccgcaccuagugucacucucuucccacccagcucugaggagcugcaggccaacaaagcuacacuugugugccugauuuccgauuuuuacccuggagcaguuaccguggccuggaaggcugacucaagcccaguccgagccgguguggaaacgacuaccccgaguaagcagucuaauaacaaauaugcggcauccagcuacuugucgcucacacccgagcaauggaagucucaucguuccuauucaugucagguaacucacgagggcaguaccguugagaaaacaguggccccuaccgaaugc

SEQ ID NO: 24228 - RNA, 684 nt, Artificial Sequence
  derived and/or modified sequence opt3 from anti-HIV_3MLX_I-Chain
caggugcaacugcaggagagcggccccgggcucgucaagccuuccgaaacccuuucucugacaugcacuguuucaggagguaguaucagcggcuuccacugguccuggauuagacagccaccggggaaaggauuggaguacauaggcuauaucuacuauucugguucgacgucauacaaccccagcuuaaagaguaggguguccaugucuguagacaccagccggaaucaguuuucccuggaacuaucaagugugacagccgcugauacugcagucuauuacugugcccgcgacuucggggaguaucauuacgauggacgaggcuuucaaugcgaaggcuucgaccucugggggcagggaacccuggugacaguuagcucugcguccaccaaagguccuucaguguuuccacuugcucccagcaguaagucuacuuccggcgggacagccgcacugggauguuuggucaaagauuacuucccugagccagugaccguaagcuggaacucgggcgcccucacgucugguguucacacuuuucccgcugugcugcaguccucagggcuguauagucucagcuccgucgugaccgugccuucuagcucauuaggaacacagacuuacauuugcaaugucaaccauaagccaaguaauaccaagguugacaaaaagguggagccgaaa

SEQ ID NO: 24229 - RNA, 633 nt, Artificial Sequence
  derived and/or modified sequence opt3 from anti-HIV_3MLX_M-Chain
agcgugcugacccagcccccuuccgucucugccgcuccaggccaaaagguuacaaucucaugcagugggagcuccucuaacauuggaaauaacauggugucgugguaccagcagcacccggguacugcacccaaacuccuuauauaugaaaauucaaagagaccuagcggcaucccagacagguucagugggucccggucuggaacgagcgccacccugggcauuaucgguuugcagacaggggaugaagcggaauacuauugugcuacuugggacggauccuuacgcaccguauuuggcggcgggacaaaacugaccgugcuaucacaacccaaggccgcaccuagugucacucucuucccacccagcucugaggagcugcaggccaacaaagcuacacuugugugccugauuuccgauuuuuacccuggagcaguuaccguggccuggaaggcugacucaagcccaguccgagccgguguggaaacgacuaccccgaguaagcagucuaauaacaaauaugcggcauccagcuacuugucgcucacacccgagcaguggaagucucaucguuccuauucaugucaaguaacucacgagggcaguaccguugagaaaacaguggccccuacc

SEQ ID NO: 24230 - RNA, 684 nt, Artificial Sequence
  derived and/or modified sequence opt3 from anti-HIV_3MLW_I-Chain
caggugcaacugguccagagcggcgccgagguuaagaaagcuggggaaucccucgagaucucuugcaagggaucagguuacaccuucacagaccacuggauugcaugggugagacagguacccggcaaagggcuugaauggaugggaaugauauauccuggcgauagugacacuagguacagcccaucccugcagggucgggugacgaugucugccgauaagaccuugucgacagcguauuuacaauggucacgccuggaggcuagcgacacugccauguacuauugugcacgacuacauuacagugaucguuccgggucuuauuuuaacgacgucuuccacauguggggacagggcaccacagugaccguuagcuccgccucaacuaaaggcccgaguguguuuccccucgcuccuagcucuaaguccacaucagggggaaccgcagcccuggguugccuugucaaggauuacuucccagaacccgugacgguaagcuggaauaguggcgcucugacuucugggguucauaccuuuccugccguguugcaguccagcggacucuacucgcugucuuccgucgugacagugccaucaaguagccugggcacucagaccuauaucuguaacgucaaucacaaacccuccaacacaaagguugacaaaaagguggagccuaaaucu

SEQ ID NO: 24231 - RNA, 645 nt, Artificial Sequence
  derived and/or modified sequence opt3 from anti-HIV_3MLW_M-Chain
cagagcgugcugacccaacccccuuccgccucuggcacaccagggcagagagucacuaucucaugcaguggaaacagcuccaauauugagaacaauuacguuuauugguaccagcagcucccggguucuacgcccaaacuucugauauucagggacgaucaacggccuucgggcgugccagaccgcuuuucagggagcaagaguggaaccuccgcuucuuuggcaaucagcggcuuacgauccgaagaugaggccgacuauuacugugcgucaugggaugacagucguggugggcccgauuauguauucggaacaggcacuaaggugaccguccugggccagccuaaagcuaacccaacagugacccuauuucccccuagcucugaggaacuccaggccaauaaggcaacucugguuugccuuauuuccgacuucuacccaggggccgugacagucgcuuggaaagcagauggaucaccggugaaggccgguguagaaaccacgaagcccagcaaacagaguaacaauaaguaugcugccucuuccuaccugagcuugacuccugagcaauggaaaucgcacagaucuuacuccugucagguuacccaugagggcucaacaguggaaaagacugucgcgccaacc

SEQ ID NO: 24232 - RNA, 678 nt, Artificial Sequence
  derived and/or modified sequence opt3 from anti-HIV_3MLV_N-Chain
gaggugcagcuggucgaaagcggcggggagguuaagcaacccggacagucccucaaaaucucuugcaagucaagugguuacaacuuccuugacagcuggauuggcugggugagacagauaccugggaaaggacuggaauggaucggcauuaucuauccagaugacuccgaugcccacuacucuccgucguuugagggucagguaaccaugucaguggacaagagcauuaguacagcuuauuugcaauggacuacguuacaggcauccgauaccgggaaauacuucuguacaaggcuguaucuauuugaaggagcccagucuagcaaugcguucgaccucuggggccagggcacuaugauccuggucuccucagggaccacaaagggacccaguguguuuccucuugcuccaagcucuaaguccaccucagguggcacugccgcacuggggugcuugguuaaagauuacuuccccgagccugugacagucagcuggaacaguggagcccucaccucuggcgugcauacguuuccagcuguacugcaauccagcggucuguauucgcucucuuccguugugacuguccccucaaguagcuuagggacccagacauacauauguaaugugaaccacaagccuuccaauacuaaaguggacaagaaagucgagccaaagucu

SEQ ID NO: 24233 - RNA, 657 nt, Artificial Sequence
  derived and/or modified sequence opt3 from anti-HIV_3MLV_M-Chain
agcuaccugcucacccagcccccuuccgugucugucucaccaggccaaacagccaguaucagcugcuccggggacaaacuugaugacaaguauguuucuugguacuaucagagaccgggacagucgcccgugcuguugauguaccaggauuucaagaggccuucagguauuccagagcgguuaagcggcaguaaauccgggaagacugcuacgcugaccauaucuggaacacaaagccuagacgaaggcgauuauuacugucaggcaugggacgccuccacugguguaucagggggaggcaccaaacucacagugcuguuuggcgaggggacccgccuuacuguccuggcgcagcccaaggcugccccuagugugacauuguucccacccagcucugaggaacuccaggcaaacaaggccacccugguuugccugaucuccgauuuuuauccuggagcugugacggucgcauggaaagccgacucaagcccagugaaggcugguguagaaacuaccacaccgaguaaacaaucuaauaacaaguacgccgcguccagcuaccucucguuaacucccgagcaguggaaaucucacaaguccuauucaugucagguuacccaugagggcaguacaguggaaaagaccgucgcaccuacg

SEQ ID NO: 24234 - RNA, 654 nt, Artificial Sequence
  derived and/or modified sequence opt3 from anti-HIV_3MLU_LightChain
uaccugcucacccagcccccuagcguguccgucucuccaggccaaacagccucaaucaguugcagcggggacaaacuugaugacaaguauguuuccugguacuaucagagaccgggacagucucccgugcuguugauguaccaggauuucaagaggccuucggguauuccagagcgguuaucaggcagcaaaagugggaagacugcuacgcugaccauauccggaacacaaucucuagacgaaggcgauuauuacugucaggcaugggacgccagcacugguguauccgggggaggcaccaaacucacagugcuguuuggcgaggggacccgccuuacuguccuggcgcagcccaaggcugccccuucagugacauuguucccacccaguagcgaggaacuccaggcaaacaaggccacccugguuugccugaucucugauuuuuauccuggagcugugacggucgcauggaaagccgacuccucaccagugaaggcugguguagaaacuaccacaccgagcaaacaaaguaauaacaaguacgccgcgucuuccuaccucagcuuaacucccgagcaguggaaaucgcacaagucuuauuccugucagguuacccaugagggcucaacaguggaaaagaccgucgcaccuacg

SEQ ID NO: 24235 - RNA, 657 nt, Artificial Sequence
  derived and/or modified sequence opt3 from anti-HIV_3MLT_G-Chain
agcuacgaccugacccagcccccuuccgugucugucucaccaggccaaacagccaguaucagcugcuccggggauaagcucgacgauaaauauguuucuugguacuaucagagaccgggacagucgcccgugcuucugauguaccaggacuucaagaggccuucagguauuccagagcgguugagcggcaguaaauccgggaagacugcuacguuaaccauaucuggaacacaaagccuggaugaaggcgacuauuacugucaggcaugggaugccuccacugguguaucagggggaggcaccaaacuaacagugcucuuuggcgacgggacccgccugacuguccuuggacagcccaaggcggcuccuagugugacacuguucccacccagcucugaggaauugcaggccaacaaggcaacccucguuugccugaucuccgauuuuuauccuggugccgugacggucgcuuggaaagcagacucaagcccagugaaggccggcguagagacuaccacaccgaguaaacaaucuaauaacaaguacgcugccuccagcuaccugucgcucacucccgaacaguggaaaucucacaaguccuauucaugucagguuacccaugaggggaguacaguggagaagaccgucgcgccuacg

SEQ ID NO: 24236 - RNA, 666 nt, Artificial Sequence
  derived and/or modified sequence opt3 from anti-HIV_3GO1_HeavyChain
gaggugcagcugcaagaaagcggccccgggcucgucaagccuuccgagacccuuucucugacaugcacuguuucaggagguccaaucaacaaugccuacuggacguggauuagacagccgcccggcaaaggguuggaauauuuaggauacguguaucacaccggcguaacaaacuacaauccuagucugaagucuaggcuaacuauaaccaucgacacaucccggaaacagcucucucugucgcuuaaguucgugaccgcugcagauucagccgucuauuacugugcgcgcgagugggcugaagacggugauuuugggaacgccuuccauguguggggacagggcacuaugguugcagugagcagugccuccacaaaaggcccaucugucuuuccccuggcuccuagcuccaagucaaccagugggggaacggcagccuuggguugccucgugaaggacuauuucccagagcccguaacuguuagcuggaauagcggcgcucugaccuccggggugcacacauuuccugccguccugcaaucaagcggacucuacaguuuaucuuccguggugacugucccaagcucgucucugggcacccagacauacauuuguaacguuaaucauaaaccguccaacaccaagguggauaaacgaguagagccc

SEQ ID NO: 24237 - RNA, 627 nt, Artificial Sequence
  derived and/or modified sequence opt3 from anti-HIV_3GO1_LightChain
agcuacgugcugacccagcccccuuccgucucuguuucaccaggccaaacagccagaaucacuugcagugcugaggcacucagcaaccaguaugccuacugguauaggcagcggccggggcaggcgccccuucugauuauauacaaggacacgaaacgcccuuccggaaucccagaacgauucucugguucgaccucaggcacaacugugaccuugacaauuagcgggguacaagcugaggaugaagccgacuauuacugucagagugcagauuccucuggagacuauguguuuggcggugggaccaaggucacuguguuaggacagcccaaagccaauccuacaguuacccuguucccacccagcuccgaggaacuacaggcuaacaaggcaacgcucgugugccugaucucagauuuuuacccuggcgccgucacuguggcuuggaaagccgacggcaguccaguaaaggcggggguugagaccacaaagccgagcaaacaaucuaauaacaaguacgcagccuccucauaucuuagccugacucccgagcaguggaaaagucaccguucuuacuccugucaggugacccaugaaggaagcacagucgagaagaccguggcuccu

SEQ ID NO: 24238 - RNA, 690 nt, Artificial Sequence
  derived and/or modified sequence opt3 from anti-HIV_4XCY_J-Chain
caggugcaacugguccagagcggcgccgagguuaagagacccggguccucugugaccguaucaugcaaagcuaguggagguagcuucuccacauacgcacucucuugggugaggcaggccccuggccgggggcuugaauggaugggaggcgucaucccacuguugacuauuacgaacuaugcgccgcgcuuucagggucgaauaaccaucacagcugaccguucgacuucaaccgccuacuuagagcugaauagccuaagacccgaagauacagcaguguauuacugugccagggaggggaccacuggauggggcuggcucggcaagccuauuggggcuuucgcacacuggggacaagguacacugguuaccgugaguuccgccucuacgaaaggcccaagcgucuuuccccuugcuccuuccucaaagaguacuagcgggggaaccgccgcgcugggcugcuuggugaaagacuauuucccagaacccguaacaguuucuuggaacuccggugcacucacuucaggggugcauaccuuuccugccguccugcagagcaguggacuguacucucucuccagcguggugacagucccaucgucuuccuuaggcacccagacguauaucuguaauguuaaccacaagccgucaaauacuaagguggauaaaaagguagagcccaaaaguugc

SEQ ID NO: 24239 - RNA, 645 nt, Artificial Sequence
  derived and/or modified sequence opt3 from anti-HIV_4XCY_K-Chain
gagaucgugcugacccagagccccggcacacaaucccucucuccuggggaaagagccacucuuucaugcagggcuagucagagcgucggaaacaauaagcuggcaugguaccagcagcggccaggucaagccccgcgcuuguuaauuuauggcgcguccucucgacccucggggguugcugaccguuucucaggaagcggcagugguacggauuuuacccugacaauauccagacuagagccugaagacuucgccguguacuauugucagcaguacgggcagucucucagcacuuuuggacaaggcaccaaaguagaggugaagaggacagucgcagccccauccguguucaucuuucccccuucagaugaacagcugaaaaguggcaccgcuagcguugugugccuucugaacaauuucuauccacgggaggcaaagguccaguggaaaguggacaacgccuugcagucuggaaauucccaagagucaguaacugaacaggauagcaaggacaguacauacucucucuccagcacccugacgcugucgaaggcugauuaugagaaacacaagguuuacgccugugaagugacucaucaggggcucucuucccccgucaccaaaucauuuaaccgcggugagugc

SEQ ID NO: 24240 - RNA, 630 nt, Artificial Sequence
  derived and/or modified sequence opt3 from anti-HIV_4YBL_C-Chain
gugcugacccagcccccuagcgccuccggcucuccagggcaaucagucacaaucaguugcacuggaacgagcuccgacguugguggcuacaacuaugugucuugguaccagcaccauccggggaaggcucccaaacucauuauaucggagguaaauaacagaccuucaggagugccagauagguucagcggcaguaaguccgguaauaccgcaucucuuacagucagcgggcugcaggccgaagacgaggcggaauauuacuguuccucauauacugauauccacaacuuuguguucggaggcggcaccaaauugacaguuuuagggcagcccaaggcugccccuagugugacccuguuuccacccagcucugaggaacuacaagcaaauaaagccacucucgucugccugauuuccgacuucuacccuggagcugugacaguagcauggaaggccgauucaagcccaguuaaggcugguguggagaccacgacuccgaguaaacagucuaacaauaaguaugccgcguccagcuaccuuucgcugacccccgagcaguggaaaucucaucgguccuacucaugucaggucacacacgaaggcaguacuguggagaagaccguggcaccu

SEQ ID NO: 24241 - RNA, 672 nt, Artificial Sequence
  derived and/or modified sequence opt3 from anti-HIV_4YBL_B-Chain
caggugcaacugcaggagagcggccccgggcucgucaagccuucccagacccuuucucugucaugcacaguuaguggagguagcuccucuucgggcgcccacuacuggucauggaucagacaguauccagggaaaggauuggaauggauuggcuacauacauuauagcgguaacacuuacuauaauccgaguuuaaaguccaggaucacgauuucucaacacaccagcgagaaccaguucucccugaaacuaaauucagugacaguagcugacacugcaguguacuauugugcccgggggacccgccuccgaacacugcguaacgcguuugauaucuggggacagggcaccauggucacugugaguagcgcuucuacaaagggccccuccguuuucccucuugccccaucaagcaaaaguaccucugggggaacggcagcccuggguugcuuggugaaggacuacuuucccgaaccugucacuguguccuggaauagcggcgcucucaccucggggguacauacauucccagcaguucugcagucuuccggacuguacucacucaguagcguggucacugugcccuccucuagcuuaggcacccaaacauauauuuguaacgugaaucacaagccuucaaacaccaaagucgauaagagaguugagccaaaa

SEQ ID NO: 24242 - RNA, 630 nt, Artificial Sequence
  derived and/or modified sequence opt3 from anti-HIV_4R4N_X-Chain
gacauccagaugacccaaagccccuccuucgugucugccucagucggcgauagaguuacaauuacuugcagggcuagucaggggauaagcuccuaccuggcaugguaucagcagaagccuggaaaagccccaaagcucgugaucuacgcggcuucuacgcuucaaucggguguaccgucacgguuuagcggcaguggguccggaaccgaguucacacugacuauuucuagcuugcagcccgaagacuuugccaccuauuacugucagcacuuaaucggccugcgcuccuucggucaggggacaaaacuagagauuaagcgaaccguggcagccccuucagucuuuaucuucccacccagugaugaacaacucaaaagcggaacugcuucugugguuugccugcuuaacaauuuuuauccucgugaggcaaaggugcaguggaaggucgacaacgcccugcaguccggcaauucacaggaaagcgugacagagcaagauaguaaagacucuaccuacuccuugagcucgacgcucacucugucuaaggcugauuaugagaaacauaagguauacgccugugaaguuacccaccagggccuguccucaccagugacaaaaaguuucaacaga

SEQ ID NO: 24243 - RNA, 660 nt, Artificial Sequence
  derived and/or modified sequence opt3 from anti-HIV_4R4B_F-Chain
caggugcaacugcagcaguggggcgccgggcuccuuaagcccagcgagacccuguccuugacaugcggagucuacggugaaucuuuaucaggccacuauuggaguuggguuagacagccuccagggaaaaggcuggaguggaucggagaaauuaagcauaacggcagcccgaauuaccaccccucccuaaaaucucgggugacuauaucgcucgacaugucaaagaaccaauucagccugaaucuuacgaguguaaccgcugcagauacagccguguauuuuugugcgcgccgauccaacuggccuuaccugccauucgaccccuggggucaggggacuuuggucaccgugucuagcgcuuccacaaaaggaccuucaguuuuuccacucgcccccaguagcaagucuaccuccggcggcacugcagcccuggggugccuggugaaggauuauuucccugagccagucacagugucauggaauagcggagcucucaccagugguguacauacguuuccggcaguuuuacagucuuccggccuguacagccuuucgucuguggucacugugcccuccucaaguuuggggacccagacauauaucuguaacgugaaucacaaaccuagcaacacuaaggucgacaaaaagguugaaccaaaa

SEQ ID NO: 24244 - RNA, 750 nt, Artificial Sequence
  derived and/or modified sequence opt3 from anti-HIV_3JUY_D-Chain
caggugcaacugguccagagcggcgccgagguuaagaaacccggggcuuccgugaagguaucuugccaggcaucaggauacagauucagucacuuuaccgugcauugggucaggcaggccccuggucaacgguucgaauggaugggcuggaucaacccauauaaugggaacaaagaguuuagcgcgaaguuccaggaccgcgugacauuuacugcugauacguccgccaauaccgcauacauggaacuccgaucucuucguucggccgacacagcuguuuauuacugugcaagagugggagaguggggcugggaugacucaccguaugauaacuacuauauggacgucugggguaaagggacuaccgugauuguaagcaguggaggcggcggguccggagguggcgggucuggaggcggugggagcgaaauaguucugacacaggcccccggaaccuuguccuuaucaccuggcgagagggcuacuuucaguugccggagcucucacuccauccgcucaagaaggguggccugguaccagcauaagccaggccaagcgccccggcuggucauucacggggugagcaaucgcgcaaguggaaucucugaucgauuuuccgguagcggcucggggacagacuucacccuaacgauuacuagaguggagccugaagauuuugcccucuacuauugucaggucuacggagcuucuuccuauaccuucggccaggguacaaagcuggagaggaaa

SEQ ID NO: 24245 - RNA, 369 nt, Artificial Sequence
  derived and/or modified sequence opt3 from anti-HIV_4KG5_HeavyChain
cagcuggugcaaagcggccccgaggccaagagaccuggguccucugucaaaguuucaugcaaggcuaguagggacaccuucaacaauuacgugcucaacuggguacggcaggcaccaggacagggucuugaauggaugggcgggaucggaccgauuauagagacagccgauuaugcggaaaaauuucgcggccgacugagcaucacugcugacgaguccacgaccacagccuacauggaauugucuucguuaacuucagaugacaccgcaguguauuacugugcccguagccccuauaguucccugacagauaccuacuauuacuacauggaccuaugggguaaggggacuacagucaccgugucuagc

SEQ ID NO: 24246 - RNA, 336 nt, Artificial Sequence
  derived and/or modified sequence opt3 from anti-HIV_4KG5_LightChain
cugacccagagccccgacucccucgccgugucucuuggcgagagagcuacaaucaacugcaagucaagucaaagcauucuggauuccucuaauaacaggaauuacuugacuugguaucagcagaaaccugggcagccaccgaaguuacugauauacugggcaucgacgcgggaaucaggaguccccgaccgcuucagcgguaguggcuccucuaccgauuuuacacuaacuaucagcucccuccaagccgaggacguugcgguguauuacugucagcaguauuucucaaccccugggauuacauuuggacagggcacccgacuggaaaucaaacgu

SEQ ID NO: 24247 - RNA, 309 nt, Artificial Sequence
  derived and/or modified sequence opt3 from anti-HIV-1_LightChain
gagaucgugcugacccagagccccgccacacucucccuuucuccuggcgaaagagcuacucugucaugcagggcaagucaaagcgucuacacgaaguuggccugguaucagcagaaaccagggcagccgccccgguuacugauuuacgacgcguccaaccgcgcugccggaauaccugcacgauucucugguucgggcucagggaccgaguuuacacuaacuaucaagcguauggaaagagaggauuucgccguuuauuacugucaaauucucgaauuuuucggacagggcaccacaaucgacaugaau

SEQ ID NO: 24248 - RNA, 312 nt, Artificial Sequence
  derived and/or modified sequence opt3 from anti-HIV-1_LightChain
gacauccagaugacccaaagccccuccucugugucagccagugucggcgauagaguuacaauuacuugcagggcuagccaggggauacuguccucucagcucgcauggcaccagcaacggcgcggacagccuccacgacuucugaucuacgguggcucgaaccgugccccggggauucccgagagauucacgggaucaggcagcgguaccgacuuuguguugacaaucaagagguuacagcgggaugacuucgcgguauauuacugucagauucuggaauuuuucgggcgcggaacuagaguggagaugaau

SEQ ID NO: 24249 - RNA, 312 nt, Artificial Sequence
  derived and/or modified sequence opt3 from anti-HIV-1_LightChain
ggccugcuccuuacccagagccccgggccuguguccuucuuuccaggagagagagccacagucucuugcagggcuucacacaguguuaacagcgcagccaucaauugguaccaacagaagcggggucagccgccccgccugauuauaguggacggcuccacucgagcgacggcuguaccugaacguuucucugccaccgggucgggaacagaguuuacuuuggugaucucaagauuagaaccagaggauuucgcagucuauuuuugucagcaucugcaauucuuuggccuagguaccaaaguggacauuaag

SEQ ID NO: 24250 - RNA, 312 nt, Artificial Sequence
  derived and/or modified sequence opt3 from anti-HIV-1_LightChain
gccuucgugaugacccagagccccggcacacuggcucucuccccuggggagagagcaacucuuucuugcaggacgucacaagaaauccugaguaaccaguuggccuggcaccagcagcggcgcggacaaccaccgcgauuacugauuuacgguggcagcaaucgugcgcccgggauaccugagagauuuaccggauccggcucugguacagacuucguccuaacuaucaacaggcucgaacgggaugacuuugcuguuuauuacugucagauucuggaguucuuugggcgcggaaccagaguggaaaugaau

SEQ ID NO: 24251 - RNA, 312 nt, Artificial Sequence
  derived and/or modified sequence opt3 from anti-HIV-1_LightChain
ggcaucgugcugacccagagccccgacacacucucccuuucuccuggggauagagccacucugucaugcaagacgagucaaagcauugcuuccgagcacuuggcaugguaccagcagaggccaggacagccgccccgguuacugauauucggugccucuaaccgcgcgucgggcaucccuacccgauuuucagggagcggaaguggcgcugacuucacacuauccauuacucgucucgaaccagaggauuuugccgucuauuacugucaauucucugaauuuuucgguagaggggcaaggguugaggugaaa

SEQ ID NO: 24252 - RNA, 312 nt, Artificial Sequence
  derived and/or modified sequence opt3 from anti-HIV-1_LightChain
caguucgugaugacccaaagccccgccacacuguccucuucaccuggcgggacugcuacgcucaguugcagaaccagccacuccauccuuaacucucagcuggcauggcaucagcagaggcggggacaaccauugcgcuuacugauuuacggugccucgaaucgagcgccgggcauacccgagcguuuuucagcuagcgggaguggaacagaguucguccuaacuaucaagagaauggaaagggaagacuuugccguuuauuacugucagauucucgaguucuuuggccaggguaccacaaucgauaugaac

SEQ ID NO: 24253 - RNA, 354 nt, Artificial Sequence
  derived and/or modified sequence opt3 from anti-HIV-1_HeavyChain
agagugcaccugguccagagcggcacccaaguuaagaaacccggggccuccgugaagguaucuugcgagacaucaggauucaaauuucucgacagucuuauccauugggugaggcaggcuccuggucagggccuguacuggaugggguggauuaagccauaucggggaagcgucaacuacgauggcuauuuccgcggucgaguguccaugacucgugacauauacacggauaccgcauauuuggaauuaucugggcugagaucggacgauacagccaucuacuauugugcguuuggagcuggcgacggcugggaucuaguuugggggcagggaacucucgugauugucucaagc

SEQ ID NO: 24254 - RNA, 354 nt, Artificial Sequence
  derived and/or modified sequence opt3 from anti-HIV-1_HeavyChain
agagugcaccugguccagagcggcacccaaguuaagaaacccggggccuccgugaagguaucuugcgagacaucaggauucaaauuucucgacagucuuauccauugggugaggcaggcuccuggucagggccuguacuggaugggguggauuaagccauuccggggaagcgucaacuaugauggcuacuuucgcggucgaguguccaugacucgugacauauauacggauaccgcauacauggaauugucuggguuaagaucggacgauacagccaucuauuacugugcguucggagcuggcgacggcugggaucugguuugggggcagggaacucuagugauugucucaagc

SEQ ID NO: 24255 - RNA, 354 nt, Artificial Sequence
  derived and/or modified sequence opt3 from anti-HIV-1_HeavyChain
caggugcaccugguccaaagcggcacccagguuaagaaacccggggccuccgugagaguaucuugcgagacaucaggauucaaguuucucgacaguaucauucauugguucaggcaggcuccuggugaaggcuuguuuuggaugggguggauaaaaccauacacuggaagcgugaacuauguccggcgcuaccagggccgaguguccaugacgcgugauguuuauucugacaccgcauacauggaucugucgggucuuaauucagacgauacagccguguauuucuguacuuacggggcgggagacggcuggaacuuagucuggggccaagggacccuggugaucguaagcgcu

SEQ ID NO: 24256 - RNA, 363 nt, Artificial Sequence
  derived and/or modified sequence opt3 from anti-HIV-1_HeavyChain
caggugagacugguccaaagcggcaaccagguuaggaagcccggggccuccgugcggaucucuugcgaggcuucaggauacaaauucauugaccacuuuauacauuggguacgccaggugccuggucacggccucgaauggcuuggguggaucaauccacgaggaggcggugucaacuauagucguggguuccagggaaagcugagcaugaccaugacaagagauaauuuugaggaaacugcauacuuggacuuauccaggcugaacccgggcgauacggccguguauuacugugcgcggggcuucgcuggguaugaguggucuuuucuauggggacaagguacccucguuauugugucguca

SEQ ID NO: 24257 - RNA, 357 nt, Artificial Sequence
  derived and/or modified sequence opt3 from anti-HIV-1_HeavyChain
caggugagccugguccaauccggcaaccagcucaagaaacccggggccucuguuagaaucucaugcgagaccaguggauacaauuuccuuaaccacuuuauucauugggugaggcagguaccuggucacggccuggaaugguugggguggauaaauccacggggaggcggugugaacuauagccgcaauuuccaggggaaggucuccuuaacacgaaacaucgacauggagacuguguaccuggauguucguggacuaacgccgggcgacaccgcuguguauuacugugcaagaggcuuugggggaucugauuggaauuucgucuggggucaaggcacaaggauuacugugucggcc

SEQ ID NO: 24258 - RNA, 357 nt, Artificial Sequence
  derived and/or modified sequence opt3 from anti-HIV-1_HeavyChain
agaaucaaccugcaccagagcggcucccaagugaagaggucuggggccucaguccggauuaguugcgagaccagcggauucaaauuuauggacucccaucuccacuggguucgccagguggcuggucagggcuucgaauggaugggguggauauuuacaucuggaggcgguguaaauuacgcacgacaguuccaagggcgucuuacucugacgagagauguguuuaccgacacagucuucauggauuugucgggagugaacguuggcgacacuggcguguauuacugugucaaggggaccggagguaaugaguggggcuuuucaugggggcagggaacagugguaguugugagcccc

SEQ ID NO: 24259 - RNA, 357 nt, Artificial Sequence
  derived and/or modified sequence opt3 from anti-HIV-1_HeavyChain
agaaucaaccuggaccagagcggcucccaagugaagaaaucuggggccucagucaggauuaguugcgagaccagcggauucaaguuuauggauucccaccuccauuggguucgccagguggcuggucagcccuucgaauggaugggcuggauauuuacaucugggggaggcguaaauuacgcacggcaguuccaaggucgacuuacucugacgcgugacguguuuucggagaccgucuucauggauuugucaggguuaaacgccggagacacaggcguguauuuuuguguuaaaggcacugggggaaaugaaugggguuucguguggggccaggggaccgucgugguaguuagcccu

SEQ ID NO: 24260 - RNA, 357 nt, Artificial Sequence
  derived and/or modified sequence opt3 from anti-HIV-1_HeavyChain
agaaucgagcugcaccagagcggcucccaagugaagaaaucuggggccucagucaggauuaguugcgaaaccagcggauucaaguuuauggacucccaucuccacuggguucgccagguggcuggucagcgguucgaguggaugggcuggauauuuacaucugggggaggcguaaacuacgcacgacaguuccaaggucgucuuagacugacuagggauguguuuucggaaucagucuucauggacuugagcggguuaaauaguggagauacgggcguguauuacuguguuaaaggcaccgggggaaacgagugggguuuuguguggggccaggggucccuggucgugguaucuccc

SEQ ID NO: 24261 - RNA, 372 nt, Artificial Sequence
  derived and/or modified sequence opt3 from anti-HIV-1_HeavyChain
caggcccuggugcaaagcggcucccagaugaagaaacccggggacucugucagacucucaugccagaccagugauagcgcuaucacaaaguacuucauucacuggauaaggcaggcaccuggaaaaggucuugaguggaucgccuggauuuccccauauggcgggcggguuaacuacggauggcaagugcgcgaccgagcgacucugacgcguaauauccauauggaaaccguauauauggauuugagaggcuuaaggccggacgauacagcuacuuacuauugugccaugcgggacuacugccgcgaugacaacuguaauagaugggaucugggucacugggggcagggaucucuaauuguggucucggca

SEQ ID NO: 24262 - RNA, 357 nt, Artificial Sequence
  derived and/or modified sequence opt3 from anti-HIV-1_HeavyChain
caggugacccugguccaaagcggcaaccagcucaagagacccggggccuccguuaggaucucuugcgagacaucaggauacaauuucauggaccacuuuauucauugggugcggcagguaccuggucacggcccagaauggcuugggugggugaacccgcgcggaggcggugucaauuauagucgaaaauuccaggggcguuuuagcaugacuagagauguguacauggagacggcuuaucuggacguuaccggauugucccccgcagauacagccguguacuauugugcgaggggcuucggcgggucugacuggucguuuuuauggggacaagguacucugauaaucgucucaagc

SEQ ID NO: 24263 - RNA, 324 nt, Artificial Sequence
  derived and/or modified sequence opt3 from anti-HIV-1_LightChain
gagaucgugcugacccagagccccggcacacucucccuuucugccggggaaagagcuucacugaguugcagggcaagccaaacuuugaacuccaauuucuuugccugguaccaccagaagccuggacaggcgccacgguuacugauuuauggugcuucuaaccgcgccacgggcauaccggaccgauucucggggucaggaagcggcagugauuuuacccuaacaaucucccgucucgagcccgaagacuucgguaaauacuauugugagcaguacgaugucucuccuagaacuuuugggcaaggaaccaagguugaaauuaaa

SEQ ID NO: 24264 - RNA, 324 nt, Artificial Sequence
  derived and/or modified sequence opt3 from anti-HIV-1_LightChain
gaggugguccugacccagagccccggcacacucucccuuucuccuggggaaagagccacucugucaugcagggcuagucaaagcaucaacuccaauuucuuugcaugguaccaccagaagccaggacaggccccgcgguuguuaauuuauggugcgucuucgcgcgcuacgggcauacccgaccgaaucucagggaccggaagcggcgccgauuucacacugacuauuaccggucuagagccugaagacuuugggcucuacuauugucagcaauacgauuucaguccacguacauuuggacagggcaccagaguugagaucaaa

SEQ ID NO: 24265 - RNA, 324 nt, Artificial Sequence
  derived and/or modified sequence opt3 from anti-HIV-1_LightChain
gaggugguccugacccagagccccggcacacucucccuuucuccuggggaaagagccacucugucaugcagggcuagucaaacgaucaacagcaauuucuuugcaugguaccaccagaagccaggacaggccccgcgguuguuaauuuauggugcguccucucgcgcuaccggcauacccgaccgaaucucggggucaggaagcggcacagauuucacucugaccauuacaggucuagagccugaagacuuugggcucuacuauugucagcaauucgauuuuaguccacguaccuucggacagggcacuagaguugagaucaaa

SEQ ID NO: 24266 - RNA, 324 nt, Artificial Sequence
  derived and/or modified sequence opt3 from anti-HIV-1_LightChain
gagaucgugcugacccagagccccggcacacucucccuugccccuggggaaagagcuacucugucuugcagggcaucacaaaguauuagcacgaccuacuuggccugguaucagcagaagccaggacaggcgccgcgguuacugauauacgagacauccucucgcgcuucggacauccccgaucgauucucagguagcggcagugggacugacuuuacccuaacaauuucccgucucgaaccugaggauuucgccgucuauuacugucaccaauaugacagaucuccaaggaccuuuggacagggcacuaaaguugaaaucaag

SEQ ID NO: 24267 - RNA, 336 nt, Artificial Sequence
  derived and/or modified sequence opt3 from anti-HIV-1_LightChain
gacaucgugaugacccagagccccgccucccugucugucacaccuggcgagacugcuucaauuaguugcaaguguagcagaucccucagggaagagguuggguacaacuaucuugauugguaccugcaacggccaggaaaaucuccgcaguuguuaauauauguggguucguuccgcgcacccggcguaucagaacgauuucgugggagcggagagcacaaggacuucacgcugaaaaucgccagaguggaaccuggcgaugcggguauuuacuauugcaugcaggggaucgacaccccaaggacauuuggacagggcacuacccuagagauuaau

SEQ ID NO: 24268 - RNA, 321 nt, Artificial Sequence
  derived and/or modified sequence opt3 from anti-HIV-1_LightChain
gacauccagaugacccaaagccccuccucucugucagccagugugggcgauagagucacaauuacuugcagggcuagccaggcauuccggaacgaccucgggugguaccagcacaagccuggaaaagccccagagcgccuuauauaugcgacguccacccuggaaucugguguuccgucgcgauuuucaggcagcgggaguggaacaaauuucacuuugaccaucuccucuuuacaggcugaggauuuugccacauacuauugucugcaauacaacaccuucccccguacuuuuggccaggguacaaagguggaaauuaaa

SEQ ID NO: 24269 - RNA, 333 nt, Artificial Sequence
  derived and/or modified sequence opt3 from anti-HIV-1_LightChain
aacuucaugcugacccagccccacagcguguccgagucuccuggcaagacagucacuaucucaugcgccagaacgaggggagggauugacagugcuuacguucauugguaucaacagcggccagguagcgugccgaccacaguaauauuugaagauaaucgccgacccccuggcgugccagaccguuucuccgggucuaucgauacuucgucaaacaccgcaagccucacaauuaguggacuuaaaaccgaggacgaagccgauuacuauugucaguccuacgacgauacuuauuuuugggucuucggcggugggacaaagcugaccguguug

SEQ ID NO: 24270 - RNA, 333 nt, Artificial Sequence
  derived and/or modified sequence opt3 from anti-HIV-1_LightChain
aacuucaugcugacccagccccacagcguguccgagucuccuggcaagacagucacuaucucaugcgccagaacgagggggaccauugacagugcuuacguucauugguaucaacagcggccaggagcagugccgacaacuguaauauuugaagaugaccgccgacccagcggugugccugaucguuucuccggcucuaucgacucgucaagcaauagugccucccucaccauuucugggcuuaaaacagaggaugaagcggacuacuauugucagagcuacgauuccaacuauuacugggucuuuggaggcgguaccaagcugacuguguug

SEQ ID NO: 24271 - RNA, 396 nt, Artificial Sequence
  derived and/or modified sequence opt3 from anti-HIV-1_HeavyChain
caggugcaacugcagcagagcggccccgcccucgucaagccuuccgagacccuuucucugacaugcucaguuaguagcgggagaguguccucuuacuauuggucguggaucaggcagucaccaggaaaagguuuggaauggauuggcuacauacacuaugacccggauacuaacacgaauuaccggacccauuaucaccccagcuuacgcgggcgaguagugaucagugucgacuccucuaagagccaagugucccugaaaguucguucagugacagcugcagauagugcccuauacuauugugcgagacauagguacgacccuuggagcaagggauacgauauucggucuccauucgacuuuuggggccaggguacucucgucaccguguccuca

SEQ ID NO: 24272 - RNA, 396 nt, Artificial Sequence
  derived and/or modified sequence opt3 from anti-HIV-1_HeavyChain
caggugcaucugcaacagagcggccccgggcucgucaagccuuccgagacccuuucucugacaugcacuguuucaggagguagagugaguagcuacuauugguccuggaucaggcagucuccaggcaaaggguuggaauggauuggauacauacacuaugacccggauacgucgaccaacuaccggacacacuaucaucccucauuacgcggccgaguagugaucagcgucgacaccaguaagaaucaggugucccugacuguucguucugugacagccgcugauagcgcacuauacuauugugccagacacagguacgacgucugguccaacgguuacgauauucggucaccuuaugacuucugggggcgcggaacccucgugacuguaaguagc

SEQ ID NO: 24273 - RNA, 396 nt, Artificial Sequence
  derived and/or modified sequence opt3 from anti-HIV-1_HeavyChain
caggugcaccuggagcaaagcggccccgcccucgucaagccuuccgaaacccuuucucugacaugcacuguuucagggggaagagugaguagcuacuauugguccuggaucaggcagucuccagguaaaggcuuggaguggauuggguacauacauuaugacccggauacgucgaccaacuaccggacacacuaucaucccucauuacgcggacgaguagugaucagcgucgacaguuccaagaaucaggugucucugaaaguucguagcgugacugcugcagauuccgcccuauacuauugugcgagacacagguacgacgucuggucaaagggcuacgauauucggaguccuuucgacuuuuggggucgcgggacccucgugacaguaagcucu

SEQ ID NO: 24274 - RNA, 390 nt, Artificial Sequence
  derived and/or modified sequence opt3 from anti-HIV-1_HeavyChain
cagguggucuuccaaaagcccggcccugggguugugaaaccaagcgagacccugucccucacaugcacuguaucuggagguagagugaggucauacuauuggaguuggauccggcuuccgcccggccaggggcuggaauggauuggauacauacacuaugacgagacgaccgaauacaagcgcagcuauaacccuuccuugaaaucucgaaucacaauuucgauggauacuucaaagaaucaggucagcuuaaaacugaguuccgugaccgccgcugacgcagccguuuacuauugugcgcgucauagauacgauagguggucugacagcuacgauauccgguccccauuugacauuuggggccaggguacaguggucaccgugucagcu

SEQ ID NO: 24275 - RNA, 396 nt, Artificial Sequence
  derived and/or modified sequence opt3 from anti-HIV-1_HeavyChain
caggugcaacugcagcaguggggcgccgggcuccuuaagcccagcgagacccuguccuugacaugcgcuaucuacggaucuucauucaguggucacuauuggauguggauuagacagagcccugcaaaaacuuuagaauggauagccgagaucaaccauacgggcgggaccagguacaauccaucccuggcgucucggguccgcguuuuuagugacacaucaaagaaccaauucagccuaaauaugacuucgcucaccgcugccgauacaggaauuuauuacugugugcgaggccaccugucccgugacagacuuggucaguaugcauuuuggucuggggcccugaucgauuacuuggacccguggggacagggcacccucguaacugugagcucc

SEQ ID NO: 24276 - RNA, 387 nt, Artificial Sequence
  derived and/or modified sequence opt3 from anti-HIV-1_HeavyChain
caggugcaacugcaccaguggggcgccgggcuccuuaagcccagcgagacccuguccuugacaugcgcugucuacggaucuuucacugguuuucaguggacguggguuagacagaccccuggcaagggguuagaauggaucggagagauuaaccauucaggccugcuagugacagguaagacugacuauaauccaagucucgaaagcaggguaaccauauccguggauacaucuaaaaaccaauucucgcugaaacuuaccucagucacugcagccgacacagggguguacuauugugcgcgggcuggaggcaugagcgauugggccuacccguauuacuauggcauggacguuugggggcagggaaccauggugacggucaguucc

SEQ ID NO: 24277 - RNA, 357 nt, Artificial Sequence
  derived and/or modified sequence opt3 from anti-HIV-1_HeavyChain
caggugcaacuggucgagagcggcgggggaguugugcagcccgguagaucccucacccuuucuugcgccacaucaggcuucgacuuuaguagcuacggguuccacuggguaaggcaggcuccuggaaagggccugcaguggguguccaucauuucucaugaugguucgaucaaaaacuauggggacucaaugaagggacgguuuagcgucagucgcgauaaugcaaaagacauauuguacuuacaaaugaacucccugcgaccagaugacacugcccuauaucacugugugcguggcgauggcgaaaaugggggaacggacuacuggggucucggcacccugguuacagugucugcg

SEQ ID NO: 24278 - RNA, 357 nt, Artificial Sequence
  derived and/or modified sequence opt3 from anti-HIV-1_HeavyChain
cagguggaccuggucgagagcggcgggggaguugugcaacccgguaagucccucaaacuuucuugcaccgccucaggcuucacauuuacgaguuacgggaugcacuggguaagacagaucccuggaaagggccuggaauggguggcuauuauaagccaugaugguacuaucaaaaacuauggggacuccgucaagggaagguucaccauuucucgggauaaugcaaugaacaucuuguacuuacagaugaauaaccugcgcggcgacgauacagcccuauauuacugugugcgaggcgacggggagaauggagguacugauuauuggggccaggggaccguugugacagucucguca

SEQ ID NO: 24279 - RNA, 369 nt, Artificial Sequence
  derived and/or modified sequence opt3 from anti-HIV_V3_HeavyChain
gaggugcagcugguccaaagcggcgccgaaguuaagaaacccggggagucccucaagaucucuugccagggauucgguuacaccuuuucaacauauuggauuggcugggugagacagaugccugggaaaggacuugaauggcugggcauaaucuacccagaggacagugaaacuauuuauagcccguccuuccagggucaagcuacgaucucugcagauaagucguugucaaccgccuacuuacaguggagcgggcugagggcgagugacuccgcuauuuauuacugugcccggcuaggauauugcggcucuacaagcuguuccuuuuucgauuuuuggggccgcgggacucucguaaccgugucaagu

SEQ ID NO: 24280 - RNA, 369 nt, Artificial Sequence
  derived and/or modified sequence opt3 from anti-HIV_V3_HeavyChain
gaggugcagcugguccaaagcggcgccgaaguuaccaagcccggggagucccucaaaaucucuugcaagggaucagguuacaguuucagcacacacuggauugcuugggugagacagaugccuggcagggggcuugaauggaugggauuuauauauccagacgauuccgacacucgguacucuccgucgcugcagggccauguaaucauuucagcagauaagagcuugaguacggccuauuuacagugguccucucugaaagcgagcgacaccgcuauguacuauugugcccgccuagguggggaugaguaccaauccucaggaggcauggacguguggggccaggggacaacugucaucgugaguagc

SEQ ID NO: 24281 - RNA, 393 nt, Artificial Sequence
  derived and/or modified sequence opt3 from anti-HIV_V3_HeavyChain
gaggugcagcugguccaaagcggcgccgaaguuaagaaacccggggcuaccgugaagaucuccugcaaaguaucuggauacacacucacugacuauuacauucacugggugcagcaggcaccugguagaggccuugaguggcugggguuggucgauccagaaaacggagagacguuauaugccgaaaaguuccagggcagggugacccugacagcggacacuucaaccgauacagcuuacauggagcuaaaaagucuccgguaugaggacaccgccguuuacuauugugcaacugaagguccgcccagcuacuacgauuccgggacauaugccaagucucugccugcuucguuugcaugcuggggacaaggcacccuugugacggucucaagc

SEQ ID NO: 24282 - RNA, 369 nt, Artificial Sequence
  derived and/or modified sequence opt3 from anti-HIV_V3_HeavyChain
caggugcaacugcaggagagcggccccgggcucgucaagccuuccgaaacccuuucucugacaugcacuguuucaggagguaguaucaacaauuacuauuggagcuggauuagacagccaccgggcaaaggguuggaguacauaggauauaucuucuacuccggcucuacgaacuauaaucccucguuaaagucaagggugaccuuuagcguagacacaaguaaaaaccaguucucccugaagcuaacuucugugaccgccacagauaccgcugucuacuauugugcacgggguccucuccuguacuuuggggccccacgcacucacuucgacuacuggggacaaggcgcgcuugugacaguuagcucc

SEQ ID NO: 24283 - RNA, 372 nt, Artificial Sequence
  derived and/or modified sequence opt3 from anti-HIV_V3_HeavyChain
gaggugcagcugguccaaagcggcgccgaaguuaagaaacccggggagucccucaagaucucuugcaaaggaucagguuacaguuucagcucccacuggauuggcugggugagacagcuuccugggaagggacuggaauggaugggcauaaucuauccagacgauucugacaccaaauacaacccgucguuucagggucagguaacaauuucagcugauaggagcaucaguacugcauauuugcaaugguccucuuuaaaggccagcgacacggcgauguacuauugugcucgggugggguacgauuccuauggauacucaggcaguaauuucgacgaguggggccaggggacccuggucacagugagcucu

SEQ ID NO: 24284 - RNA, 357 nt, Artificial Sequence
  derived and/or modified sequence opt3 from anti-HIV_V3_HeavyChain
gaggugcagcugguccaaagcggcgccgaaguuaagaaacccggggagucccucaagaucucuugcaaaggaucagguuacaacuucaauagugacuggauuggcugggugagacagaugccugggaagggacuugaauggguaggcaugauauauccagaugacuuugaggugaggcacagcccgcccuuccagggucgggucaccauguccguggauaaaucuaucucgacagcuuaccugcaguggagcucauugaagaguuccgacacugggauguauuuuugugcacgcuuagauggaaacgccgcggcuuucgacuacuggggccaaggcacgcagguuaccgugucuagc

SEQ ID NO: 24285 - RNA, 360 nt, Artificial Sequence
  derived and/or modified sequence opt3 from anti-HIV_V3_HeavyChain
gacgugcagcugguccaaagcggcgccgagguuaagaaagcuggggaaucccucaagaucucuugcagacccucaggauacaacuucgcagauuauuggauugguugggugaggcagaugccuggcaaagggcuugaguggaugggaauaaucuuuccagacgauagugacacccgguacggcccgagcuucgaaggucagguaacaauuuccgccgauaagucuaucaauacugcguaucugcaguggaacucguugaaagccucagacacggcuauguacuuuugugcacgccacgggggaagcggcgccgcucccggcgauuauugggggcaaggaaccuuagugacagucaguucc

SEQ ID NO: 24286 - RNA, 363 nt, Artificial Sequence
  derived and/or modified sequence opt3 from anti-HIV_V3_HeavyChain
gaggugcagcugguccaaagcggcgccgaaguuaagaaacccggggcuaccgugaagaucuccugcaaaguaucuggauacacauucacugacuauuuuaugcacugggugcaggaggcaccugguaagggccucgccuggauggggcuugucgauccagaaaacggagacacgguguacgcggagaaacugcagggcagaguuaccaugucagcugauacaaguagggacacugccuauauggaauugaccagcuuacgguccgaggauacagcaguguacuauugugccauugguaagucugucgcugggaccucggcauacgacauauggggacagggcacuauggugacaguaucaagc

SEQ ID NO: 24287 - RNA, 369 nt, Artificial Sequence
  derived and/or modified sequence opt3 from anti-HIV_V3_HeavyChain
caggugcaacugguccagagcggcgccgagguuagaaagcccggggcuuccgugaaaguaucuugcaaggcaucaggagacaccuucaacaaucacgauaucaacugggugaggcaggccccuggucagggcccagaaugggucggguggaugaauccgaaaaguggaaacgcgggcuacgcucaaaaguuucagggucgggugacaaugacucgcgacacgagcauuuccaccgccuauauggagcuccgaucucuuacaucggaagauacugggguuuacuauugugcacgucugaccguggacugcgaugacggaggcuguuacggcgauuauugggggcagggaacauuggucaccgugucaagc

SEQ ID NO: 24288 - RNA, 354 nt, Artificial Sequence
  derived and/or modified sequence opt3 from anti-HIV_V3_HeavyChain
gagguguaccugcagcaaagcggcgccgaacucaaggagcccggggcuaacgucaaaaucuccugcaaggcauucggauuuauuuucaccgacuauuuuauacacuggcuuagacaggccccugguaaaggcccacaguggguuggggugguagauccggaagacggaucuacaacuuacgcggaggcuuuccagggcagggugucaaucacggccgaucggaguaccgacacagcauauauggaucuggccgguuugacuagcgacgauaccgcugucuacuauugugcauuaauguggaaugaauccgggcccgacaacuggggacaaggcacacuggugauuguuucuucg

SEQ ID NO: 24289 - RNA, 393 nt, Artificial Sequence
  derived and/or modified sequence opt3 from anti-HIV_V3_HeavyChain
gaggugcaggucguugaguucggcggggaagugaagaaacccggagccagcguaaagguguccugcgaggcuucugguuacaccuuugcaaaauucgccauccacugggucagacaagcgccuaggcagggccuggaauggaugggguggauuaacggagacgauggcaagacagaauauucacagaaauuucaggaccgggugacuaugacgcgcgauaccagugcuagcacaguuuacauggagcucuccucucuucgaucggaggacacugcccuguauuacugugcacgugccauguauccagauaccgugacagguaaugacaacccggcucccccuccauucgaaggggauuacuggggacaaggcaccuuggucacugugucaagc

SEQ ID NO: 24290 - RNA, 393 nt, Artificial Sequence
  derived and/or modified sequence opt3 from anti-HIV_V3_HeavyChain
gaggugcagcuggucgaaagcggcgggggacucguuaagcccgguggcucccuuagacugaccugcguggccucuggguucacauuuucagacguaugguugaacugggugaggcaagcuccuggaaaaggcuuagagugggucggucggaucaagagucgcacugaugggggaacgaccgacuacgcagccagcgugaaaggccgauucacaauuucccgugaugacucuaagaauacucuguaucuacagaugaacucgcucaaaaccgaagauacagcgguuuacucauguaccacugacggcuuuauaaugaucagaggggugagcgaggauuauuacuauuacuauauggacgucuggggaaaggguacaaccgugacgguaaguucc

SEQ ID NO: 24291 - RNA, 387 nt, Artificial Sequence
  derived and/or modified sequence opt3 from anti-HIV_CD4bs_HeavyChain
gaggaacagcugguggagagcggcgggggacucgucaagcccgguggcucccaaagacuuucuugcgccgcuucagaguucaccuuuaguagguacacaaugaacuggguucggcaggcaccugggaaaggacuggaaugggugagcuccaucucuggcaaugacaacaauauuuauuacgccgauucgguaaagggucgcuucacuauaucacgagacaacgcgcguaauagcuuguauuuacagaucaacagucugagaguggaagauacggcugucuacuauugugccagggggccacuagacuccuacgauuuuuggucuggaagccggcacuauuacggccucgacguguggggccaggggaccacaguuacuguguccuca

SEQ ID NO: 24292 - RNA, 372 nt, Artificial Sequence
  derived and/or modified sequence opt3 from anti-HIV_CD4bs_HeavyChain
caggugcaacugguccagagcggcuccgagcucaagaaacccggggccucuguuaaggugucaugcaaagcuaguggauacaccuucacaagccacaucauuaacuggguaagacaggcaccuggucagggccuugaauggaugggguggauaaauacuaacacgggaaauccaaccuaugcccaaggcuuuacagguagguucguguuuucccuggacacuucugucucgauggcguacuugcagaucagcucauuaaaggcugaggauaccgggguguauuacugugcccggggauuccgccaguggcugguugcacgaauuacauauuuugacuacuggggccagggcacccuagugacugucaguucc

SEQ ID NO: 24293 - RNA, 369 nt, Artificial Sequence
  derived and/or modified sequence opt3 from anti-HIV_CD4bs_HeavyChain
gagcugagacuccaggccagcggccccgggcuugugaagccuuccgaaacccugucuuuggucugcucaguuaguggagugagcaucuccgacucuuacuggaacuggauuaggcaaccagcugguaaaggcuuagaguggauagggcggguauauacacgcggaacucacacguacaauccgucgcugggcggucgagcaaccgugucaggggauacaaacaagaaugaagucagccuaaaacucaugagugugacugccgcggacaccgcuguuuauuacugugcccgugcacuguccggagauuggacaagaagguauuucuacauggacguguggggccggggcacccccgucacugugucuagc

SEQ ID NO: 24294 - RNA, 381 nt, Artificial Sequence
  derived and/or modified sequence opt3 from anti-HIV_CD4bs_HeavyChain
cagcugcaacuccaggagagcggccccagacuugugaagccuuccgaaacccugucuuugacaugcacugucucagggggaaguaucagcuccggugacuacuauuggacguggauuaggcagccaccgggcgagggguuagaauacauaggauauaucuacucuggcgguucgaccgauuauaaccccucacugaaaagccgggccaguauuucccaggacacaucuacuaaugaguucagccuaaagcucaccuccguuacagcugcagauaccgccguguacuuuugugcgcgcgaccgacguguacugcuuugguucggggaaccuagaaggggacuggauuuuuggggcccaggcacuuuggugacagucucaagu

SEQ ID NO: 24295 - RNA, 396 nt, Artificial Sequence
  derived and/or modified sequence opt3 from anti-HIV_CD4bs_HeavyChain
gaggugcagcuggucgaaagcggcgggggacucguuaagcccgguggcucccuuagacugucuugcgccgcuucaggguucaccuuuaguagcgcauggauguccugggugaggcaagccccuggaaaaggcuuggaguggguaggucggaucaagucuaaaucggacggggaaacaacugauuacgcggcuccagugaagggacgcuucacgauuucacgagacaacuuagagagcacccuguaucuacagcucaauagucugaaaacagaagauacugccgucuacuauugugcaaccgccacaccguccuacuaugacauaaugaccggcaacuacaaguauuacuacuauauggauguguggggcaaggggacuacaguuaccgugucuagc

SEQ ID NO: 24296 - RNA, 363 nt, Artificial Sequence
  derived and/or modified sequence opt3 from anti-HIV_CD4bs_HeavyChain
caggugcaacuggucgagagcggcgggggacucguuaagcccgguggcucccuuagacugucuugcgccgcuucaggguucaucuuuagggaccacuacaugaccuggauucggcaggcaccuggaaaaggcuuggaaugggugaguuauauaagcuccucuucgaacaauauccaguacgccgauucaguaaagggucgcuucacagugagccgagacaacgcgaaaaauaguuuauaucugcagaugaacucccuacgugcugaugacacugccgucuacuauugugcaagaucugggccauuuuacaauuauggaccgcccaacaauuggggccaaggcacgcucgugaccguuagcucc

SEQ ID NO: 24297 - RNA, 378 nt, Artificial Sequence
  derived and/or modified sequence opt3 from anti-HIV_CD4bs_HeavyChain
caggugcaacuggucgagagcggcgggggaguugugcagcccgguggcucccucacccuuucuugcacagccucaggguucccuuuuaacaguuacgcuaugcacuggguaagacaggcaccaggaaagggccuggaaugggugagcaugacuucccaugacggugggaauaaagauuucgucgacucugugaagggaagguuuacgaucucgcgggauaacucacgcaauaccuuguucuuacagaugaacagccugagucaagacgauacaggcguuuauuacugugugcgaggcaaacuagaggacuauaauuuuugggggcacuaccgugauuucgacuccuggggacaggguacucucgucaccgugucugcc

SEQ ID NO: 24298 - RNA, 405 nt, Artificial Sequence
  derived and/or modified sequence opt3 from anti-HIV_CD4bs_HeavyChain
gagccccacguggucgaaagcggcgggggaauggccaagccugguggcucccugagacucucuugcgcugggucaggauucaccuuuacaaacgcauggaugaauuggguuaggcaggccccaggcaaaggucuugaguggguggggcugaucaagaguaaaagcgacggaggcacuacggauuacgcggcugacguagaaggccgguucaccauuucccgcgaugacuuggagucuacaauguuuuuagaaaugcauucgcugcaaauagaggauacugccguguauuucuguaccacacaguacccgcgauauuacgaccuaaugaccgggaacuauaagcguagauacuuuucaagcggaauggaugucuggggucagggcacugcagugacaguuaguucc

SEQ ID NO: 24299 - RNA, 384 nt, Artificial Sequence
  derived and/or modified sequence opt3 from anti-HIV_CD4bs_HeavyChain
caggugcaacugcaggagagcggccccgggcucgucaagccuucccagacccuuucucugacaugcacuguuucaggagacagugugagcuccgguaacuacuauuggucuuggaucagacagccagccggcaaaccguuggaauggauugggcacauaucgacgggaggcgguaccaagaauaaccccucauuacaaagcaggguaacaaucagucuggauuccucuaaaaaucaggugagccuaucccucucaagugucacugcugcagacaccgccguguacacaugugcgcgggggccuccacgcagccugugguucggagaucccaccuauucuuacauggacguuuggggcaagggcacuacagugaccgucuccuca

SEQ ID NO: 24300 - RNA, 372 nt, Artificial Sequence
  derived and/or modified sequence opt3 from anti-HIV_CD4bs_HeavyChain
caggugcaacugguccagagcggcgccgagguuaagaaacccggguccucugugaagguaucaugcaaagcuaguggagguaccuucaacagccacgcauuuacaugggugagacaggccccuggccaggggcucgaauggaugggaggcaucauuccaacucuuggucuggcgaaugacgcucaaaaguuccaggggagguuuacgauaaccgccgaugaguccacaacuaccgucuacauggaauugucuucguuacggucagaggacacagcaguguauuacugugcccgccgaccguauuacgaucagguuagcggagugggcgcuuucgacaucuggggccaggggacccgugucacugugaguucc

SEQ ID NO: 24301 - RNA, 390 nt, Artificial Sequence
  derived and/or modified sequence opt3 from anti-HIV_V2_HeavyChain
caggugcaacugguccagagcggcgccgagguuaagaaacccggguccucugugaagguaucaugcgaagcuaguggagugaccagcuccucuuacacaaucucgugggucagacucgcaccuggucagggccuugaguggauggggaggauuacuccaauauucgacaucacgaacuaugcccagaaauuucaaggacgggugacccugacagcggauaagucaacuggcaccacauacauggaauugagcaguuuacgcuccgacgauaccgcuguuuauuacugugcccgagacaaaucugauguggucgugguaacuagcauucguccggcauauuacuaugguauggacguuugggggcagggaacaaccgugacggucuccuca

SEQ ID NO: 24302 - RNA, 366 nt, Artificial Sequence
  derived and/or modified sequence opt3 from anti-HIV_V2_HeavyChain
caggugcaacugguccagagcggcgccgagguuaagaaacccggguccucugugaagguaucaugcaaagcuaguggagguaccuucagaagcuacgcaaucuccugggugaggcaggccccuggccaggggcucgaauggaugggaggcauuauaccaaucuuugguacagcggacuaugcucaaaaguuccaggggaaagucacuauuacggccgaugagucuaccucgacagcauacauggaacuuucaagccugaccagugaggacacugccauguauuacugugcucggucccgcgaucacuuuuucgacacacgaguguuucagggauggggccagggcaccuugguuacugugucuagc

SEQ ID NO: 24303 - RNA, 363 nt, Artificial Sequence
  derived and/or modified sequence opt3 from anti-HIV_V2_HeavyChain
caggugcaacugguccagagcggcgccgagguuaagaaacccggguccucugugaagguaucaugcaaagcuaguggagguaacuucaauaccuacacaaucagcugggugagacaggcaccuggccaggggcucgaauggaugggaaggauuauaccaaucuuuggcauugucaacccggcccaaaaguuccccggucgggugacuaucaauguugacaaauccacgaacaccgcguauauggagcuuucuucgcugcgcucagaagauacagcuguguacuauugugccacuagcggggucggauugcacuuuggcuacuucgacuauuggggccaggggacccaggugacaguaaguucc

SEQ ID NO: 24304 - RNA, 378 nt, Artificial Sequence
  derived and/or modified sequence opt3 from anti-HIV_V2_HeavyChain
caggugcaacugcagcaguggggccccgggcuccuuaagccuagcgagacccuguccuugacaugcgccgucuacggagguucuuucggcagauauuacuggucauggaucaggcagaguagcggggaaggauuagaguggcugggccaaauugaccacacugguuccacgaccuauaacccaucucuaaaagggcggguuacaauaucgaucgauucaagcacuaaucaguuuagucucaaggugaccuccguaauugcugcagacacagccguguacuauugugcgcgcgcuccgucuggauaccccggcgucagccuguaucaguacuacggccuugaugugugggggcagggaaccacuguuacaguguccccu

SEQ ID NO: 24305 - RNA, 366 nt, Artificial Sequence
  derived and/or modified sequence opt3 from anti-HIV_V2_HeavyChain
caggugcaacugguccagagcggcgccgagguuaagaaacccggguccucugugaagguaucaugcaaagcuaguggagguaccuucagcaacuacgcaaucuccugggugagacaggccccuggccaggggcucgaauggaugggaggcauuauaccaaucuuugguacaacugacuaugcgcaaaaguuccaggggagggucacgauuaccgcugaugccucuacaucgacugcauacauggagcuuucaagccugcggagugacgauaccgccguguauuacugugcucgcucccgaggacacuauuuugacacacguguuuucgaaggcuggggccaggggaccuuggugacugucucuagc

SEQ ID NO: 24306 - RNA, 372 nt, Artificial Sequence
  derived and/or modified sequence opt3 from anti-HIV_V2_HeavyChain
caggugcaccugguccaaagcggcaccgagguuaagaaacccggggccuccgugacaguaucuugcaaggcuucaggauacaguuucacugguuauuaccuccauugggugagacaggcaccuggccaggggcuugaauggaugggauggaucaacccaaauagcggcgguacguauuacgcccagaacuuucaagcgagggucaccaugacacgggacacuuccauuucuaccguguauauggaucugucgcgcuugcgaucagacgauacagcuguuuacuauugugugcguagagccgucuuaaccgcacugccgcccagguacuacuucgacuuuugggggcagggaacucuagugacaguaagcagu

SEQ ID NO: 24307 - RNA, 318 nt, Artificial Sequence
  derived and/or modified sequence opt3 from anti-HIV_V3_LightChain
agccuggagcucacccagcccccuuccgugucugucucaccaggccaaacaguuaguaucacuugcagcgggaaccuucugggagacaaggaugccuccugguaccaguugaaaccgggucagucucccauuuuagugauauaucuggacacggaaagaccuucgggcaucccagagagguucucagggagcaagaguggaaauaccgcuacacuaacuauuuccggcacccaggcaauggaugaagccgaguacuuuugucaagcgugggacacaaccacuguacucuucggugggggaacacggcugaccgugcuu

SEQ ID NO: 24308 - RNA, 324 nt, Artificial Sequence
  derived and/or modified sequence opt3 from anti-HIV_V3_LightChain
agcgacgagcugacccagcccccuuccgugucugucucaccaggccaaacagccagaaucacuugcaguggggaugcucucccggaaaaguacgcauauugguaccagcagaaaagcggacaggcccccguucuugugauugacgaggauaacaagaggccuuucgguacgccagaacgguuuuccggcucucgcucggggaccauggcgacacugacuauaaccggagcucaaauggaggacgaagccgauuauuacuguucaagcacagacagucgaggcaccuauuggguauucggugggggaacuaaauugacaguguua

SEQ ID NO: 24309 - RNA, 336 nt, Artificial Sequence
  derived and/or modified sequence opt3 from anti-HIV_V3_LightChain
cagagcgugcugacccaacccccuuccgucucugccgcuccaggccagaagguuacaaucucaugcagugcagggaacagcaaaauuggagacaauuacauauccugguaucagcacgugccgggugccgcgcccaagcuccuuaucuacgagaacgauaaaagaccuucuggcauuccagacagguucucggggucaaagagcggaacgagugcuucccugggcaucacugguuugcagaccggggaugaagccgacuauuacugugcagccugggauaauucuuuaagcuccgcucuguauguauuuggaacaggcacuaaagugaccguccua

SEQ ID NO: 24310 - RNA, 339 nt, Artificial Sequence
  derived and/or modified sequence opt3 from anti-HIV_V3_LightChain
gacaucgugaugacccagagccccgauucccuggccgucucucucggcgagagagcuacaauuaacugcaagucaagucaaaauguuuucuacagcuccaacaauaggaacuaucuugcaugguaccagcagcggccugggcagccaccgaaacuguuguuuuauugggccucuacucgcgaaucgggagugcccgaccgauucucagguagcggcagugggacggauuuuaccuuaacaauauccucucugcaaacugaggacguagcgaucuacuauugucagcaguacuauaauaccccuccaacauucggacccggcaccaagguggaaauuaaa

SEQ ID NO: 24311 - RNA, 318 nt, Artificial Sequence
  derived and/or modified sequence opt3 from anti-HIV_V3_LightChain
agcuacgagcugacccaacccccuuccgugucugucucaccaggccaaacagccacuaucacgugcaguggggaccuccuuggagauaaguaugcuagcugguacagacagaaaccgggucagucccccguucuggugauuuaugaagacaccaagaggccuucuggcuugccagagcgguucucggggucaaacagcggaaauacagcaacuuuaaccauaagugaaacacaggccauggaugaggcggacuacuauugucaggcuugggauacccgcacuguaguguuuggcggugggacaaaacugaccguccua

SEQ ID NO: 24312 - RNA, 327 nt, Artificial Sequence
  derived and/or modified sequence opt3 from anti-HIV_V3_LightChain
cagagcgugcugacccaacccccuuccgucucugccgcuccaggccagaagguuacaaucucaugcagugggagaagcuccgacauugagaacaaauucgugucuugguaccagcagcucccgggaacugcacccaaacuucugauauaugaagauaauaagaggccuucggguaucccagaccgguuuucaggcagcaagagugggacguccgccaccuugggaauuacaggcuuacaaacuggugaugaggcggacuacuauugugggaccugggauaacaaucugcgcgcuggauucggcggcgggacacaccuaaccguacuc

SEQ ID NO: 24313 - RNA, 324 nt, Artificial Sequence
  derived and/or modified sequence opt3 from anti-HIV_V3_LightChain
agcuacgagcugacccagcccccuuccgugucugucucaccaggccaaacagccagaaucacuugcaguggggacgcucucccgaacaaguaugcauucugguaccagcagaaaagcggacaggcccccguucuugugauuuuugaugacaauaggcggccugcggguauaccagaacgcuucuccggcucucgaucggggacgcuggcuaccuugacaaucucaggagcccaaguagaggaugaagcagacuauuacuguuauagcacugauaacgacggcaaguacuuuguguucgguagugggaccauggucacaguguua

SEQ ID NO: 24314 - RNA, 318 nt, Artificial Sequence
  derived and/or modified sequence opt3 from anti-HIV_V3_LightChain
agcuacgagcugacccagcccccuuccgugucugucucaccaggccaaacagccaguaucacuugcagcgggcacaagcucggagacaaauaugcuuccugguaccagcauaagccgggucagucucccguucuugugauuuaugaagauacgcagagaccuucgggcauaccagagaggaucucagggagcaaaaguggaaacaccgcaacacugacuauuuccggcacccaagccauggacgaagcggauuacuauugucaggcuugggacucucgggccgcaguauucggugggggaacacgcuugaccguguua

SEQ ID NO: 24315 - RNA, 327 nt, Artificial Sequence
  derived and/or modified sequence opt3 from anti-HIV_V3_LightChain
cagagcgcccugacccaacccgcuuccgugucuggcucaccugggcagaguaucacaauuagcugcacuggaauauccucugacaucgguacggauaacuacgucucgugguaucagcagcacccaggcaaggcaccgaaacucauuaucuacgagguuucaaauagacccagcgggauuagucauagguucuccggaucuaagagcggcaacaccgccucccuuaucauaucaggucugcaaguggaagacgaggcgcacuauuacuguaauaguuaucggagcgauacauugguauuugggggaggcacuaaagugaccgucuua
